United States Patent 11,098,302 (IDENTIFICATION OF POLYNUCLEOTIDES ASSOCIATED WITH A SAMPLE) - sequence listing, part 110

SEQ ID NO: 378878 - DNA, 551 bp, Homo sapiens
  misc_feature: GZ8MTXP02F9HEK.44.70.G04.1.454.CMB.2.raw
  modified_base (263)..(263): a, c, t, g, unknown or other
  modified_base (267)..(267): a, c, t, g, unknown or other
  modified_base (304)..(304): a, c, t, g, unknown or other
  modified_base (340)..(340): a, c, t, g, unknown or other
  modified_base (346)..(346): a, c, t, g, unknown or other
  modified_base (365)..(365): a, c, t, g, unknown or other
  modified_base (367)..(367): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagcttggtttttcctcgttgcttcttttaagaggtgtccactgtcaggtgcacctggtggagtcgtgggggagcgtggtccagccgtggggacgtccctgagactctcctgtgaancctntggtatttgttcagttgtctggcatgcacgtggtccncaggcctcgaggcgaaggggcgagtggtgcagttanagcatntgatggaattcagtaattntngctagaccgtcgtaggaacggcctatccacatccacagacacctaagttcccgaatagttgtagtacgttaggaaattggacagcctaggagtagtcggaagccgtcgtacttcgtagtattacgtggtgacgtagtacgtcgggtaaggtgtaagttacgttacgtacgggctacgtgtacgg

SEQ ID NO: 378879 - DNA, 634 bp, Homo sapiens
  misc_feature: GZ8MTXP02HQRDR.44.70.G04.1.454.CMB.2.raw
  modified_base (584)..(584): a, c, t, g, unknown or other
tcagacagtatatacacgaccggtgctcgatttagtgtagtgtgaagggaaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggtcgttgtcgtgggtgcggcaccggcccccggaaaggccctggagtggatcgcactcacttatggaatgacgatatacgatatagtccttctctgacgaccagactcacgcctacaacgaacggacacgtaaccaaaaacgtggtacgtaccttacacttacgaccgaaacgtcgacccttgacggacacgaggccactaacttatttctgtacgtaccctactttcagttacgaaccaactaactacgaaccgaaccgggttccttacgtttaccggaaccccgttcgggggacccgaacggggtaaccttcccggaagggtcccaaccggttcctaccgacttccgacncccgttacccaacccgaaccgggccctacgtcccggttcccttcccccgg

SEQ ID NO: 378880 - DNA, 539 bp, Homo sapiens
  misc_feature: GZ8MTXP02F2IJO.44.70.G04.1.454.CMB.2.raw
  modified_base (342)..(342): a, c, t, g, unknown or other
  modified_base (347)..(347): a, c, t, g, unknown or other
  modified_base (421)..(421): a, c, t, g, unknown or other
  modified_base (425)..(425): a, c, t, g, unknown or other
  modified_base (446)..(446): a, c, t, g, unknown or other
  modified_base (464)..(464): a, c, t, g, unknown or other
  modified_base (472)..(472): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtctgggggaggcgtggtccagcctgggaggtccctgagactctcctgtaaagcctctggatttagttcagtgttctggcatgcacgtgggtcccgcaggctccgaggcgaaggggccggagtggttggcagttanagcanatgatggaagttctagaattattatgcagactccgtgaacggccattccacatcacagacacaacttcccgaanttgntactgaaatggtcagctgagngtcgagtctcggctcgtntacttacngtacgcgtagagtcggggaggttggtaaggtacgttaacggttaccggggctacagtcggtaccggg

SEQ ID NO: 378881 - DNA, 717 bp, Homo sapiens
  misc_feature: GZ8MTXP02JUNZC.44.70.G04.1.454.CMB.2.raw
  modified_base (260)..(260): a, c, t, g, unknown or other
  modified_base (307)..(307): a, c, t, g, unknown or other
  modified_base (353)..(353): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtgggggagcgtggtccagccgtgggagtccctgagctctctgtgagcctntggtatttagttcagttggttctggctagtcgctacgtcgggtcccncgaggcctaccgaggcgaaggggccgtaggtggttggctagtttanacgcacgtatcggatgggtaaactttctagtaaattatttagcggactacggtaccgtcccgggtaggaaaccggggtccctaatttacccgaaaccctagtttaccccgtacccgaaagggtaaaccgtaacccgtaaacgtttaccccccggggaaaattgtttacggttacggttaaaccgtttagggaaaactttcggggtaccaacggtcccttagggaaccgtagggttcggaaacggtccgttcggtactaccgtttagtacgtttacggtggtacggacggtaggtacgggttacgggggtaggttaaggttaacggttaacggttaccggtaccgggacgtacgtacggtacggg

SEQ ID NO: 378882 - DNA, 602 bp, Homo sapiens
  misc_feature: GZ8MTXP02F71J0.44.70.G04.1.454.CMB.2.raw
  modified_base (212)..(212): a, c, t, g, unknown or other
tcagacagtatatacacgaccggtgctcgatttagtgtagtgtgaagggaaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttcncactcgtcactcctggagagggtcgttgtcgtgggtgcggcaccggcccccggaaaggcccgtggagtggactcgcactcacttatggatgacgatatacgatatacgtccttctctcgacgacacgactcgacgccctacacgaacgacacgtacccaaaacgcggtcgtacttacattcgaaccgtacgtcgacccgtgtacggacaacgaggaccactattactttcgtgtaccgaccctactttcatcgaaccaactaagtcgaacccgtacgggtcttaccgttaccggaacccggtcggggaccgaacggtactaccgacggtactaccgtctacacgtcaaccgtccaccaccgaacggtccctacgtccgtccgttcccccg

SEQ ID NO: 378883 - DNA, 626 bp, Homo sapiens
  misc_feature: GZ8MTXP02I72VH.44.70.G04.1.454.CMB.2.raw
  modified_base (309)..(309): a, c, t, g, unknown or other
  modified_base (351)..(351): a, c, t, g, unknown or other
  modified_base (358)..(358): a, c, t, g, unknown or other
  modified_base (380)..(380): a, c, t, g, unknown or other
  modified_base (423)..(423): a, c, t, g, unknown or other
  modified_base (610)..(610): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtgggggaggcgtggtccagccgtgggagtccctgagactctcctgtgaagcctctggtatttagttcagttggttctggcatgctacgtcggggtcccnccaggcctccgaggcgaaggggccgaggtggttgctagttanagcatangatggaattctagaattagttncgtcaagtaccgtcggtaggaaacggggtcctaattccacctntccaccgaagacgtaacctaaacgttccccggaaatgttacggtagttaacgttaggaaaacgtttcggtacacgggccttaggaacggtacgtacggacgggtacctcggggcttcgtagttacttagtggtaggtagtagacgggttggggaggttggttaagttacggtttacggtaccggggntaccggtacgtacggg

SEQ ID NO: 378884 - DNA, 629 bp, Homo sapiens
  misc_feature: GZ8MTXP02I3Y3J.44.70.G04.1.454.CMB.2.raw
  modified_base (370)..(370): a, c, t, g, unknown or other
  modified_base (429)..(429): a, c, t, g, unknown or other
  modified_base (449)..(449): a, c, t, g, unknown or other
tcagacagtatatacacgaccggtgctcgatttagtgtagtgtgaagggaaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactccgtggagagggtcgttgtcgtgggtgcggcaccggccccggaaggccctggagtggatcgcactcacttatgatgagatatacgatatagtccttctctgacgaccagacctcacgcctacacgaagaccacgtaacccaaaacgngggtcgtacccttaactacttacgaacctaacggtcggtaaccctggtacggacaacgnggacaactattaactttcgngtccgaccctacttaccatacgaaccctacgaacttacggaacccgtacgggtacctttccgtaccggaacccggtcgggggaccaacggggtaactccgacgggtcctaccgttcgtacactcgaccgtcccgtacccgaaccgaccggacccctacgttcccggtccctttcccccgg

SEQ ID NO: 378885 - DNA, 707 bp, Homo sapiens
  misc_feature: GZ8MTXP02GRW6Q.44.70.G04.1.454.CMB.2.raw
  modified_base (195)..(195): a, c, t, g, unknown or other
  modified_base (306)..(306): a, c, t, g, unknown or other
  modified_base (352)..(352): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagctgggttttcctcgttgctcttttaagaggtgtccactgtcaggtncacctggtggagtcgtgggggagcgtggtccagcctgggagtccctgagactctcctgtgaagcctctggtatttagttcagttggttctggctagtgcacgtgggtcccncaggcctcgaggcgaaggggccgaggtcggttgctagttatagcanatgagtggtaagttctagtaattattagtgacgtaacgtaccgttccggtaggaaacggggtccctaatttacccgaaccctagttcccgtacccgaaaggtaaccgtaacccgtaaacgtttccccccgggaaaattcgtttacgggtaacgtttaacccgttaaaggggtaaaactttccggggtaaccaaacgggtccccttaagggaacggtacggttacggaacgggtaccctcgggtacttacgtttagttaacgttaccgttggacggtcgtaaggtcggttacgggggtaggttaagggttaacgttacggtttaccgtacccgggggactcgttaaaggtccgggg

SEQ ID NO: 378886 - DNA, 563 bp, Homo sapiens
  misc_feature: GZ8MTXP02HM5P1.44.70.G04.1.454.CMB.2.raw
  modified_base (261)..(261): a, c, t, g, unknown or other
  modified_base (280)..(280): a, c, t, g, unknown or other
  modified_base (297)..(297): a, c, t, g, unknown or other
  modified_base (336)..(336): a, c, t, g, unknown or other
  modified_base (341)..(341): a, c, t, g, unknown or other
  modified_base (363)..(363): a, c, t, g, unknown or other
  modified_base (366)..(366): a, c, t, g, unknown or other
  modified_base (390)..(390): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtgggggagcgtggtccagccgtgggagtccctgagctctctgtgaagcctntggatttagttcagtgtcnggcatgcacgtggtccncgaggcctccgaggcgaaggggccgagtggtgctagttnagcanatgatgaattcagaattattcnganagacgtcgagaacggctatccacntcacgagacaactacgtaccgaatgttagtagtagttaagagtcgtacacgtacgtgaagtacggacgtacgtaccgtcgcttatacgttaacgttcgtaggcgacgtacggtacggtacgggtaggttaaggttaaagttaacggttacggtaccgggcgacgtacggtcgg

SEQ ID NO: 378887 - DNA, 758 bp, Homo sapiens
  misc_feature: GZ8MTXP02HLXV0.44.70.G04.1.454.CMB.2.raw
  modified_base (196)..(196): a, c, t, g, unknown or other
  modified_base (350)..(350): a, c, t, g, unknown or other
  modified_base (355)..(355): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttggctgagcttgggttttcctcgttgcttcttttaagaggtgtccactgtcaggtncacctggtggagtcgtgggggagcgtggtccagccgtgggagtccctgagctctccgtgtgacgcctgtggtatttagttcagttggttctggctagtgcctacgtcgggtcccgccaggcctccgaggccgaaggggcgaggtggtgctagtnagcanagtgagtggtaattctagtaattattgtgactaacgtaccttccgggtaaggaaaccgggtcccgtaatttacccgaaaccctgtacccgtacccgaaagaccgtaaacctaaaccgttacccccgggaaactaggtttcggttaacgtttaaaccgttaagggtaaaacgtttcgggactacggtacccgttagaaccgggtaggtacccgggaaaggtaccccggtttcgggtacctttaccgggttaagtttaaccgttttacggtcggttacgggtaaaccgttaacggggtaaccggggtttacgggggaagggggtttttaaggggttaaaacggttttacggggttttaaaaccggggtacccccggggtcggtaactttaacggggtacccgggg

SEQ ID NO: 378888 - DNA, 579 bp, Homo sapiens
  misc_feature: GZ8MTXP02IZ8HL.44.70.G04.1.454.CMB.2.raw
  modified_base (260)..(260): a, c, t, g, unknown or other
  modified_base (302)..(302): a, c, t, g, unknown or other
  modified_base (341)..(341): a, c, t, g, unknown or other
  modified_base (347)..(347): a, c, t, g, unknown or other
  modified_base (359)..(359): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtctgggggagcgtggtccagcctgggagtcctgagactctcctgtgaagcctntggtatttagttcagtggttctggcatgcacgtggggtcccncaggcctccgaggcaaggggccgagtggttggcagttanagcacntgatggaattcngaaattattgtgacaggtcctccggtaggaaacgggtcccgattcgaccctactctacccaagacgaccaacttaccccggaaatagttgtagtacgtttaggaaattggtacagcctagagagtcgagactcgctactacgtattacgtgtggacgagtacggtacgggaggttaaggtacggttaaggttacggttaacgggccgtacgtaaggtcgg

SEQ ID NO: 378889 - DNA, 652 bp, Homo sapiens
  misc_feature: GZ8MTXP02HHA1I.44.70.G04.1.454.CMB.2.raw
  modified_base (195)..(195): a, c, t, g, unknown or other
  modified_base (307)..(307): a, c, t, g, unknown or other
  modified_base (347)..(347): a, c, t, g, unknown or other
  modified_base (353)..(353): a, c, t, g, unknown or other
  modified_base (432)..(432): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagctgggttttcctcgttgctcttttaagaggtgtccactgtcaggtncacctggtggagtcgtgggggagcgtggtccagccgtgggacgtccctgacgactctcctgtgaagcctctggtatttagttcagttggttctggcatgctacgtggtcccncgaggctccgaggcgaaggggccgagtggttgctagttanagcagntcgatggaagttctagtaattattagcgtacaacgtaccgtccgggtaggaaacggggcccttaaattcccaaaccgtntacccggtaccaagtaacacccgtaacgttacccccggaatagtttacgtacgttaacgttaggaaacttcgggtacacgtccgtaggacggcgtacggaacggccttcgggtcttacgttaggtactttaccggcggttaaggcggtaaggtacggttacgggggaggtttaacgggttagttacggtttacggtacccgggcgtactaacggtcgggg

SEQ ID NO: 378890 - DNA, 582 bp, Homo sapiens
  misc_feature: GZ8MTXP02GQQAV.44.70.G04.1.454.CMB.2.raw
  modified_base (231)..(231): a, c, t, g, unknown or other
  modified_base (365)..(365): a, c, t, g, unknown or other
  modified_base (375)..(375): a, c, t, g, unknown or other
  modified_base (540)..(540): a, c, t, g, unknown or other
tcagacagtatatacacgaccggtgctcgatttagtgtagtgtgaagggaaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagngggcgttgtcgtgggtgcggcacgcccccggaaggccctggagtggatcgcactcacttatggaatgacgatatacgatatagtcttctctgacgaccagactcacgcctacactaagacacgtaccaaaacgnggtcgtctanattcgacacgtcgaccctgtcggacacgagcacattacttctgtcgccctaacttcatcgaccaacaagttcgaccgtaacggggtacttccgttaccggaaaccccgtgggggacccgaaggggtaacctccgaacgggtcctacccgtctaccgactccgacnccctaccaaccgacgggcccacgttccggtcccttcccccgg

SEQ ID NO: 378891 - DNA, 592 bp, Homo sapiens
  misc_feature: GZ8MTXP02JQ8YF.44.70.G04.1.454.CMB.2.raw
  modified_base (212)..(212): a, c, t, g, unknown or other
  modified_base (366)..(366): a, c, t, g, unknown or other
tcagacagtatatacacgaccggtgctcgatttagtgtagtgtgaagggaaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttcncactcgtcactcctggagagggcgttgtctgggtgcggcacgccccccggaaaggccctggagtgggatcgcactcacttattggaatgacgatatacgatatagtccttctctgacgacagactcacgcctcactaagacacgtaccaaaacngtgtctacatgaccacgtcgaccctgtgacacaggcacatatttctgtcgcccaacttcatgacccaataactacgaacccgacggggtactttccgtaccgaaaccccgtgggggacccaggggtaaactcccgagggttccacccggttacttccaacttccgacgtcccctacccgaacccgaacggggcccctaacgttcccggtaccgttttcccccccgg

SEQ ID NO: 378892 - DNA, 670 bp, Homo sapiens
  misc_feature: GZ8MTXP02HN8RS.44.70.G04.1.454.CMB.2.raw
  modified_base (266)..(266): a, c, t, g, unknown or other
  modified_base (311)..(311): a, c, t, g, unknown or other
  modified_base (355)..(355): a, c, t, g, unknown or other
  modified_base (360)..(360): a, c, t, g, unknown or other
  modified_base (564)..(564): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagcttgggttttcctcgttgcttcttttaagaggtgtccactgtcaggtgcacctggtggagtcgtgggggagcgtggtccaggccgtgggacgtccctgacgactctctgtgagcctntggtatttagtttcaggttggttctggctagtgcacgtgggtccnccgaggcctcgaggacgaacggggcggtagtggtgcgtagttanagcanagtgagtaggtaattcgtagtaattattagtgcacgtaccgttaccggtaggaacggtccctaattccaaccctatccgacgaagtacgaactaaacgttcccgaaattagttgtagttaacgttaggaaagtttcggacaggtaccgtaggagtacggtaccggaggtaccgttcggtcttacgttagttaactttaccgggnggttacgggacggtagggtacgggttacgggggtttaagggttaacggttaaacggtttaaccgggtttaccgggacccggggactaacggttacgggtaccgggg

SEQ ID NO: 378893 - DNA, 577 bp, Homo sapiens
  misc_feature: GZ8MTXP02H2XGA.44.70.G04.1.454.CMB.2.raw
  modified_base (376)..(376): a, c, t, g, unknown or other
  modified_base (437)..(437): a, c, t, g, unknown or other
  modified_base (472)..(472): a, c, t, g, unknown or other
tcagacagtatatacacgaccggtgctcgatttagtgtagtgtgaagggaaagggggactcctgtgccccaccatggacacactttgctccacgctcctgctgctgaccatcccttcatggggcctgtcccagatcaccgtgaaagagtctggccctacattggtgaaacccacaccagaccctcacgctgacctgcaccgtctcaggcttctcactcgtcactcctggagagggcgttgtcgtgggtcgcggcaccggccccccggaaaggcccctggagtggatcgcactcacttatggatgacgatatacgatatacgtccttctctgacgacagactcacgcctacacctaaggacctacgaccaaaaaccnggtacgtacctacattcgaccaacgtcggaccctgtacgacacgacggcactatactttcngtcgcccactttcacttgaccctaacagcgaaccncgggtctttccgtcgaacccgtcggggaccaggtactccggaagtccgaccgtactcactcgacgtcccaccaaccgaacgggccctacgtccgtacctcccccg

SEQ ID NO: 378894 - DNA, 660 bp, Homo sapiens
  misc_feature: GZ8MTXP02JF5WS.44.70.G04.1.454.CMB.2.raw
  modified_base (308)..(308): a, c, t, g, unknown or other
  modified_base (312)..(312): a, c, t, g, unknown or other
  modified_base (360)..(360): a, c, t, g, unknown or other
  modified_base (391)..(391): a, c, t, g, unknown or other
  modified_base (398)..(398): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagctgggttttcctcgttgctcttttaagaggtgtccactgtcaggtgcaccgtggtggagtcgtgggggagcgtggtccagccgtgggacggtccctggagactctcctgtgaagcctctggtatttagttcaggttgtctggcatgcacgtgggtcccnccgnggcctccgaggccgaagggggtccgaggttcggtggacgtaggtttangctacatggattaggactttctagtaaattntttacgngacgtacgtaccgtaccgggtaggaacgggtccctaactaccacctactccgacgaagtacgaacctaacgtacccgaatagttgttacgtacgttaggtaaacgtgtactacggtacgtaggacggtacggtacggacggtaccgtcggtcgttacgttagttacgtttacggagggtcgaacgggtacggtaacgggttacgggggtaaggttcggttaacggtttacggttaccggtaacgggactacggtacggtcgg

SEQ ID NO: 378895 - DNA, 537 bp, Homo sapiens
  misc_feature: GZ8MTXP02I9RAY.44.70.G04.1.454.CMB.2.raw
  modified_base (363)..(363): a, c, t, g, unknown or other
  modified_base (435)..(435): a, c, t, g, unknown or other
tcagacagtatatacacgaccggtgctcgatttagtgtagtgtgaagggaaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttctcactcgtcactcctggagagggcgttgtctgggtgcggcacggcccccggaaaggccctggacgtggatcgcactcacttatggaatgacatatacgatatagtcttctctgacgaccagactcacgcctcactagacacgtaccaaaacnggtcgtacttacattcacacgtcgaccctgtcggacacgagcacattattctgtcgcctattcatcgaccanatcgaccacggtcttcgtcgaacccgtggggccaacgggtactccgaggtccaccgtctcactcacgcctacaccgtaacggcccacgtcggtccttccccg

SEQ ID NO: 378896 - DNA, 582 bp, Homo sapiens
  misc_feature: GZ8MTXP02FLLZB.44.70.G04.1.454.CMB.2.raw
  modified_base (342)..(342): a, c, t, g, unknown or other
  modified_base (513)..(513): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtctgggggaggcgtggtccagcctgggaggtccctgagactctcctgtgaagcctctggatttagttcagtggttctggcatgcacgtgggtccgccaggctccaggcaaggggccgaggtggttggcaggttanagcacatgatggaagttctgaattattatgcagactccgtaggaaagggtcccaattcaaccctatcctacccaagtacgacctaaactttcccccgggaaatagtttgtacgttaacgttagggaaaactgggttacaaggcccttaggagtagtcggaggacgtcgggntcgtgttattacgtgtaggcgagtagtcggggaaggtggtagttagttacgttaccgggcgcagtcggg

SEQ ID NO: 378897 - DNA, 702 bp, Homo sapiens
  misc_feature: GZ8MTXP02F3NYL.44.70.G04.1.454.CMB.2.raw
  modified_base (195)..(195): a, c, t, g, unknown or other
  modified_base (265)..(265): a, c, t, g, unknown or other
  modified_base (307)..(307): a, c, t, g, unknown or other
  modified_base (348)..(348): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagctgggttttcctcgttgctcttttaagaggtgtccactgtcaggtncacctggtggagtcgtgggggagcgtggtccagccgtggggacgtccctgagactctcctgtgaagcctntggtatttagttcagttggttctggcatgcacgtggggtccnccgaggctccgaggcaaggggccgagtggttggcagtttanagcacatgatggaatttcagtaaattattatgacagaccttccggtaggaaacggggtcccgtaattccaaccctaatcctaccgaagacgaacctaaacgttaccccggaaactagtttcggttagttacgtttagggtaaaacgttcgggtaccaacggtcccgttaggaaacggtacgggttaccgggaaacgggtaaccgttccgggtaccttacggttaacggtttaacgtttaaaccgttgggttacggaccggtaaggtaacggggttaccgggggtaaggggttaaggtttaacgggttaaacggttttacggttaacccggggcgtaaccgtagtttaaccgggg

SEQ ID NO: 378898 - DNA, 740 bp, Homo sapiens
  misc_feature: GZ8MTXP02GNGS3.44.70.G04.1.454.CMB.2.raw
  modified_base (195)..(195): a, c, t, g, unknown or other
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagctgggttttcctcgttgctcttttaagaggtgtccactgtcaggtncaccgtggtggagtcgtgggggaggcgtggtccagccgtgggacgtccctgagactctcctgtgaagtcctcgtggtatttagttcgagttggttctggcatgcacgtcgggtcccgcgaggcctccgaggacgaacgggggccggtaggttgggttggactaggttagtagcactagtggagtaggtaacgttcgtaagtaaatttagttacgtcggactaaacggtacccgttaccgggtaagggaacgggggtaccccctaatttaccccgaaacccgtattaccccgtaaccgaaagtaaccggtaaacccctaaacgtttacccccggaaattacgttgtaacgttaacgttaggtaaagttcggactaaggtcccgtaggaacgtggtacccgaggtaccgtcgtactacgttattacgtttacgtggtacgtacggggtaagtacggggttaaccggggtagggggtttaaggttaaaggggtttacggttttaaacccggggtaccggggtaccgtacggtaaggtttacccggggg

SEQ ID NO: 378899 - DNA, 629 bp, Homo sapiens
  misc_feature: GZ8MTXP02I9FGW.44.70.G04.1.454.CMB.2.raw
  modified_base (174)..(174): a, c, t, g, unknown or other
  modified_base (368)..(368): a, c, t, g, unknown or other
tcagacagtatatacacgaccggtgctcgatttagtgtagtgtgaagggaaagggggactcctgtgccccaccatggacacactttgctccacgctcctgctgctgaccatcccttcatggggcctgtcccagatcaccgtgaaagagtctggccctacattggtgaaacccanacagaccctcacgctgacctgcaccgtctcaggcttctcactcgtcactcctggagagggtcgttgtctgggtgcggcacgcccccggaaggccctggagtgatcgcactcacttatgaatgacgatatacgatatacgtccttctctgacgaccagcctcacgcctacgacgagaacacgtaaccaaaaccgngggtcgtacttacacttacgaacctacgtcgaccctgtacggacacgaggcaagacttattttacgtcggtacctacccctacttaccaacttaccgacccaactaaacgttacgacccgtacgggtaccctttacggtaccggtacccgttacgggggaccaaggggtaaccttaccgaccggttaccaaccgttcctacgtacttaccacggtccctaccgaaccgaacgggccctacgtcccggtcccgtttcccccg

SEQ ID NO: 378900 - DNA, 601 bp, Homo sapiens
  misc_feature: GZ8MTXP02FL0BY.44.70.G04.1.454.CMB.2.raw
  modified_base (201)..(201): a, c, t, g, unknown or other
  modified_base (214)..(214): a, c, t, g, unknown or other
  modified_base (258)..(258): a, c, t, g, unknown or other
  modified_base (366)..(366): a, c, t, g, unknown or other
tcagacagtatatacacgaccggtgctcgatttagtgtagtgtgaagggaaaggggaggaactgctcagttaggacccagaggggaccatggaagccccagctcagcttctcttcctcctgctactctggctcccagataccaccggggaaattgtgttgacacaatctccagccaccctgtctttgtctccaggggaaangccaccctctccngcagggccagtcagagtgttaggaactacttagcctgtatcaanagacactggccaggctcccaggctcctcatctatgatgcatccaatgggcgcggcatccccagccaggttcagtggcaggtcggggtctgagtacagacttcaccgtntcaccatcagtcggacctagagccggaatacgttttgctagtttattactggtcaaacgaccgttagcgaactggtacctaggtacgtagttttcggacagggggtaccaaggctagggtaacgccgttacggaaaaaccgttaacggtggttacgggaccttgggacctaccctaaagttccgttcgttaaccgttttccaacgttttccctttaacccccggcgtttaaaccg

SEQ ID NO: 378901 - DNA, 720 bp, Homo sapiens
  misc_feature: GZ8MTXP02ICFLP.44.70.G04.1.454.CMB.2.raw
tcagacagtatatacacgaccggtgctcgatttagtgtagtgtgaagggaaaggggtctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtgggggagcgtggtccagccgtgggagtccctgacgactctcctgtgaacgccctctggtattttagttcaggttggttctggcagttcgcacgtgggtccccgccgacggctccgaggcgaacgggggccggtaggttgggttggctagttatagcacagtgagtggtaatttcagtaatattgtgcaagtacctacccgggtagggaaacgggtccctaatttccgaaaccctacgttccctacccgaaaggtaaccgtaaccgtaaacgtttacccccggaaaattacgtttaggtacggtttaaccgtttaggaaacgtttcggtactaaccgggtcccttaagggacggttaacgggttcggaaacgggtcccgttcgggtaccttcgtttagttaactttcgtcggttcggacggttaggaacggttcgggggttaagggttggggtttaacggtttacggtttaaaccgggtttaccgggggacgtacgtaaacgggtttcgg

SEQ ID NO: 378902 - DNA, 644 bp, Homo sapiens
  misc_feature: GZ8MTXP02F1RTI.44.70.G04.1.454.CMB.2.raw
  modified_base (237)..(237): a, c, t, g, unknown or other
tcagacagtatatacacgaccggtgctcgatttagtgtagtgtgaagggaaagggggactcctgtgccccaccatggacacactttgctccacgctcctgctgctgaccatcccttcatggggcctgtcccagatcaccgtgaaagagtctggccctacattggtcgaaacccacacagaccctcacgctgacctgcaccgtctcaggtccttctcacttcgtcactccgtaggagngggtcgttgtcgtgggtgcggacgaccggacccccggaaggtccctggagtggatcgcactctactatagatgacatatacgatatacgtccttctacgtagaccgtaccacgactcacgcctacgacgaacggaccaccgtaaacccgaaaaccgtgggtacgttaccttacgtacttcgaaccgtacgtcgacccgtgtacggacacgaggactactattacttctggtacctaccctacttacatacgaacccaactaacgacgaacccgtacgggtacctttccgtaccgacccggtacggggaccgacggggtaactccggtagtacccgtacgttcctaccgaactccgactaaccccgtaccgaaccgaccggtaccgactcccggttcccttcccccgg

SEQ ID NO: 378903 - DNA, 508 bp, Homo sapiens
  misc_feature: GZ8MTXP01D55KL.22.14.B03.1.454.CMB.2.raw
  modified_base (302)..(302): a, c, t, g, unknown or other
  modified_base (336)..(336): a, c, t, g, unknown or other
  modified_base (398)..(398): a, c, t, g, unknown or other
  modified_base (439)..(439): a, c, t, g, unknown or other
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagtatttttacagctccacaataagagtactagctggtccagcagaaaccaggacatcgtcctgcactgctcatttacngggctctacccggaatccggggccctgaccccgnttcagtgcaagcgggtctgggacagattcactctcaccatcagcagcctgcaggctgaaagntgtgctagtttatatgcagactaattattatacttcctctnaagtcgttcgaccgaaagggaaccaaggttagaaacttacgaaaacgtatggtgcttacgccaacgtaa

SEQ ID NO: 378904 - DNA, 547 bp, Homo sapiens
  misc_feature: GZ8MTXP01D8YLB.22.14.B03.1.454.CMB.2.raw
  modified_base (410)..(410): a, c, t, g, unknown or other
  modified_base (455)..(455): a, c, t, g, unknown or other
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagtatttttacagctccaccaataagagttactagctggtccagcaagaaaccaggacatcgtcctgcactgctctatttactgggcgtcgtacccgggaatcccggggtccctgaccccgattcagtgcaagcgggtcgtgggacagtattcactctcaccatcagcagcctagcaggctgaaagntgtgctaagtttatattgcagcaaattattatatttcccgtcctntaagaccgtttcggacccaaaggggacccaaagggttggaaaattccgaaaacgggaacttggtacggcttacgaacccttaacccgtaacg

SEQ ID NO: 378905 - DNA, 524 bp, Homo sapiens
  misc_feature: GZ8MTXP01DXR01.22.14.B03.1.454.CMB.2.raw
  modified_base (412)..(412): a, c, t, g, unknown or other
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaacaataagagttactagctggtccagcagaaaccaggacatcgtcctgcactgctcatttacgtgggcgtcgtacccgggaatcccgggggtccctgaccccgattcagtggcaaggcgggtctgggacagatttcactctcaccatcagcagccctgcaggctgaaagntgtggctagttttatattgtcagctaatattatattcctctcaagtcgttcggaccttaaagggacctaagggttacgaaattacgaaacgaactgtggcttagcaacctaa

SEQ ID NO: 378906 - DNA, 536 bp, Homo sapiens
  misc_feature: GZ8MTXP01CSHDF.22.14.B03.1.454.CMB.2.raw
  modified_base (415)..(415): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttacttagctggttccagcaagaaaccaggacatcgtcctgcactgctcatttacgtgggtcgtccgtacccgggaatcccggggtccctgaccccgattcgagtggcaagcgggtctgggacagtattcactctcaccatcagcacgcctgcagctgaanatgtggctaagttttattatgtacagactaattaattatacttccctctcaagtacgttcggaccgaagggaaccaaggttaggaaattaccgaaaagaactgtggcttacgcaaccgtaa

SEQ ID NO: 378907 - DNA, 531 bp, Homo sapiens
  misc_feature: GZ8MTXP01C0H29.22.14.B03.1.454.CMB.2.raw
  modified_base (454)..(454): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttactagctggtcagcagaaaccaggacatcgtcctgcactgctcatttactgggctcgtacccggacgtccggggtcctcgaccccgattcgagtggcaaggcgggtcgtgggacagattcactctcaccatcagcagcctgcaggctagaagatgtggctagtttattattgtcaagctaaattattatattcctctnaacgtacgttcggacccgaaagggtaccaagggttaggaaacttacgaaaacgactgtacggcttagccaaccgtaa

SEQ ID NO: 378908 - DNA, 523 bp, Homo sapiens
  misc_feature: GZ8MTXP01BFPBZ.22.14.B03.1.454.CMB.2.raw
  modified_base (306)..(306): a, c, t, g, unknown or other
  modified_base (516)..(516): a, c, t, g, unknown or other
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagtatttttacagctccaccaataagagttactagctggttccagcaagaaaccaggacatcgtcctgcactgctcatttacngggcgtctacccgggaatccgggggtccctgaccccgattcagtggcaagcgggtctggggacagatttcactctcaccatcagcagccctagcaggctgaagatgtggctagtttatattgtcagcaattattatacttcctcctcaagtacgtttcggaccaaagggaccaaagggttggaaattacaaacgactgagggcttggccncccgtaa

SEQ ID NO: 378909 - DNA, 512 bp, Homo sapiens
  misc_feature: GZ8MTXP01BRVLA.22.14.B03.1.454.CMB.2.raw
  modified_base (405)..(406): a, c, t, g, unknown or other
  modified_base (434)..(434): a, c, t, g, unknown or other
  modified_base (444)..(444): a, c, t, g, unknown or other
  modified_base (496)..(496): a, c, t, g, unknown or other
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagctggtccagcagaaaccaggacatcgtcctgcactgctcatttactgggctcgtacccgggaatcccggggtcctgaccccgattcagtggcaagcgggtctgggacagatttcactctcaccatcagcagcctgcaggctgaagnngtggctagtttatatgcagcaattattntattcctctnaagtacgttggacccaaagggtacccaagggttgaaattccaaaagactggnggcttgccaaccgtaa

SEQ ID NO: 378910 - DNA, 541 bp, Homo sapiens
  misc_feature: GZ8MTXP01C6TLP.22.14.B03.1.454.CMB.2.raw
  modified_base (417)..(417): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagtatttttacagctccaccaataagagttacttagctggttccagcaagaaaccaggacatcgtcctgcactgctcatttactgggcgtcgtacccgggaatcccggggtcctgaccccgatcagtgcaagcgggtctgggacagattcactctcaccatcagcagccctagcaggctagaagatggtcggntaagttttattattgtcagtcaaattattattacttccctaccttcaagtccgtttcggacccaaaggggtaacccaagggttaggaaacttacgaaaacgtactggtggcttagccaacctaa

SEQ ID NO: 378911 - DNA, 551 bp, Homo sapiens
  misc_feature: GZ8MTXP01CKO2W.22.14.B03.1.454.CMB.2.raw
  modified_base (416)..(416): a, c, t, g, unknown or other
  modified_base (420)..(420): a, c, t, g, unknown or other
  modified_base (437)..(437): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccacaataagagttactagctggttccagcagaaaccaggacatcgtcctgcactgctctatttacgtgggcgtccgtacccgggaatcccgggggtccctgaccccgtattcgagtgcaaggcgggtctgggacagtattcactctcaccatcagcagcctgcaggctagaaagngtgnggtactagtttttaatntttgacagactaaattattactattcccctctcgaacgtcggttcggaccaaagggacccaagggttacggaaacttacgaaaacgacttggtcggacttgaaccaacgtaacg

SEQ ID NO: 378912 - DNA, 712 bp, Homo sapiens
  misc_feature: GZ8MTXP01AWHX7.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagtagttatttttacagctccacaataagagttactagctggtccagcaagaaaccaggacatcgtcctgcactgctctatttacgtgggccgtccgtacccgggaacgttcccggggtcccctacggaccccgtattcgaaggtcggccgaaacgggccggggttcgtacggggaacctaggtacttttccgaacttcctacccaaccctatccgaacgccaacggtcccctgggaccaacgggtccttaaggaaaacgtacgttgggttaccgggtacttaaagttttttaagtttaagtttcggttaccaaaggtacctaaaatttaattttaacttaaccttttccccgtacccttagaaaccggttaacccgggtttccgggaaaccccgttaaagggggtaaacccctaaaggggttacggaaaacttaccgaaaaacccggtaacttgggtacgggacttacggaacccttaacccgttaacg

SEQ ID NO: 378913 - DNA, 515 bp, Homo sapiens
  misc_feature: GZ8MTXP01DI8MY.22.14.B03.1.454.CMB.2.raw
  modified_base (259)..(259): a, c, t, g, unknown or other
  modified_base (424)..(424): a, c, t, g, unknown or other
  modified_base (442)..(442): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagtatttttacagctccaccaataagagttactanctgtccagcagaaaccagacatcgtcctgcactgctcatttactgggctcgtacccggaatccggggtccctgaccccgattcagtgcaagcgggtctgggacagattcactctcacatcagcagcctgcaggctagaagatgtggactagttttatatgtcagnaatatatatctcctcaanacgttcgtcgaacggaaccgaaggagaaagttaacgaaacgaaacgtaagttggcgttacgtcgaaccgtaac

SEQ ID NO: 378914 - DNA, 568 bp, Homo sapiens
  misc_feature: GZ8MTXP01EG9E4.22.14.B03.1.454.CMB.2.raw
  modified_base (423)..(423): a, c, t, g, unknown or other
  modified_base (426)..(426): a, c, t, g, unknown or other
  modified_base (471)..(471): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttactagctggttccagcaagaaaccaggacatcgtcctgcactgctctatttacgtgggcgtccgtacccgggtaacgtcccgggggtccctcgacccccgtattcgagtggcaaggcgggtcgtgggacagtctttcactctcacatcagcagcctgcaggcagaantgnggctagtttatattgtacagactaatatttagtactttcctcctntaagtccggttcggaccgttaaagggacctaaaggggttacggaaaacttacgaaaaccggtagttaaggtacggacttacggaaccaacccgttaa

SEQ ID NO: 378915 - DNA, 542 bp, Homo sapiens
  misc_feature: GZ8MTXP01EPK3M.22.14.B03.1.454.CMB.2.raw
  modified_base (412)..(412): a, c, t, g, unknown or other
  modified_base (469)..(469): a, c, t, g, unknown or other
  modified_base (542)..(542): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagtatttttacagctccaccaataagagttactagctggtccagcaagaaaccaggacatcgtcctgcactgctcatttacgtgggcgtcgtacccgggaacgtccggggtccctgaccccgattcagtgcaagcgggtctgggacagtatttcactctacaccatcagcagccctgcaggctagaanagtgtggacttaagttttattagttgtacaagcttaaatatttatactttcctcctnaagtacgttcggaccgttaaagggacctaagggttagaaacttacgaaaacgactgtggcttcgcaacccgtn

SEQ ID NO: 378916 - DNA, 675 bp, Homo sapiens
  misc_feature: GZ8MTXP01CKEW0.22.14.B03.1.454.CMB.2.raw
  modified_base (466)..(466): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggacgggccaccatacaactgacaacgtccagccagtagttatttttacagtctaccaacaataagtagttacttagtctggttaccagacaacgaaaccgaggactatccgtcctgactacgtcgtcctactactttacggtcggggtccgtaccggtaacccggggaacggttcccggggtccctacggaccccgtacttcgaggtcggacgaacgggtccgggttcgtcggggaactaggttactttaccaccttctaccaaccttancgacgcgacgtcgtagacgaggtacgtaaggaagtggttagggtacgttagtttaagttttattgtacgtacgaactaacttaaatttacttacttaccttccctacgtacgtaacggttaccggttacggaaaccgttaaacgggtaaacgtaaggttaacgaaacttaccgtaaacgtagtggacgtacttacgtaaccttaacgtg

SEQ ID NO: 378917 - DNA, 606 bp, Homo sapiens
  misc_feature: GZ8MTXP01B5S5T.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaaccaataagagttactagctggttccagcaagaaaccaggacatcgtcctgcactgctctatttacgtgggccgtaccgtacccgggaacgttcccgggggtccctcggacccccgtattcaggtggccgaaggccgggtcgtgggacagtatttcactctcaccatcagcacgccctgccgaggctagaagatggtacggcttaaggtttttattagttcggtacagtactaaattacttaattactttccctcctctaacgggtaccgtttccgggacccgaaaagggggaacccctaaaggggttcggaaaacttaccgaaaacgaacttggtacggcttacggaacccaacgttaacg

SEQ ID NO: 378918 - DNA, 536 bp, Homo sapiens
  misc_feature: GZ8MTXP01B4QEK.22.14.B03.1.454.CMB.2.raw
  modified_base (415)..(415): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagttatttttacagctccaccaataagagttactagctggtccagcagaaccaggacatcgtcctgcactgctcatttacgtgggcgtcgtaccccgggaatcccgggggtccctgacccccgtattcagtggcaaggcgggtctggggacagtattcactctcaccatcagcagccctgcaggctgaagntgtggctagttttattatgtacagctaattattatattccctctcaagtccgttcggacccaaggggacccaagggttacgaaattaccgaaacgtactggtaggcttgccttaaccgtaa

SEQ ID NO: 378919 - DNA, 548 bp, Homo sapiens
  misc_feature: GZ8MTXP01BABA4.22.14.B03.1.454.CMB.2.raw
  modified_base (308)..(308): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagttatttttacagctccaccaataagagttactagctggttccagcaagaaaccaggacatcgtcctgcactgctcatttacngggcgtcgtacccgggaatcccgggggtccctgaccccgattcgagtggcaaggcgggtcgtagggacagtactttcactctcaccatcagcagctgcaggctagagatgtggctagtttattagttgtcagactaattatttatacttccctcctgaacgtcgttacgggacaaacgggacctaagggttaggaaacttacgaaaacgtacgtgtacgggcttacgccttaaccgtaac

SEQ ID NO: 378920 - DNA, 551 bp, Homo sapiens
  misc_feature: GZ8MTXP01EB25M.22.14.B03.1.454.CMB.2.raw
  modified_base (459)..(459): a, c, t, g, unknown or other
  modified_base (479)..(479): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagttatttttacagctaccaaccaataagagttactagctggtccagcaagaaaccaggacatcgtcctgcactgctctatttacgtcgggtccgtccgtaccccggggaacgttcccgggggtcccctaggacccccgtattcgaggtggccaagggcgggtcgtgggacagtatttcactctcaccatcagcagcctgcagctgaagatgtggctagttttatattgtacagntaattattatacttcctctnaagtcttcggaccttaagggacctaagggttagaaacttcgaaaccgaatggtggcttgaaccttaacgtaa

SEQ ID NO: 378921 - DNA, 518 bp, Homo sapiens
  misc_feature: GZ8MTXP01AXPB0.22.14.B03.1.454.CMB.2.raw
  modified_base (370)..(370): a, c, t, g, unknown or other
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagtatttttacagctccaccaataagattactagctggttccagcaagaaaccaggacatcgtcctgcactgctctatttacgtgggcgtccgtacccgggaatcccgggggtccctgaccccgtattcgagtggcaaggcgggtcngggacagtactttcactctcaccatcagcagcctagcaggctgaacgatgtggctaggtttatattgcagctaattattatacttcctctcaagtcgttcgacttaggaccaaggagaattcgaaacgatgtaggcttagcaacctaa

SEQ ID NO: 378922 - DNA, 545 bp, Homo sapiens
  misc_feature: GZ8MTXP01EXAB2.22.14.B03.1.454.CMB.2.raw
  modified_base (310)..(310): a, c, t, g, unknown or other
  modified_base (423)..(423): a, c, t, g, unknown or other
  modified_base (426)..(426): a, c, t, g, unknown or other
  modified_base (443)..(443): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttactagctggtccagcaagaaaccaggacatcgtcctgcactgctctatttacgngggcctcgtacccgggaactcccgggggtccctgacccccgattcgagtggcaaggcgggtctgggacagtatttcactctacaccatcagcagcctgcaggctagaagatgnggntagtttattattgcagnaattattatacttcctcctcgaagtcgttcggacgttaaacgggaccgtaaaggttaggaaattaccgaaaacgtactggtaggcttacgcttaaccctaag

SEQ ID NO: 378923 - DNA, 550 bp, Homo sapiens
  misc_feature: GZ8MTXP01AIKPB.22.14.B03.1.454.CMB.2.raw
  modified_base (305)..(305): a, c, t, g, unknown or other
  modified_base (462)..(462): a, c, t, g, unknown or other
tcagacatacgcgtcacgaccggtgctcgatttagtgtgagtagttccgcgggggagctacaacaggcaggcagggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagtatttttacagctccaccaataagagttactagctggttccagcagaaaccaggacatcgtcctgcactgctcatttacngggacgtcctacccgggaatccggggtccctggaccccgattcgagtcggcaagggcgggtctgggacagtactttcactctcaccatcagcagcctgcaggctagagatgtggctagtttattattgtacagtcaaattattatacttcctccctnaacgtcgtttccggaccgttaaggggaacctaagggttacggaaaattacgaaaacgtactggtcgggcttacgtaacgaaccctaag

SEQ ID NO: 378924 - DNA, 592 bp, Homo sapiens
  misc_feature: GZ8MTXP01D0M71.22.14.B03.1.454.CMB.2.raw
  modified_base (375)..(375): a, c, t, g, unknown or other
  modified_base (426)..(426): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagtagttatttttacagctaccaccaataagagttactagctggtccagcaagaaaccaggacatcgtcctgcactgctcatttacgtgggcgtccgtacccggaagtcccggggtcctcgaccccgtatcgagtcggcaacggcgggtcgngggactaggtactttcactctcacctatccagcagcctgcaggctagaagntcggaggcttaagttttatattgtacagtctaaatttatttatactttcccgtctacgtaaggtaccgttcggaacccgaaagggggtaacccaaaggggttaggaaaattaacccgaaaacggtaaccgttgggttaacggcccttaaggtccccaaccgttaag

SEQ ID NO: 378925 - DNA, 706 bp, Homo sapiens
  misc_feature: GZ8MTXP01EOVTC.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagctggtcagcagaaaccaggacatcgtcctgcactgctctattttacgtcgggtccgtccgtaccccggggtaactcccgggggtccctcggacccccgtattcgaagtcggcaacgggccgggttcgtggggaaccaggtacttttccaaccttccttaccaaccctaattcccgaagccgaacgccccttggaccgaagggtccgttaggaaaggtaagttggttcggggtaccttaaggttttttaattaagtttaggtacctaaggtaccttaaatttaacttttaagttaacttttccccgttacccttaccgtaacggtaaccgggttttacccgggaacccgttaaacgggggaaaccccgtaaaaggggttacgggttaaaaacttaccgaaaacgtaccgttaaggttacgggcttacggaaccttaacccgttaag

SEQ ID NO: 378926 - DNA, 509 bp, Homo sapiens
  misc_feature: GZ8MTXP01BPLK9.22.14.B03.1.454.CMB.2.raw
  modified_base (447)..(447): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagctggtccagcagaaaccaggacatcgtcctgcactgctcatttactgggcgtcgtacccgggaatcccggggtcctgaccccgattcagtggcaagcgggtctgggacagatttcactctcaccatcagcagctgcaggctgaagatgtggctagtttattatgtcagctaatattatattcctctnaagtacgttcggaccaagggaccaaggttggaaattcgaaacgactgtaggcttgcaactaa

SEQ ID NO: 378927 - DNA, 557 bp, Homo sapiens
  misc_feature: GZ8MTXP01CT0LK.22.14.B03.1.454.CMB.2.raw
  modified_base (418)..(418): a, c, t, g, unknown or other
  modified_base (425)..(425): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagtatttttacagctaccaccaataagagttactagctggtccagcagaaaccaggacatcgtcctgcactgctcatttacgtgggcgtccgtacccgggaactccggggtccctgaccccgtattcgagtggcgaaggcgggtctggggacaggtatttcactctcaccatcagcagcctgcaggctgaaagntgtcggntagtttattattgtcagtcaaattattactacttccctccttcaacgtccggttcggaccgaaagggtacccgtaaggggttaacgaaaacttccgaaaaacggaacgtggtgggacttcgaaccgccgtaa

SEQ ID NO: 378928 - DNA, 580 bp, Homo sapiens
  misc_feature: GZ8MTXP01C1615.22.14.B03.1.454.CMB.2.raw
  modified_base (259)..(259): a, c, t, g, unknown or other
  modified_base (394)..(394): a, c, t, g, unknown or other
  modified_base (398)..(398): a, c, t, g, unknown or other
  modified_base (400)..(400): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagttatttttacagctccacaataagagttactanctggtccagcaagaaaccaggacatcgtcctgcactgctactatttacgtgggctccgtacccgggaatcccggggtccctgaccccgattcagtggcaaggcgggtctgggacagtatttcactctacacccancacncncgctcgcgacgacgagagagtagtgtaggttagtttattattagtatagtactaattaattaacttacttcctcctcgtaacgtacgttaccggtaccgaaacggaaacgtaaacggttaacggaaacgttaaacgaaacgtaacgtaacgtacggtacgttacgtaaccgaacgtaacg

SEQ ID NO: 378929 - DNA, 556 bp, Homo sapiens
  misc_feature: GZ8MTXP01D7YQE.22.14.B03.1.454.CMB.2.raw
  modified_base (240)..(240): a, c, t, g, unknown or other
  modified_base (434)..(434): a, c, t, g, unknown or other
  modified_base (457)..(457): a, c, t, g, unknown or other
  modified_base (469)..(469): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactcccctggctgtgtctctgggcgagagggccgccatcaactgcaagtccagccagtagttatttttacngctccaaccaataagagttactagctggttccagcaagaaaccaggacatcgtcctgcactgctacatttacgtgggtcgtcgtacccgggaacgttcccggggtccctcgaccccgtattacgaggtgcgaacggcgggtcgtggggacagtactttcactctcaccatcagctagcctgcaggtcagaaagntgtggactaggttttatattganagtataatattntactcctctgaacgtcgttacgacgaaggaacgtaaggttaacgaaacttaacgaaacgtacgtggtacgcttacgtaaccaacgtg

SEQ ID NO: 378930 - DNA, 550 bp, Homo sapiens
  misc_feature: GZ8MTXP01BDXJ3.22.14.B03.1.454.CMB.2.raw
  modified_base (422)..(422): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagttatttttacagctccaccaataagagttactagctggttccagcagaaaccaggacatcgtcctgcactgctctatttacgtgggccgtccgtaccccggggaacttcccgggggtccctggaccccgattcgagtggcaaggcgggtctgggacagatttcactctcacatcagcagccctgcaggctagaagntgtggctagttttatattgtcagctaattattatacttcctcctgaacgtacgttcggacccaaaggggacccgtaaagggttacggaaattacgaaaacgacgtggtaggcttacgcttaaccgtaa

SEQ ID NO: 378931 - DNA, 586 bp, Homo sapiens
  misc_feature: GZ8MTXP01C49AE.22.14.B03.1.454.CMB.2.raw
  modified_base (449)..(449): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggagggccaccatcaactgcaagtccagccagtagttatttttacagtctcccaaccaataagagttactagctggtccagcaagaaaccaggacatcgtcctgcactgctctatttacgtcggggtccgtccgtacccgggaacgttccccggggtccctcggacccccgtattcgaggtcggcgaacgggcgggtcgtggggactagtacttccactctcaccatcagcagccctagcgaggctagaaagtntggtcggtattaagttttattattgacagctaaattatttatacttccctctcaaggtccgttcgggaccgaaagggtaaccaagggttagaaacttacgaaaacggtactgggtggacttcgtaaccaaccttaag

SEQ ID NO: 378932 - DNA, 566 bp, Homo sapiens
  misc_feature: GZ8MTXP01AP1FI.22.14.B03.1.454.CMB.2.raw
  modified_base (381)..(381): a, c, t, g, unknown or other
  modified_base (496)..(496): a, c, t, g, unknown or other
  modified_base (531)..(531): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagttatttttacagctccaccaataagattactagctggtccagcagaaccaggacatcgtcctgcactgctctatttacgtgggcgtaccgtacccgggaacgtcccgggggtccctcggaccccgtattcgaggtcggcgaagggccgggttcgnggggaacagtactttccacgtctacaaccctatccaagccacgccctgacgaggctagaaagtgtggtcggataaggtttttatattgtacagtataattattatacttccctcncaagtaccgttcggacgaagggtaccaaggggttnaaacttacgaaaacgctgtcggcttaggccaactc

SEQ ID NO: 378933 - DNA, 586 bp, Homo sapiens
  misc_feature: GZ8MTXP01C1X87.22.14.B03.1.454.CMB.2.raw
  modified_base (416)..(416): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaaccaataagagttactagctggttccagcaagaaaccaggacatcgtccctgcactgctcatttactgggcgtcgtacccggaagtcccggggtccctgaccccgtatcagtgcaagcgggtctgggacagtatttcactctcaccatcagcagcctgccaggctagaaagntgtgtagttagtttatagttgtacagtactaatttattactacttccctactacgtaacggtaccggttccggaaccgaaacgggtaaacccgtaaaggggttaacgaaaaacgttaacccgtaaaaacgtacgttcgggtacgtaccgttacgaacccgttaaccgtaa

SEQ ID NO: 378934 - DNA, 575 bp, Homo sapiens
  misc_feature: GZ8MTXP01CWKFB.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggtcaccatcaactgcaagtccagccagagttatttttacagctccaccaataagagttacttagctggttccagcagaaaccaggacatcgtcctgcactgctcatttacgtgggtcgtccgtacccgggaatcccggggtccctgaccccgtattcgagtggcaaggtcgggtctgggactagtactttcactctcacctatcagcacgcctagcaggctagaacgatggtgtcgtagttttattagttgacagtctaattattactacttccctctcaacgtacgttcggaccgaaagggaaccctaagggttacggttaaacttaccgaaaaccggtaaacttggtacggtcttacgaacccgaaccgttaacg

SEQ ID NO: 378935 - DNA, 574 bp, Homo sapiens
  misc_feature: GZ8MTXP01EPHQB.22.14.B03.1.454.CMB.2.raw
  modified_base (401)..(401): a, c, t, g, unknown or other
  modified_base (426)..(426): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccacaataagagttactagctggtcagcagaaccagacatcgtctgcactgctctatttacgtcgggtcgtcgtaccccgggaagtcccgggggtccctcggacccccgtattcgaggtggcgaacgggcgggtcgtgggaccagtatttcactctcaccntcagcagcctagctaggctagaagntgtggtactagttttattagtcgtacagtactaaattattatacttcctcctcaaggtaccgttcggacccgttaaagggaccgtaaagggttacggaaacttaccgtaaaaccgtaagtgtaacgggcttacgaaccgttaacgtcg

SEQ ID NO: 378936 - DNA, 504 bp, Homo sapiens
  misc_feature: GZ8MTXP01BD8GF.22.14.B03.1.454.CMB.2.raw
  modified_base (257)..(257): a, c, t, g, unknown or other
  modified_base (275)..(275): a, c, t, g, unknown or other
  modified_base (303)..(303): a, c, t, g, unknown or other
  modified_base (399)..(399): a, c, t, g, unknown or other
  modified_base (423)..(423): a, c, t, g, unknown or other
  modified_base (445)..(445): a, c, t, g, unknown or other
  modified_base (504)..(504): a, c, t, g, unknown or other
tcagacatacgcgtcacgaccggtgctcgatttagtgtgagtagttccgcggggagctacaacaggcaggcagggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagtatttttacagctccaccaataagagttactanctggtccagcagaaaccnggacatcgtcctgcactgctcatttacngggctctacccgggaatccggggtccctgaccccgattcagtggcaagcgggtctgggacagatttcactctcacatcagcagctgcaggctgaanatgtggctagtttattattcgtanagctaatattatacttcctctntaagtcgttcgacgaaggacaaggttagaacacgaaacgactgtcgcttacgcaacgtn

SEQ ID NO: 378937 - DNA, 554 bp, Homo sapiens
  misc_feature: GZ8MTXP01AUNV3.22.14.B03.1.454.CMB.2.raw
  modified_base (310)..(310): a, c, t, g, unknown or other
  modified_base (444)..(444): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaaccaataagagttactagctggtccagcagaaaccaggacatcgtcctgcactgctctatttacgngggcgtccgtacccgggaatcccggggtccctggaccccgtattcaggtggcgaacggcgggtcgtggggacaggtactttcactctcacatcagcagcctagccaggctagaagatgtaggcttagtttattnttgtcagctaattattatacttccctcctgaagtaccgttcggaccgaaagggaaccaagggttacggaaaattaccgaaacgtacgtgtcggcttgtaaccaacgtaac

SEQ ID NO: 378938 - DNA, 529 bp, Homo sapiens
  misc_feature: GZ8MTXP01DXZYQ.22.14.B03.1.454.CMB.2.raw
  modified_base (465)..(465): a, c, t, g, unknown or other
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccacaataagagttactagctggtccagcaagaaaccaggacatcgtcctgcactgctctattttacgtgggcgtcgtacccgggaactcccgggggtccctcgaccccgtattcagtggcaaggcgggtctgggacagtattcactctcaccatcagcagccctgcaggctagaagatgtcggattaggttttatattgtcagctaaattattatattcctcctnaagtcgttcggaccaaagggaccaagggttacgaaattacaaacgatgtaggcttgcaactaac

SEQ ID NO: 378939 - DNA, 548 bp, Homo sapiens
  misc_feature: GZ8MTXP01D9K8R.22.14.B03.1.454.CMB.2.raw
  modified_base (477)..(477): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaaccaataagagttacttagctggtcagcaagaaaccaggacatcgtcctgcactgctctatttacgtgggcgtccgtaccccggggaattcccgggggtccctgacccccgtattcagtggcaaggcgggtcgtgggacagtatttcactctcaccatcagcagccctgccaggctagaagatggtggacttaagtttattattgtacagactaattattatacttcctcctnaacgtacgttcggaccgaaagggaaccgtaaggaggaaacttcaaacgactggtaggcttgccaacgtaac

SEQ ID NO: 378940 - DNA, 537 bp, Homo sapiens
  misc_feature: GZ8MTXP01DH07K.22.14.B03.1.454.CMB.2.raw
  modified_base (421)..(421): a, c, t, g, unknown or other
  modified_base (424)..(424): a, c, t, g, unknown or other
  modified_base (470)..(470): a, c, t, g, unknown or other
  modified_base (531)..(531): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaaccaataagagttacttagctggttccagcaagaaaccagacatcgtctgcactgctcatttacgtgggtccgtcgtaccccgggaatcccgggggtccctgaccccccgtattcgagtcggcaaggcgggtcgtgggacagtatttcactctcacatcagcagctgcagctagaagntgnggtctaaggttttattaattgcagctaaattattatattccctctnaagtacgttcggaccaagggaccaagggttagaaattacgaaacgaatgtggcttgaaccncgtaac

SEQ ID NO: 378941 - DNA, 680 bp, Homo sapiens
  misc_feature: GZ8MTXP01BZ17T.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgacaagtccagccagagttatttttacagtctaccaaccaataagagttactagctgtcagcaagaaccaggacatcgtcctgcactgctctatttacgtgggccgtaccgtacccggggaacgttcccgggggtccctgaccccgtattcgaggtcggcgaacgggccggggtcgtcggggtaactaggtactttccgactctaccacccgatccagcacgccctagaccgagggtctaggaaagagttcggtagggtacttaaggtttttaattacgttacggttaccaaggtacctaaagttttaactttaacttacctttcccctacccgttacgtaaaccgggttacccggttaccggggaaccccgaaaagggggtaacccctaaagggggttacggttaaaaccttaccgtaaaaaccggtccgttaagggtcggtaccttcggaacccgttaaccttaag

SEQ ID NO: 378942 - DNA, 555 bp, Homo sapiens
  misc_feature: GZ8MTXP01CNA5K.22.14.B03.1.454.CMB.2.raw
  modified_base (394)..(394): a, c, t, g, unknown or other
  modified_base (416)..(416): a, c, t, g, unknown or other
  modified_base (463)..(463): a, c, t, g, unknown or other
  modified_base (468)..(468): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagtatttttacagctccaccaataagagttactagctggtcagcaagaaaccaggacatcgtcctgcactgctctatttacgtgggcgtccgtacccggaacgtccggggtccctgacccccgattcgagtcgcgaaggcgggtcgtgggacagtacttcactctcaccntcagcagcctgcgagctagaanatgtgctaagttttattagttgtacagactaattacttatacttccnccttnaaggtaccgttcggaccgaaacggggaaccgaagggttagaaacttaccgtaaaacgacgttgtcggacttcggtaaccaacgtaac

SEQ ID NO: 378943 - DNA, 651 bp, Homo sapiens
  misc_feature: GZ8MTXP01BPZ82.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaacaataagattactagctggtcagcaagaaccaggacatcgtcctgcactgctactatttacgtcgggccgtaccgtacccgggggaactccccgggggtccctcggaacccccgtatttacgaggttcggccgaagggccgggttcgtcggggacagtactttccgacttctaccacagtcagcagccctgacagctagaacgattggtcggtacgtaaggtttttaattattacggtacctaaggtaccttaaagtttaactttacttaacctttccccttaccctcggtaaacggttaacccggtttccgggaaaccccgttaaagggggtaaaccccgtaagggttaaacggaacttaaccgaaaacgtaacgtggtacggacttcggaaccttaaccgtaag

SEQ ID NO: 378944 - DNA, 556 bp, Homo sapiens
  misc_feature: GZ8MTXP01CLKQC.22.14.B03.1.454.CMB.2.raw
  modified_base (415)..(415): a, c, t, g, unknown or other
  modified_base (419)..(419): a, c, t, g, unknown or other
  modified_base (433)..(433): a, c, t, g, unknown or other
  modified_base (438)..(438): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagtatttttacagctaccaccaataagagttacttagctggtccagcagaaaccaggacatcgtcctgcactgctcatttactgggtcgtcgtacccgggaatccggggtccctgaccccgattcagtcggcgaaggcgggtctgggacagtattcactctacaccatcagcagccctgcaggctgaaagngtgngtactagtttattntgtanagactaattatatacttccctctcgaacggtccggttccggaccgaaacgggaaccgtaagggttaggaaacttaaccgaaaacgtacgtggtacggcttacgtaaccttaacgtaag

SEQ ID NO: 378945 - DNA, 634 bp, Homo sapiens
  misc_feature: GZ8MTXP01AVMTK.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagtagttatttttacagtctacccaaccaaataagtagttacttagtctggtccagcaagaaaccaggacatcgtcctgcactgcttactattttacgtcgggaccgttaccggtacccgggtaacgttcccgggggtacccctacggaacccccgtattcgaggtcggacgaacgggtccggggtcgtaggggaactaggttactttcgactctacaccatcagcacgccgtagacgaggactagaagtagtggtcgggtacttaaggttttattaagttgtacgagtactaaattatttacttactttccctacctcgtaagtaccggttcggaaccgaacgggtaaaccgtaaggttacggttaaacttacgaaacggtacgtggtacggcttacgaaccaacgtaac

SEQ ID NO: 378946 - DNA, 558 bp, Homo sapiens
  misc_feature: GZ8MTXP01AY3C8.22.14.B03.1.454.CMB.2.raw
  modified_base (385)..(385): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaaccaataagagttacttagctggttccagcaagaaaccaggacatcgtcctgcactgctcatttacgtgggcgtccgtacccgggaatcccgggggtccctgaccccgattcaggtggcaaggcgggtctggggacaggtntttcactctcaccatcagcagcctagccaggctgaagagtgtggacgtagtttattattgacagactaattattaactactttccctctcaagtaccggttcggaccaaaggggaccctaaggggttacgaaacttaccgaaaacgtacgtggtcggcttacgcaaccgtaac

SEQ ID NO: 378947 - DNA, 580 bp, Homo sapiens
  misc_feature: GZ8MTXP01D105G.22.14.B03.1.454.CMB.2.raw
  modified_base (318)..(318): a, c, t, g, unknown or other
  modified_base (477)..(477): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgtaagtccagccagtagttattttttacagctaccaaccaaataagtagttacttagcttggtccagcaagaaaccaggacatcgtctgcactgctctatttacgngggcctcgtaacccgggatcccggggtcctgaccgtacttcagtggctaggcgggtctgggacagtattcactctcaccatcagccagcctagctaggctaggaagtatgaggtcttaaggttttatattgacagactaatattagtacttcctcgtcngtaaccggtgacccgtaaagggaacccgtaaagggtaacggttaaaattccgaaaaacgtaaccgtaggtcgggaccccttaggaccctaaccttaaggtccc

SEQ ID NO: 378948 - DNA, 550 bp, Homo sapiens
  misc_feature: GZ8MTXP01AF1BM.22.14.B03.1.454.CMB.2.raw
  modified_base (262)..(262): a, c, t, g, unknown or other
  modified_base (416)..(416): a, c, t, g, unknown or other
  modified_base (464)..(464): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaaactgcaagtccagccagtagttatttttacagctccaccaataagagttactanctggtccagcagaaaccaggacatcgtcctgcactgctcatttacgtgggcgtcgtacccgggatccgggggtcctcgaccccgattcgagtggcaagcgggtctgggacagtatttcgactctcaccatcagcagcctgccaggctagaaagntggtgacgtagtttattattgtctagctaaattattatattcctcctnaacgtacgttcggaccgaagggtaaccaagggttacgaaacttaccgaaaacgtacgtcggtacggcttaggtcccaaccgttaag

SEQ ID NO: 378949 - DNA, 597 bp, Homo sapiens
  misc_feature: GZ8MTXP01BLMTP.22.14.B03.1.454.CMB.2.raw
  modified_base (444)..(444): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttactagctggtcagcaagaaaccaggacattgtcctgcactgctctattttacgtgggcgttccgtaccccggggaacgttcccgggggtcccctggacccccgtattccaaggtcggcaagggccgggtcgtggggaacaggtactttcactctacacccatcagcagccctagccaggctagaaagntgtgtagttagtttatatgtacagtactaattacttatacttcctactcgtaacgtaccgttcggaaccgaaacgggtaaccgtaaagggttaacgttaaacttaaccgtaaaacgtacgttcggtacgtacttacgtaaccgttaaccgtcg

SEQ ID NO: 378950 - DNA, 542 bp, Homo sapiens
  misc_feature: GZ8MTXP01A4WG6.22.14.B03.1.454.CMB.2.raw
  modified_base (410)..(410): a, c, t, g, unknown or other
  modified_base (413)..(413): a, c, t, g, unknown or other
  modified_base (451)..(451): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagtatttttacagctccaccaataagagttactagctggtccagcaagaaaccaggacatcgtcctgcactgctcatttacgtgggcgtcgtacccgggaatccgggggtccctgacccccgattcagtggcaagcgggtctgggacagatttcactctcaccatcagcagcctgcaggctgaagntgnggctagtttatatgtcagcaaatattatattccctctnaacgtcgttccggacccaaaggggtaacccaagggttacggaaaattaccgaaaacgtaactggttcgggacttcggaaccaaccgttaag

SEQ ID NO: 378951 - DNA, 541 bp, Homo sapiens
  misc_feature: GZ8MTXP01DX6E8.22.14.B03.1.454.CMB.2.raw
  modified_base (339)..(339): a, c, t, g, unknown or other
  modified_base (401)..(401): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaatagagttactagctggtcagcaagaaccaggacatcgtctgcactgctcatttactgggcgtcgtaccggaatccgggtccctgaccccgntcagtcgcaagcggtctgggacagtattcactctacaccatcagcagcctgcagctagaagntgtggctaagttttattattgtcagtctaattacttatacttcctcctgaagtccgttcggacgttaaagggaaccctaagggttacggaaattaccgaaaacgggtaacttggtacgggcttcggaaccaaccgtaacg

SEQ ID NO: 378952 - DNA, 598 bp, Homo sapiens
  misc_feature: GZ8MTXP01CHNNL.22.14.B03.1.454.CMB.2.raw
  modified_base (307)..(307): a, c, t, g, unknown or other
  modified_base (389)..(389): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagttatttttacagtctccacaaataagattactagctggtccagcaagaaaccaggacatcgtcctgcactgctcatttacngggcgtcgtacccggaatcccggggtcctgacccccgtatcagtgcaaggcgggtctgggacagtattcactctacacctancgagcacgctgacgagctagaagtagtgtagtacgttaagttttattagttacgtactaagtacttaaatttaacgtttacttaccttaccctaccgtacgtaacggtaccggttaccggaaccggaaacgggtaaccgtaaagggttacgttaaaacttaaccgaaaacgtacgtcggtacggtacttaccgtaaccttaaccgtaag

SEQ ID NO: 378953 - DNA, 538 bp, Homo sapiens
  misc_feature: GZ8MTXP01BVL1F.22.14.B03.1.454.CMB.2.raw
  modified_base (306)..(306): a, c, t, g, unknown or other
  modified_base (435)..(435): a, c, t, g, unknown or other
  modified_base (457)..(457): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagttatttttacagctccaccaataagattactagctggtccagcagaaaccaggacatcgtcctgcactgctcatttacgngggcgtcgtacccgggaatcccggggtccctgaccccgattcgagtgcagcgggtctgggacagtactttcactctcaccatcagcagccctgcaggctagaagatgtggcttagtttattatgtcagntaattattatacttccgtcctnaacgtcggttcggacccttaaaggggacccaagggttagaaacttacgaaacggtactggtaggcttggaaccaaccgtaa

SEQ ID NO: 378954 - DNA, 571 bp, Homo sapiens
  misc_feature: GZ8MTXP01B0SNT.22.14.B03.1.454.CMB.2.raw
  modified_base (307)..(307): a, c, t, g, unknown or other
  modified_base (415)..(415): a, c, t, g, unknown or other
  modified_base (438)..(438): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagaggccaccatcaactgacaagtccagccagagttatttttacagctaccaacaataagagttactagctggtcagcaagaaaccagacatcgtcctgcatgctctatttacgngggcgtacgtacccggaacgtcccggggtccctgaccccgattcgagtgcaaggcgggtctgggacagtattcactctacaccatcagcagccctgcaggctagaagntgtgctaggttttatacgtgtanatataattattactacttcccgtctacgtaacggtaccggttaccggaaacgaaacgggtaaaccgtaaagggttaacgaaaacgttaacgtaaaacggtacgttaagggtcgacttacgtaacccaacgtaa

SEQ ID NO: 378955 - DNA, 546 bp, Homo sapiens
  misc_feature: GZ8MTXP01BJKQ9.22.14.B03.1.454.CMB.2.raw
  modified_base (428)..(428): a, c, t, g, unknown or other
  modified_base (458)..(458): a, c, t, g, unknown or other
  modified_base (473)..(473): a, c, t, g, unknown or other
  modified_base (512)..(512): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttactagctggtcagcagaaccaggacatcgtcctgcactgctactatttacgtggggtcgtccgtacccgggtaatcccgggggtccctgacccccgtattcgagtggcgaacggcgggtctggggacctagtactttcactctcaccatcagcagcctgcaggctagaagtntgtggctagttttatatgtacagtctaatnttatacttcctcctnaagtaccgttggacccgaagggacctaaggttacgaaanccgaaacgactggtacggcttacgccaactaacg

SEQ ID NO: 378956 - DNA, 539 bp, Homo sapiens
  misc_feature: GZ8MTXP01BTZ9R.22.14.B03.1.454.CMB.2.raw
  modified_base (308)..(308): a, c, t, g, unknown or other
  modified_base (421)..(421): a, c, t, g, unknown or other
  modified_base (468)..(468): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagctggtccagcaagaaaccaggacatcgtcctgcactgctctatttacngggcgtcgtaccccgggaatcccggggtccctgaccccgattcgaggtggcaaggcgggtctggggacagtatttcactctcaccatcagcagcctgcaggctagaagagtgnggtctaagttttattagttgtacagctaaattattatacttcctctnaacgtcgttcgaccgaaagggacctaagggttaggaaacttacgaaacgtactgtcggcttgcaacgtaac

SEQ ID NO: 378957 - DNA, 594 bp, Homo sapiens
  misc_feature: GZ8MTXP01AHOEN.22.14.B03.1.454.CMB.2.raw
  modified_base (305)..(305): a, c, t, g, unknown or other
  modified_base (313)..(313): a, c, t, g, unknown or other
  modified_base (481)..(481): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgaggagggccaccatcaactgacaagtccagccagtagttatttttacagctaccacaataagtagttactagtctggtcagacaagaaaccaggacatcgtctgcactgctntatttcgngggcgtacgtaccggtaagtccgggtcctgaccccattcgagtcggcgaggcgggtgtgggactagtacttcactctcaccatcacgcacgcctagacaggtctaggaagagtgggtgtacgtagttttattagtgtacagtactaaattattactacttccttaccncgtaacgtaccgggttacggaacccgaaagggtaacccgtaaaggggttacggttaaaacttacggaaaaacgtacgttggtacgggaccttacggaaccgttaacccttaag

SEQ ID NO: 378958 - DNA, 524 bp, Homo sapiens
  misc_feature: GZ8MTXP01EHEVN.22.14.B03.1.454.CMB.2.raw
  modified_base (260)..(260): a, c, t, g, unknown or other
  modified_base (415)..(415): a, c, t, g, unknown or other
  modified_base (433)..(434): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactanctggtccagacaagaaaccaggacatcgtcctgcactgctcatttacgtgggcgtcgtacccgggaatccggggtcctgacccgattcagtgcaagcgggtctgggacagtatttcactctcaccatcagcagcctgcaggctagaagatgtggntaagtttattattgtcannatattattattctcctctaagtacgttcggtacgaacggaaccgaaggttaggaagttaacaaacgaacgtaagtggcttgcgaactaac

SEQ ID NO: 378959 - DNA, 655 bp, Homo sapiens
  misc_feature: GZ8MTXP01DX9OK.22.14.B03.1.454.CMB.2.raw
  modified_base (427)..(427): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgaggagggccaccatcaactgcaagtccagccagtagttatttttacagctaccaaccaataagagttactagtctggtccagcaagaaaccaggactatcgtctgactactcgtctacttactttcggtcgggtcgtaccggtaccgggtaccgtcccgggtccgtacgtacccgtacgtacgaggtcgacgaacgggtcggtcggtaggactagttacttcactctaccactntacgacgctacgtcccgaggaccgaggtacgtaagaacgttgtgggggtacttacgggtttaaatttttaggttatttcggaacgtactaaattaacgtttaaattccttaccttcccctacgtacgtaacggttccggttaccggaacgaaacgggtaaccggaagggttaacgttaaacttaacccggaaaagtgttgggaacggcttactaaccttaacgttaac

SEQ ID NO: 378960 - DNA, 531 bp, Homo sapiens
  misc_feature: GZ8MTXP01BAY36.22.14.B03.1.454.CMB.2.raw
  modified_base (308)..(308): a, c, t, g, unknown or other
  modified_base (382)..(382): a, c, t, g, unknown or other
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctggcgagaggccaccatcaactgcaagtccagccagagttatttttacagctccaccaataagagttactagctggttccagcaagaaaccaggacatcgtcctgcactgctctatttacgngggcgtcgtacccgggaacgtcccgggggtccctggacccccgtattcagtggcaaggcgggtctgggacagtntttcactctcacatcagcagcctgcaggctagagagtgtggcgtagtttattatgtacagctaaatattatacttccctctcaagtacgttcgaaccgagggaccaagggttacgaaattacgaaagactgtaggcttgccaacgtaac

SEQ ID NO: 378961 - DNA, 572 bp, Homo sapiens
  misc_feature: GZ8MTXP01A0HSX.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagttatttttacagctccaccaataagagttacttagctggttccagcaagaaaccaggacatcgtcctgcactgctcatttacgtgggcgtcgtacccgggaatcccggggtccctgaccccgattcgagtggcaaggcgggtctgggacagtatttcactctcaccatcagcagcctgcaggctagaagagtgtaggcttaggttttattattgtacagtactaaattatttatactttccctcctcgtaacgtaccgtttcggacccttaaaggggaaccctaagggttacggaaacttacgaaaacggtactaaggttcgggcttacggaaccaacccgtaacg

SEQ ID NO: 378962 - DNA, 509 bp, Homo sapiens
  misc_feature: GZ8MTXP01AMWUD.22.14.B03.1.454.CMB.2.raw
  modified_base (411)..(411): a, c, t, g, unknown or other
  modified_base (431)..(431): a, c, t, g, unknown or other
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagtatttttacagctccaccaataagagttactagctggtccagcagaaaccaggacatcgtcctgcactgctcatttacgtgggcgtcgtacccgggaatcccgggggtccctgaccccgattcagtggcaaggcgggtctgggacaggactttcactctcacatcagcagcctgcaggctagaagntgtgctagtttatatgtacngcaaatattatactcctacctcaagacttggccaagggaccaagggttgaaattcaaacggatgtgcttgcaacctaa

SEQ ID NO: 378963 - DNA, 567 bp, Homo sapiens
  misc_feature: GZ8MTXP01C72UE.22.14.B03.1.454.CMB.2.raw
  modified_base (146)..(146): a, c, t, g, unknown or other
  modified_base (385)..(385): a, c, t, g, unknown or other
  modified_base (391)..(391): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggganattgtgatgacccagtctccagactcctggctgtgtctctggcgagagggccaccatcaactgcaagtccagccagagtatttttacagctccacaataagagttactagctggtcagcagaaaccaggacatcgtcctgcactgctacatttactgggctctacccgggaatccggggtcctgaccccgattcagtgcaagcgggtctggggacaggtatttcaactctcaccatcancacgcngcgagcgagagagtgtgtacgttagtttaattattagtactagactaaattaattaattacttacctcctctaacgtacgttacggtaaccgaaacggaaacgtaaacggttaaggttaaacgttaacgtaaacgtaaacgtaacgtacggtacgttacgtaaccgaaccgtaacg

SEQ ID NO: 378964 - DNA, 549 bp, Homo sapiens
  misc_feature: GZ8MTXP01CE9QM.22.14.B03.1.454.CMB.2.raw
  modified_base (307)..(307): a, c, t, g, unknown or other
  modified_base (415)..(415): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagtatttttacagctccacaataagagttactagctggtccagcaagaaaccaggacatcgtcctgcactgctctatttacgngggcgtccgtacccgggaatcccggggtccctgaccccgattcagtggcaaggcgggtctgggacagtattcactctcaccatcagcagccctgccaggctagaacgntggtggctagttttatagtttgacagctaaatttattattacttccctcctgaacgtacgtttcggacccaaaggggaaccctaagggttacggaaattaccgaaaacggactggacggcttagcccaacgtcg

SEQ ID NO: 378965 - DNA, 586 bp, Homo sapiens
  misc_feature: GZ8MTXP01DMDWT.22.14.B03.1.454.CMB.2.raw
  modified_base (443)..(443): a, c, t, g, unknown or other
  modified_base (497)..(497): a, c, t, g, unknown or other
  modified_base (566)..(566): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagacctccctggctgtgtctcgtgggcgaggagggccaccatcaactgacaagtccagccagagttatttttacagctaccaacaaataagtattactagctggtcagcaagaaaccagacatcgtctgcactgctactatttacgtgggccgtaccgtacccgggaagtcccgggggtccctcggacccccgtattcgaggtggcgtaagggtccgggtcgtaggggactagtactttcactctaccaccatcgagcagccctgcgagcagaagntgtcgattagtttattattgtacaagtactaaattattactacttcccctctanaacggtaccgttccggaacgttaaacgggaaccgtaagggttaaggaaacttacgaaaacgacgttggnggtcttagaaccaaccgtaa

SEQ ID NO: 378966 - DNA, 565 bp, Homo sapiens
  misc_feature: GZ8MTXP01CYUOB.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagctgtcagcagaaccagacatcgtctgcactgctctatttacgtgggtcgtcgtacccgggaatcccggggtcctgaccccgattcgagtcggcaacggcgggtcgtgggacaggtacttcactctaccacatcagccagcctgccaggctaggaagataggtgggacttaaggtttatttaagttgtctaagctaaattaacttattaacttccctctcgaagtaccggttaccggccgaaaggggtaacccaagggttacggaacttaaaacgaactaacgtggtagacttgaaccaacgtaac

SEQ ID NO: 378967 - DNA, 523 bp, Homo sapiens
  misc_feature: GZ8MTXP01EWXAH.22.14.B03.1.454.CMB.2.raw
  modified_base (406)..(406): a, c, t, g, unknown or other
  modified_base (410)..(410): a, c, t, g, unknown or other
  modified_base (443)..(443): a, c, t, g, unknown or other
  modified_base (523)..(523): a, c, t, g, unknown or other
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagtatttttacagctccacaataagagttactagctggtccagcaagaaaccaggacatcgtcctgcactgctctatttactgggcgtcgtacccgggaatcccggggtccctgaccccgattcagtggcaagcgggtctgggacagatttcactctcaccatcagcagcctgcaggctgaanatgnggctagttttaattatgtacagctaaattattntaattcccgtcctcaagtcgttcggaccttaaagggacctaaggttacggaaattcgaaaacgatgaggcttgccaactn

SEQ ID NO: 378968 - DNA, 609 bp, Homo sapiens
  misc_feature: GZ8MTXP01BCFUC.22.14.B03.1.454.CMB.2.raw
  modified_base (313)..(313): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccacaataagagttactagtctggtccagcaagaaaccaagacatcgtcctgccactcgctctattttacgngggtccgttccgtacccgggtaacgtcccgggggtccctcggacccccgtattcgaggtggaccgtaacgggccggggtcgtggggacctaggtactttccactctacacccatccagcagcctagcagcagagatgtggacttaagttttattagttgtacaagtctaaattattatacttccctaccgtcaacggttaccggttccggaaaccgttaaacggggaccctaaaggggttacggaaaacttaccgaaaacgtacgtggtacgggcttacgaaccgttaacctaacg

SEQ ID NO: 378969 - DNA, 637 bp, Homo sapiens
  misc_feature: GZ8MTXP01CH6I5.22.14.B03.1.454.CMB.2.raw
  modified_base (294)..(294): a, c, t, g, unknown or other
  modified_base (448)..(448): a, c, t, g, unknown or other
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagacctccctggctgtgtctcgtggcgagagggccaccatcaactgcaagtccagccagagttatttttacagctccacaataagagttactagctggtcagcagaacagacatcgtctgcactgctntattacgtgggcgtcgtacccggaatcccggggtcctgacccccgtattcaggtcggacgaagggtccgggtcgtggggaacctaggtactttccaaccttctcccaacctactcgaacgccgaacgccccgtgaccgaagggcctagaaagtntagggttgacgtttaaaggttttatttagttacggtaacaagtaacttaatttaacttaacttaccttccctaccgtacgtaacggtaccggttaccggaaaccggaaacgggtaaaccgtaaagggttacgttaaaacgttacgaaaacggtaacgtcggtcgtacgttacgtaacccttaacgtaac

SEQ ID NO: 378970 - DNA, 584 bp, Homo sapiens
  misc_feature: GZ8MTXP01ED2A2.22.14.B03.1.454.CMB.2.raw
  modified_base (371)..(371): a, c, t, g, unknown or other
  modified_base (450)..(450): a, c, t, g, unknown or other
  modified_base (480)..(480): a, c, t, g, unknown or other
  modified_base (508)..(508): a, c, t, g, unknown or other
  modified_base (584)..(584): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagactccctggctgtgtctcgtgggcgaggacgggccaccatcaactgacaagtccagccagtagttattttacagtcctaccaacaataagtagttactagtctggtccagacaagaaaccgaggacatccgtacctgcactcgctactatttacgcgggtccgtaccgtaccggaacgtcccggggtccctcgaccccgtnttcgaggtcggccaagggtcgggtcgagggacagtacttccacgtctacacctatcacgcacgctagcgagctaggaangtggtcgtagttagttttacgttattcganacgtataaatttacttataccttccctntcgaaggtcgttcggaaaccgagggtaaacaaggttagaaacttacgaaagtactgtcggattacgcttaaccgtn

SEQ ID NO: 378971 - DNA, 571 bp, Homo sapiens
  misc_feature: GZ8MTXP01AGBCA.22.14.B03.1.454.CMB.2.raw
  modified_base (411)..(411): a, c, t, g, unknown or other
  modified_base (416)..(416): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagtatttttacagctcacaataagagttactagctgtccagcagaaaccaggacatccgtcctgcactgctctatttacgtgggccgttcgtaccccggggaagtcccgggggtccctggtacccccgattcgacggtcggcgaacgggcggggttctggggacagtactttcactctcaccatcancgacncctgcaggctagaagtagtgtggtacgtagtttattaagttgtacagactaattattatacttcctcctcaagtcgttacggaccgaaagggacctaagggttacggaaaacttacgaaaacgtacgtggtcggcgttagtaaccgaacgtaacg

SEQ ID NO: 378972 - DNA, 529 bp, Homo sapiens
  misc_feature: GZ8MTXP01EJRVF.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagctggtccagcagaaaccaggacatcgtcctgcactgctcatttactgggcgtctacccgggaatccggggtccctgaccccgattcagtgcaagcgggtctgggacagatttcgactctcacatcagcagcctgcaggctgaagatgtggctagtttattatgtcagcaattattatattccctctcaagtacgttcggacccttaaaggggaccctaaagggttacggaaaattacgaaaacgaacttggaggcttggcaacccgtaa

SEQ ID NO: 378973 - DNA, 674 bp, Homo sapiens
  misc_feature: GZ8MTXP01DYHTE.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgaccccagtctccagacctccctggctgtgtctcgtgggcgaggacgggccaccatcaactgacaagtccagccagtagttatttttacagctacccaaccaaataagagttacttagtcgtcgtcacgacaagaaaccgacggacatccgtacctcgcactacgtctacttactttacgtcgggtccggtaccgtaccccgggtacgttcccggggtcccgtaccgaccccgtacgttcgtacggtcggcgacgggtcgggtcgtagggaccgtagtactttacgtacgtcctaccaccaactcacgcacgccgtaagccgagtacgagaagtagttgtagggtacgttagtttttaagttaagttcgtacacgtattaaatttaactttctttaacctcccgttccgtaacgaacggttaccggttaccgggaaaccgaacgggtaccgtaaagggttaacgaaacttaccggaaaaacgtccttaagggtcggtcagtaaccccttaacgttaacg

SEQ ID NO: 378974 - DNA, 541 bp, Homo sapiens
  misc_feature: GZ8MTXP01BORA9.22.14.B03.1.454.CMB.2.raw
  modified_base (299)..(299): a, c, t, g, unknown or other
  modified_base (344)..(344): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagttatttttacagctccaccaataagagttactagctggtccagcagaaaccaggacatcgtcctgcactgctnatttactgggcgtcgtacccgggaatcccggggtcctgaccccgnttcgagtggcaaggcgggtctgggacagtatttcactctcaccatcagcagcctgcaggctagaagtatgtggctaggttttattagttcgtacagtctaaattatttactacttccctactcaagtccgttcggaccaaaggggacctaagggttacggaaattacgaaacgtatggtggcttagccaaccgtaag

SEQ ID NO: 378975 - DNA, 655 bp, Homo sapiens
  misc_feature: GZ8MTXP01DEMU6.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggagggccaccatcaactgacaagtccagccagtagttatttttacagtctacccaaccaaataagagttacttagtctggttcagcaagaaaccgagacatcgtcctgcactgctactagtttacgtgggtccgtaccggtacccgggtaacgtcccggggtcctcgaccccgtatcgagtcggcgaacgggcgggtcgtgggacagtacttcactctacacatcacgcacgcccgtgaccgacgggtactagggaaagtagtgggttacgggactttaaaggttttatttaaagtttcggtacaagtactaaatttaaacttattaccttccctcctacgtaacggtaccgtttacccgggaaccgaaacggggtaaaccgtaaggggttaaacgaaaacgttaaccgtaaaaacggtaaccgttgggttacggcttaccggaaccgaacccgttaac

SEQ ID NO: 378976 - DNA, 674 bp, Homo sapiens
  misc_feature: GZ8MTXP01DVGEG.22.14.B03.1.454.CMB.2.raw
tcagacatacgcgtcacgaccggtgctcgatttagtgtgagtagttccgcggggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgacaagtccagccagtagttatttttacagcctaccaacaataagtagttactagtctggtccagacaagaaaccaggacatcgtcctgcactgcctactactttacgtcgggtccgtaccggtacccgggtacgtcccgggggtccctacgtaccccgtacttcgaggtcggccgtaacgggtccgggttcgtaggggaacctaagttactttaccacttctacccaccctaatccaacggcaacgtccccgtaggaccgagggtacttaagggaaacgtagtgggttacggtactttaaaggttttttaactttagttcgtacgaaagttactaaatttatttacttactttcccctctagtaacggtaccgttccggaaccgaaagggtaccctaaagggttaacgttaaaacttaaccgaaacggtactcggaacggccttagaaccttaacgtaac

SEQ ID NO: 378977 - DNA, 557 bp, Homo sapiens
  misc_feature: GZ8MTXP01B9WR0.22.14.B03.1.454.CMB.2.raw
  modified_base (371)..(371): a, c, t, g, unknown or other
  modified_base (420)..(420): a, c, t, g, unknown or other
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagttatttttacagctccacaataagagttacttagctggttccagcaagaaaccaggacatcgtcctgcactgctctatttacgtgggcgtccgtacccgggaactcccggggtccctgaccccgtatcgagtcggcaaggcgggtntgggacagtatttcgactctcaccatcagcagccctgcagctgagatgnggctagtttatattgtacagtcaaattattatacttccctctcgtaacgtccgtttcggaccgaaaggggtaaccctaagggttacggaaaacttcgaaaacccgtaattgggtaggacttggaaccaaccgttaag

SEQ ID NO: 378978 - DNA, 681 bp, Homo sapiens
  misc_feature: GZ8MTXP01AJWKA.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagacctccctggctgtgtctcgtgggcgagacgggccaccatcaactgcaagtccagccagtagttatttttacagctccacaataagattactagctgtcagcaagaacagacatcgtcctcgcactgctactacgtttacgtcgggtccgttaccggtaacccggggtacgtccccgggggtccctacggacccccgtattcgaggtcggcgtaacgggtccgggtcgtacggggaccaggttactttccactcctccaaccgtaatccgaaggtaccacggccgtaggacgtacgggtactaggaaagtggttggtcgggtaaccttaaggtttttattagttacggtaccgagtaaccttaaatttactttaacttacccttcccgtaccgttacggtaacgtcccgggtttacggaaaccccggttaaaggggtaacccgtaaagggttacggaaacttaacggaaaacggtaccgtgggtaacggcttacggtaacccaaccgtttcg

SEQ ID NO: 378979 - DNA, 654 bp, Homo sapiens
  misc_feature: GZ8MTXP01C6FMF.22.14.B03.1.454.CMB.2.raw
  modified_base (424)..(424): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggacgggccaccatcaactgcaagtccagccagtagttatttttacagtctaccaaccaataagtagttacttagctggttccagcaagaaaccaggacatccgtcctgcactgacttctatttacgtgggccgtccgtaacccgggaagtcccggggtcctcggacccccgtattcgaggtcggacgaagggtcgggtcgtgggacagtattccactctaccactacncgacgcacgccgtagacgtaggtcgtaagaagtgttagggtacgttaacgtttaaggttttaattcgttacgactaagtaacttaatttacttacttccgttaccctcgtaacgtaaccgggttacggttaccgggaaaccggaaacgggtaaccgtaaagggttaacgttaaacttaaccggaaacgttcggtcgggtaccgtacgttaccgtaaccgttaaccgtaag

SEQ ID NO: 378980 - DNA, 706 bp, Homo sapiens
  misc_feature: GZ8MTXP01DAZ67.22.14.B03.1.454.CMB.2.raw
  modified_base (454)..(454): a, c, t, g, unknown or other
tcagacatacgcgtcacgaccggtgctcgatttagtgtgagtagttccgcggggggagctacaacaggcagtcaggggcagcaagatggtgttgcagacccaggtcttcatttctctgttgctctggatctctggtgcctacggggacattgtgatgacccagtctccagacctccctggctgtgtctcgtgggcgaggacgggccaccatcaactgacaagtccagccagtagttatttttacagtctaccaacaaataacgtagttactagtctgtaccagcaagaaaccaggacatcgtcctgctactgctctagtttacgtgggtcctaccggtacccgggaacgtcccgggggtaccctacggacccccgtattcgaggtcggcgtaacgggtcgggttcgtagggggactaaggtacttaccactctaccactactcagcacgtcccngacgaggtctaggaagtgtggtacggtatttaaggtttttatagttacggtacgtaagtaaccttaaaattttaacttaactttaaccctttcccctaaccccgtttgtaaaccgggttaacccggtttacccggggaaaaccggttaaaccggggtaaaacccggtaaggggttaaaccgttaaaacttaaaccggtaaacggtaaacgttcgggttacgacgttacggtaacccgttaaccgtttaaccg

SEQ ID NO: 378981 - DNA, 524 bp, Homo sapiens
  misc_feature: GZ8MTXP01E4DVK.22.14.B03.1.454.CMB.2.raw
  modified_base (520)..(520): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagctggttccagcaagaaaccaggacatcgtcctgcactgctctatttacgtgggccgtcgtacccgggaactcccgggggtccctaccgtacttcagtggcaggcgggtctgggacagtattcactctcaccatcagcagcctgcaggctagaagatgtgctaggtttattatgtacagtcaatattatacttcctctcagaacgttcgaacgaagggaccaaaggtagaaattcaaacgtaactgtggctgacctaaccnttcg

SEQ ID NO: 378982 - DNA, 580 bp, Homo sapiens
  misc_feature: GZ8MTXP01CRH0H.22.14.B03.1.454.CMB.2.raw
  modified_base (295)..(296): a, c, t, g, unknown or other
  modified_base (340)..(340): a, c, t, g, unknown or other
  modified_base (357)..(357): a, c, t, g, unknown or other
  modified_base (411)..(411): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtggcgagacggccaccatcaactgcaagtccagccagtagttatttttacagtctaccaaccaataagagttactagctgtcagcaagaaccagacatcgtctgcannctctattacgtgggctcgtaccggagtcccggtcctgaccccgntcagtgcgaagcgggtntgggatagtacttcactctcacatcagcagccctgccagggtacctaggaaagngtagtacggactttaagttttagttaattcggataacgtataaattattactaccttccctacctagtaacgtaccgggttacggaacccgaaaggggtaaacctaaagggggttacgaaaacttaccgaaaacgaacgtggtcggacttcggaacccttaacgtaacg

SEQ ID NO: 378983 - DNA, 554 bp, Homo sapiens
  misc_feature: GZ8MTXP01BG8AK.22.14.B03.1.454.CMB.2.raw
  modified_base (471)..(471): a, c, t, g, unknown or other
  modified_base (480)..(480): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttactagctggtccagcaagaaaccaggacatcgtcctgcactgctctatttacgtcgggccgtaccgtacccgggaacgtcccgggggtccctcggaccccgtattcgaggtggcgaacggtcgggtcgtgggacaggtacttcgactctacaccatcagcacgcctgcaggctagaagatgtgcttagttttatattgaccagactaattaattntactttccnctacgaagtacgttcggaccaagggaacctaaggacgaacttacgaaacgactgtcggcttacgaacaacgtcg

SEQ ID NO: 378984 - DNA, 657 bp, Homo sapiens
  misc_feature: GZ8MTXP01CUE0I.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagtagttatttttacagtctaccaaccaaataagtagttactagtctgttccagcaagaaaccaggacatcgtcctgcactgctactatttacgtgggtcgtaccgtacccgggtaacgtcccggggtccctcggacccccgtattacgaggtcggacgtaacgggcggggtcgtaggggaactaaggtactttcgacttcctaccacctatcaagcacgccctagaccgaggccgtagaaagtgtggtacggtagttaagttttagttaagttgtacaacgtattaatttaatttacttacctttaccctcctacgtaacggtaccggttaccgggaacccaaaggggtaaaccccgtaagggttaaacggaaacttaaaccggtaaaacgtaccgtaaggttcggacttaccggaaccttaacccgttaacg

SEQ ID NO: 378985 - DNA, 613 bp, Homo sapiens
  misc_feature: GZ8MTXP01EINQM.22.14.B03.1.454.CMB.2.raw
  modified_base (591)..(591): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtggcgagagggccaccatcaactgacaagtccagccagtagttatttttacagctaccaaccaataagtagttacttagctggtacagacaagaaaccaggacatcgtctgcactgctactagtttacgtgggtccgttaccgtacccgggtaacgtcccggggtaccctcggaccccgtattacgaggtcggacgaacgggcgggtcgtagggacagtactttcactctaccaccatcaagcacgccctagacgaggtactaggaaagtgttggtagggtactttaaggtttttattagttcgtacaatacttaaatttacgttacttacttccctacctcgtaaacggtcgttaccggaacgttaaagggacctaaagggttacgaaacttacgaaacgtntcgtaggcttagcccttaatcg

SEQ ID NO: 378986 - DNA, 571 bp, Homo sapiens
  misc_feature: GZ8MTXP01EY8Y2.22.14.B03.1.454.CMB.2.raw
  modified_base (304)..(304): a, c, t, g, unknown or other
  modified_base (416)..(416): a, c, t, g, unknown or other
  modified_base (439)..(439): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttactagctggtccagcaagaaccagacatctctgcactgctcatttacncgggcgtccgtacccgggaatccgggggtccctgaccccgattcgagtggcaaggcgggtcgtagggactagatttccactctcaccatccaagcagcctagcagctagaanatgtgctagttttatattgacantaatatttatactttccctactctaaggtccgtttacgggacccgttaaagggaaccctaaaggggttacggttaaaacttaccgaaaaaccgaacgttggttaacgggcttcggaacccttaacgtaaccg

SEQ ID NO: 378987 - DNA, 603 bp, Homo sapiens
  misc_feature: GZ8MTXP01CUGBD.22.14.B03.1.454.CMB.2.raw
tcagacatacgcgtcacgaccggtgctcgatttagtgtgagtagttccgcggggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccatcatcaactgcaagtccagccagtagttatttttacagtcctaccaacaataagtagttacttagcttggtccagcaagaaaccaggacatccgtcctgacactgctactatttacgtgggccgtaccgtacccgggaacgtcccggggtccctcggaccgtattcgaggtcggacagggtcgggtcgtgggactagtactttcacttcctaccactactacacgcacgtcctacgcaacgggtctagaagtagttggttacggggtacttaaggttttaattagttcgtactagtactaaattatttattacttcctcctcgacgttacggttcgacgaaagggtaccaaagggttacgaaactaacgaaagtaacgtggtaggactcgaactaaccg

SEQ ID NO: 378988 - DNA, 600 bp, Homo sapiens
  misc_feature: GZ8MTXP01D3PNO.22.14.B03.1.454.CMB.2.raw
  modified_base (463)..(463): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggacgggccaccatcaactgacaagtccagccagtagttatttttacagctaccaacaataagtagttactagctggtccagacaagaaccaggacatccgtctgcactgctactatttacgcgggtcctaccggtacccgggtaacgttcccggggtaccctacggtaacccccgtattacgaggtcggcgaaacgggtcgggttcgaggggaacctagtactttaccgactctccaccatcagctacgccctgccaggctagaagntgcggtatagtttatattgacagactaattattgttaacctccgtacctcgtaagtaccgttcggaccgttaaagggaccgtaagggttaagaaacttacgaaaacggtatgggtcgacttcgaacgttaaccgttg

SEQ ID NO: 378989 - DNA, 635 bp, Homo sapiens
  misc_feature: GZ8MTXP01BPEBB.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagactccctggctgtgtctctgggcgagagggccaccatcaactgacaagtccagccagtagttatttttacagtcctaccaacaataagtagttactagtctggtcagacaagaaaccaggacatccgtcctgcactgctactatttacgtcgggtccgtaccggtacccgggtaacgttcccggggtccctacggaacccccgtattacgaggtcggcgtaacgggtccgggtcgtgggaacctaggtacttccgactctaccacctatcagcagccctgacgagctagaagtgtaggtggtacttaagtttacgttatcggtaactagtaactaatttaattacgtacctttccgtacctacggtaagtacccgggttcggaaacccaaaggggtaaccctaagggttaacggttaaattacccgaaaagtcgtggtacggacttacgaaccttaacccgtaag

SEQ ID NO: 378990 - DNA, 548 bp, Homo sapiens
  misc_feature: GZ8MTXP01BPDDH.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagctggttccagcagaaaccaggacatcgtcctgcactgctcatttacgtgggccgtcgtacccgggaactcccgggggtccctggaccccgattcgagtggcgaaggcgggtctgggacagtatttcgactctcacatcagcagcctgcaggctgaagatggtggctagttttatagttgaccagctaattatttatactttccctctcaaggtaccgtttcggaccaaaggggaccctaagggttacgaaacttcgaaaacgtactgtcgggacttgaacaaccgtaa

SEQ ID NO: 378991 - DNA, 659 bp, Homo sapiens
  misc_feature: GZ8MTXP01C7K4D.22.14.B03.1.454.CMB.2.raw
  modified_base (324)..(324): a, c, t, g, unknown or other
  modified_base (529)..(529): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgaggagggccaccatcaactgacaagtccagccagtagttatttttacagctacccaaccaaataaagagtttacttagtctggttccagacaaacgaaaccaggacatcgtcctgcactgctcatttacgngggtcctaccgtacccgggaacgtcccgggggtcctacgaccccgtattcgagtggcgaacgggcgggtcgtgggacaggtactttccgactcgaccacctatcaacgtcacgtccgagaccgaggtctagaaagtgtggtcggtattagtttttaatctttaggactaagtactaaattattaaacttcttaccctccgttaanaacgggttaaccgtttccggggaaacccgttaaaacggggtaaacccgtaaagggggttaacgttaaaaacgttaccgtaaaaaccgggtaaactggggttcgggaccttacggaaccttaacccttaag

SEQ ID NO: 378992 - DNA, 621 bp, Homo sapiens
  misc_feature: GZ8MTXP01AIYUQ.22.14.B03.1.454.CMB.2.raw
  modified_base (311)..(311): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagttatttttacagctccaccaataagagttacttagctggttccagcaagaaaccaggacatcgtcctgcactgctctatttacgngggcctccgtacccgggacgtcccggggtccctgacccccgatttcgagtcggcaaggtccgggtctaggggaccaggtactttcactctaccacatcaagcagcctgcaggctaggaaatgtggtcggacttaggttttacttaattcggtaccaaggtacctaaatttaactttactactttccctacctttcgaaacggtcccggtttacggaacccgttaaaggggtaacccctaaaggggttacggaaaaacttaccgaaaacggtaaccttggttacgggccttacggaacccttaaccgttcg

SEQ ID NO: 378993 - DNA, 636 bp, Homo sapiens
  misc_feature: GZ8MTXP01DGKA1.22.14.B03.1.454.CMB.2.raw
  modified_base (299)..(299): a, c, t, g, unknown or other
  modified_base (385)..(385): a, c, t, g, unknown or other
  modified_base (411)..(411): a, c, t, g, unknown or other
  modified_base (434)..(434): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagtagttatttttacagctaccaaccaataagagttactagtctggtacagacaacgaaaccgaggacatcgtccngcactgctctatttacgtcgggtcgtccgtaccggtaacgtcccggggtcctacgaccccgtatcgagtcggcgaaggcgggtcgnggacagtatctactctcacctatcancacgcctagctaggctagaagtntggtggtacttaaggttttatttaacttggtactagtacttaaattaatttacttactttaccctccgaacgtaacgttaacccgggtttccgggaaacccgaaaacgggggtaacccctaagggggttaaaacggttaaacgttaacccgtaaaaacggtaccgtttgggacgggacgttaccgtaaccaacccgtttaac

SEQ ID NO: 378994 - DNA, 505 bp, Homo sapiens
  misc_feature: GZ8MTXP01D47PI.22.14.B03.1.454.CMB.2.raw
  modified_base (404)..(404): a, c, t, g, unknown or other
  modified_base (445)..(445): a, c, t, g, unknown or other
  modified_base (496)..(496): a, c, t, g, unknown or other
  modified_base (505)..(505): a, c, t, g, unknown or other
tcagacatacgcgtcacgaccggtgctcgatttagtgtgagtagttccgcgggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccacaataagagttactagctggttcagcagaaaccaggacatcgtcctgcactgctcatttactgggctcgtacccgggaatccggggtcctgaccccgattcagtgcaagcgggtctgggacagatttcgactctcaccatcagcagcctgcagctagaaagntgtgactagtttatattgcagtactaaatattatctcctcnaagtcgttcgacgaaggacaaggttagaaattacaaacgtatggtgcttancttaacgtn

SEQ ID NO: 378995 - DNA, 556 bp, Homo sapiens
  misc_feature: GZ8MTXP01C8RT1.22.14.B03.1.454.CMB.2.raw
  modified_base (474)..(474): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagttattttttacagctccaaccaataagagttactagcttggttccagcaagaaaccaggacatcgtcctgcactgctactatttacgtgggcgtccgtacccgggaacttcccgggggtccctcgaccccgattcaggtcggcaaggcgggtcgtgggacagtacttcactctcacatcagcagccctagcaggctagaagatgtggctaagttttattacttgcagctaattattatacttcctctnaagtacgttcggaccttaaagggaccctaaagggttacgaaattacgaaaaccggtaatggtacggcttacgccaacctaag

SEQ ID NO: 378996 - DNA, 546 bp, Homo sapiens
  misc_feature: GZ8MTXP01AZINL.22.14.B03.1.454.CMB.2.raw
  modified_base (427)..(427): a, c, t, g, unknown or other
  modified_base (464)..(464): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttacttagctggtccagcaagaacaggacatcgtcctgcactgctctatttacgtgggtccgtccgtaccccgggaattcccgggggtccctgacccccgattcgaggtggcaaggcgggtctgggacagtactttcactctcacatcacgcagccctagcaggctagaagtntgtggctaggttttattattgtacagctaattacttntacttccctcttcgaagtacgttcggaccgaagggaccaagggttgaaattacgaaacgacgtgtacgcttgtcaacctaag

SEQ ID NO: 378997 - DNA, 617 bp, Homo sapiens
  misc_feature: GZ8MTXP01B2PQA.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagacgggccaccatccaactgacaagtccagccagtagttatttttacagctaccaccaataagagttactagctggtccagacaagaaaccgaggaccatccgtcctgcactgctactatttacgtgggtccgtaccgtacccggggacgtcccggggtccctcggaccccgtagttcgaggtcggcgaacgggcgggtcgtaggggactagtactttccgactctaccacctatccgagcacgccctgcaggtcagaagtgtgtacggtacttagttttattagtgtacagtactaattattactaccttccctctacgaacggttacccgttcgggaccgttaaagggtaacccgtaaagggttacgaaaacttaccggaaaacgtcgtggtacggccttacgaacccttaaccgttaag

SEQ ID NO: 378998 - DNA, 592 bp, Homo sapiens
  misc_feature: GZ8MTXP01D9PMN.22.14.B03.1.454.CMB.2.raw
  modified_base (369)..(369): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagctggttccagcaagaaaccaggacatcgtcctgcactgctcatttactgggctcgtacccgggaactcccggggtccctgaccccgattcgagtggcaaggcgggtcgngggacagtatttcgactctacaccatcagcagccctagcagggctagaagagtgtcggtacttaaggttttattagtttcgacagtactaaattatttactactttccctacctcgaacggtaccgtttccgggaaccgttaaaggggtaccctaaagggttacggaaaacttaccaaaaaccggtaacgtggttacgggaccttacggaaccgaacgttaac

SEQ ID NO: 378999 - DNA, 584 bp, Homo sapiens
  misc_feature: GZ8MTXP01B5PR8.22.14.B03.1.454.CMB.2.raw
  modified_base (446)..(446): a, c, t, g, unknown or other
  modified_base (491)..(491): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagacctccctggctgtgtctcgtgggcgaggagggccaccatcaactgacaagtccagccagtagttatttttacagcctaccacaataagagttactagtctggtcagacaagaaacagacatcgtcctgcactgctacatttacgtgggccgtaccgtacccgggactcccgggggtccctcggaccccgtcttcgacggtggcgaaggccgggtcgtggggacacgtacttccactctaccaccatcagcagccctagcaggctagagatgtcggntaagtttattatgtacagtactaaattattactacttcccctacncgtaaggtccgttaccggaacgttaaacggggacctaaagggttaggttaaaacaccgtaaaagacgtggtaggccttaggaaccaaccgtaa

SEQ ID NO: 379000 - DNA, 790 bp, Homo sapiens
  misc_feature: GZ8MTXP01CRXDO.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagactcctggctgtgtctcgtggcgaggacggccacatcaactgacaagtccagaccagtagttatttttacagtcctaccaactaaagtaagtacgttactagtcgtggtaccagacaacgaaaccaggactactcgtcctgcactgacctctacgtttacgcgggtaccgtaccggtacccggggtaacgtcccggggtcccgtacggtaccccgtattcgaggtcggacgtaacgggtccgggtcgtacgggaactacggttacttaccgactcctaccaaccctatccgacgggtaccacgtcccgtacgggacgtaacggggtacttaagggaaacgtggtttaagggttccggggtaacttttaaagggtttttttaattactttacggggaacctaaaggtaaaccctttaaagttttaaacttttacgttaaccccgtttacccccttccgggttaacgtaaaacccgggggtttcccggttacccgggggtaaacccggaaacgggggtaaaccccgttaaaagggggaacggtttaaaaaccgaaccccgtaaaaaaggttaccggtttgggaacccgggttaccggttacgaaccccgttaaccgttaacg

SEQ ID NO: 379001 - DNA, 531 bp, Homo sapiens
  misc_feature: GZ8MTXP01EBFIV.22.14.B03.1.454.CMB.2.raw
  modified_base (259)..(259): a, c, t, g, unknown or other
  modified_base (387)..(387): a, c, t, g, unknown or other
  modified_base (409)..(409): a, c, t, g, unknown or other
  modified_base (443)..(443): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagattactanctggtccagcagaacaggacatcgtcctgcactgctcatttacgtgggcgtcgtacccgggaactccggggtcctcgaccccgattcgagtggcaaggcgggtcgtgggacagatttcactctcaccntcagcagcctgcagctagaaantgtggcttaagtttattatgtacaagctaaattnttaactattccctctgaacgtacgttcgggacccttaaaggggaccaaagggttgaaaattcgaaaagactgtggcttagccaactaa

SEQ ID NO: 379002 - DNA, 680 bp, Homo sapiens
  misc_feature: GZ8MTXP01CPHGR.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagacgggccaccatcaaactgacaacgtccagccaagtagtttatttttacagtcctaccaaccaaataagtagttaacttacgtcgttggtaccagcaaacgaaaaccgaggacatccgtactgccactgctactatttacgtcgggccgtaccgtaaccccgggaacgttcccggggtcctacgtaaccccgtattacgaggtcggcgaacgggcgggtcgtagggacgtagtactttcacttctaccactaatcgaacgcgaacgtccgtagaccgagggtcctaagaaagtagtgggttcggactttaaaggtttttatagtttgactaacgtactaagtttaacttattacgttccctactcgtaacggtaaccgttcgggaaccgaaacggggtaaacctaagggttaaacggttaaaacttacgaaaaacccggtaagttcgggtaacccggtagttacgaaccttaaacccggtttcg

SEQ ID NO: 379003 - DNA, 606 bp, Homo sapiens
  misc_feature: GZ8MTXP01A6LVM.22.14.B03.1.454.CMB.2.raw
  modified_base (443)..(443): a, c, t, g, unknown or other
  modified_base (473)..(473): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggagggccaccatcaactgcaagtccagccagagttatttttacagtctaccaaccaataagtagttacttagctggtcagcaagaaaccaggacatccgtctgcactgctctatttacgtgggcgtccgtaccgggactcccgggggtaccctcggaccccgtatttcgaggtcggcgaaggcgggtcgagggacaggtactttcactctacacctatcagcacgcctagacgtacgctagaaagtntggtacggacttagtttaattattacgtanagtactaattattactacttcccgtacctgaacgttacggttccggacgaaacgggaaccgtaagggttacggaaacttaaccgaaaacggtaccgtggttacgggaccttacggaacccgttaacgtaaccg

SEQ ID NO: 379004 - DNA, 666 bp, Homo sapiens
  misc_feature: GZ8MTXP01CJ3ZX.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagacctcctggctgtgtctcgtggcgagacgggccaccatcaactgacaagtccagccagtagttattttacagtctaccaacaataagtagttactagctgtaccagacaagaaacagacatcgtcctgcactgctactatttacgtcgggtccgtaccgtacccgggaacgtcccggggtacctacggaccccgtattcgaggtcggacgtaaacgggtccgggtcgtacggggaactacgggttacttttaccgaaccttcctaccaaacccttagtccgaaacggcccaacggttcccctaggacccgaagggtaccttaagggaaaagtcgttggggttacggtactttaaagggtttttatagtacggtacaagtactaaatttacttaactcttccctactagaaccgtacggttccggaaccgaaagggtaacctaagggttaacgaaacttacccgaaaagtcgtggtacgcttacgtaaccgaaccgtg

SEQ ID NO: 379005 - DNA, 723 bp, Homo sapiens
  misc_feature: GZ8MTXP01CQZAO.22.14.B03.1.454.CMB.2.raw
  modified_base (313)..(313): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgcaagtccagccagtagttatttttacagctaccaacaataagtagttactagctggtccagcaagaacaggacatcgtcctgcactgctactatttacgngggtccgtaccgtacccgggtaagtccccgggggtccctacggaacccccgtatttacgaggtcggaccgaaaggggtcccggggtcgtaggggtaacaacggttactttaccaccttcctaccaaccctatccgaaacggcaacggtcccctaggacgaacgggtctaaggaaaacgtagtggttacgggtactttaaaggtttttagttaattcggtaacctaaggtaaccttaaattttaaactttacttaaccctttccccgtacccttacgaaaccgggttaacccggtttcggggaaacccgttaaacgggggtaaacccgtaaaggggttaacgggaaaaacttacccggtaaaaaacggtaccgttgggttacggacttacggaacccttaacgtttaaccg

SEQ ID NO: 379006 - DNA, 610 bp, Homo sapiens
  misc_feature: GZ8MTXP01EPWYA.22.14.B03.1.454.CMB.2.raw
  modified_base (309)..(309): a, c, t, g, unknown or other
  modified_base (444)..(444): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggagggccaccatcaactgacaagtccagccagtagttatttttacagtcctaccaaccaataagtagttacttagctggtcagcaagaaaccaggacatcgtcctgctactcnctactatttacgtcgggtacgttaccgtacccgggtacgtcccggggtccctggaccccgtacgttacgaggtcggccgtaagggtcgggtcgtagggactagtactttcactctacacatcagcacgcctagcnggactagaagtgtggtaggtcttaagttttattgttagtaccaagtactaatttattacttaccttacccttcctacgtaacggtaccggtttccggaacccgttaaaggaccgtaaggttaacgaacttacgtaaacgactgtcggacttcgaaccttaacgtcg

SEQ ID NO: 379007 - DNA, 571 bp, Homo sapiens
  misc_feature: GZ8MTXP01AMG43.22.14.B03.1.454.CMB.2.raw
  modified_base (442)..(442): a, c, t, g, unknown or other
  modified_base (460)..(460): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagttatttttacagtctccaccaataagtagttacttagctggttaccagcagaaaccaggacatcgtcctgcactgctctatttacgtgggcctaccgtacccggggaatcccgggggtccctggacccccgtatttcgaaggtcggcaagggccggggtcgtacggggacaggtactttcactctcacctatcagcagccctagcgagctagaagntgtggactatttaagttnttcgtacatataattattattacttcctccgtactaacggtacgttccggacgaaacgggacgtaaggttaaggaaacttacgaaacgtcgtgacgcttcgaaccaacgtc

SEQ ID NO: 379008 - DNA, 561 bp, Homo sapiens
  misc_feature: GZ8MTXP01AUHVF.22.14.B03.1.454.CMB.2.raw
  modified_base (238)..(238): a, c, t, g, unknown or other
  modified_base (416)..(416): a, c, t, g, unknown or other
  modified_base (431)..(431): a, c, t, g, unknown or other
  modified_base (451)..(451): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagtagttatttttanagctccaacaataagtagttacttagctggtccagcaagaaaccaggacatcgtctgcactgctactatttacgtgggccgttaccgtaccccgggaagtcccgggggtccctgaccccgtattcgagtcggcgaaggccgggtcgtgggacagtactttcgactctcacatcagcanctgacagctagaacngtgtggctagtttatatgtnagctaatattatcttccctctgaaggtccgttcggaccgaaagggtaccgaagggttacggaaacttacgaaaacggtactggtacggcttacgaaccgttaacctaacg

SEQ ID NO: 379009 - DNA, 598 bp, Homo sapiens
  misc_feature: GZ8MTXP01BRXHG.22.14.B03.1.454.CMB.2.raw
  modified_base (300)..(300): a, c, t, g, unknown or other
  modified_base (379)..(379): a, c, t, g, unknown or other
  modified_base (409)..(409): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgcaagtccagccagtagttatttttacagctaccaacaataagagttactagctggtccagcaagaaccaggacatcgtcctgcactnctcatttacgtgggtccgtaccgtacccgggaactccgggggtccctgacccccgtattcgaggtgcaagggcgggtcngggacagtatttcacttcacacctagcacnctagcgcgcgagacgagagagtagtagtacggttagtttagttagttagtactagtataattaattattacttaccttacctacgtaacgtacggttaccggtaccggaacggaacggtaacggttaacggttaaacgttaacgtaaacgtaacgtaacgtacggtacgttacgtaaccgaacgtaacg

SEQ ID NO: 379010 - DNA, 549 bp, Homo sapiens
  misc_feature: GZ8MTXP01BN4JU.22.14.B03.1.454.CMB.2.raw
  modified_base (386)..(386): a, c, t, g, unknown or other
  modified_base (464)..(464): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctccggtgcctacggggacattgtgatgacccagtctccagactccctggctgtgtctctgggcgagagggccaccatcaactgcaagtccagccagagttattttttacagctccaaccaataagagttacttagcttggtccagcagaaaccaggacatcgtcctgcactgctcatttacgtggccgttcgtacccgggatcccggggtccctgaccgtattcagtggcagcgggtctgggacagtacttcactcncacatcagcagcctgacaggctagaagatgtagcttaggtttattagtgtacagtactaattattatacttcctactnaaggtcgttcggacctaaaggggacctaaagggtggaaaacttcgaaaaacggtctgggtcgctaggacctaaccgttaattccg

SEQ ID NO: 379011 - DNA, 542 bp, Homo sapiens
  misc_feature: GZ8MTXP01BQN04.22.14.B03.1.454.CMB.2.raw
  modified_base (351)..(351): a, c, t, g, unknown or other
  modified_base (380)..(380): a, c, t, g, unknown or other
  modified_base (417)..(417): a, c, t, g, unknown or other
  modified_base (464)..(464): a, c, t, g, unknown or other
  modified_base (519)..(519): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttactagctggttccagcaagaaaccaggacatcgtcctgcactgctctatttacgtgggcgtcgtaccccgggaatcccggggtccctgaccccgnttcagtggcaaggcgggtctgggacagtntttcactctcaccatcagcagcctagcaggctagaantgtggctaggttttatatgtcagcaaattacttatacttccctcctnaagtcgttcggaccgaaaggggcctaaagggttcggaaaattccaaaacgtacgnggtacggcttcgaacaaccgtaa

SEQ ID NO: 379012 - DNA, 561 bp, Homo sapiens
  misc_feature: GZ8MTXP01A1QZ4.22.14.B03.1.454.CMB.2.raw
  modified_base (273)..(273): a, c, t, g, unknown or other
  modified_base (290)..(290): a, c, t, g, unknown or other
  modified_base (383)..(383): a, c, t, g, unknown or other
  modified_base (415)..(415): a, c, t, g, unknown or other
  modified_base (434)..(434): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagttatttttacagctccacaataagagttactagctgtcagcagaacngacatcgctgcatgctntattacgtgggcgtacgtacccggtaacgtccggggtcctgacccgtattcgagtggcaaggcgggtcgtgggacagtacttcactctcaccntcagcacgcctagccaggctagaacgtagtgnggtactagttttaagtttntagtacagattaattacttactaccttcctccgtgaacggttcggttacggaacggaaacgggtaaccgtaaagggttacgaaacgttacgtaaacgtcgtaacggtcgtcgttacgtcttaacgtg

SEQ ID NO: 379013 - DNA, 540 bp, Homo sapiens
  misc_feature: GZ8MTXP01A4TYV.22.14.B03.1.454.CMB.2.raw
  modified_base (310)..(310): a, c, t, g, unknown or other
  modified_base (418)..(418): a, c, t, g, unknown or other
tcagacatacgcgtcacgaccggtgctcgatttagtgtgagtagttccgcgggggagctacaacaggcagtcaggggcagcaagatggtgttgcagacccaggtcttcatttctctgttgctctggatctctggtgcctacggggacattgtgatgaccccagtctccagactccctggctgtgtctctggcgagagggccaccatcaactgcaagtccagccagagtatttttacagctccaccaataagagttacttagctggttccagcagaaaccaggacatcgtacctgcactgctcatttacgngggctctacccggatccggggtcctgaccccgattcgagtcggacacgggcgggtctggggaccaggatttcactctcacatcagcagccctgccaggcctagaaagntgtgacgtagtttacttatgtcagtcaattatatacttcctcctcgaagtaccgttggaccgttaagggaccctaagggttcgaaaacttacgaaacgactggtacggcttacgcaacgtcg

SEQ ID NO: 379014 - DNA, 611 bp, Homo sapiens
  misc_feature: GZ8MTXP01BYNVZ.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagttatttttacagctccacaataagagttactagctggttccagcaagaaaccaggacatcgtcctgcactgctctatttacgtgggccgtccgtacccgggaatcccgggggtccctgacccccgtattcgagtggcaacggcgggtcgtgggactagtacttcactctcacatcagcacgcctgcgaggctagaagtagtggtacggacgttagttttagttattgtaccagtacctaaatttaatttacttaactttccctccgtcgtaacggttacccgttcgggaaacccggttaaagggaaccccgtaaaaggggttaacggaaacttaaccgtaaaacggtaaccgtgggtacggaccgttgaacccttaacgttaacg

SEQ ID NO: 379015 - DNA, 583 bp, Homo sapiens
  misc_feature: GZ8MTXP01AC88X.22.14.B03.1.454.CMB.2.raw
  modified_base (309)..(309): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgcaagtccagccagagttatttttacagctccaccaataagtattacttagctggtccagcagaaaccaggacatcgcctgcactgctcatttacgngggctccgtacccgggaactcccggggtcctagacccccgtattcgagtggcaaggcgggtcgtggggacctagtactttcgactctacaccatccagcagcctagcaggctagaagtagtggtggacttagtttattagttcgtacagtactaaattattaatacttccctaccgtctaacggtaccggttcggaaccgaaaggggtaacctaagggttacggaaaacttaccgaaaccgtatcggaacgggcttacggaacaacccgttaag

SEQ ID NO: 379016 - DNA, 582 bp, Homo sapiens
  misc_feature: GZ8MTXP01DOK5H.22.14.B03.1.454.CMB.2.raw
  modified_base (283)..(283): a, c, t, g, unknown or other
  modified_base (311)..(311): a, c, t, g, unknown or other
  modified_base (402)..(402): a, c, t, g, unknown or other
  modified_base (412)..(412): a, c, t, g, unknown or other
  modified_base (447)..(447): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgcaagtccagccagagttatttttacagctaccacaataagagttacttagctggtccagacaagaaaccnggacatcgtcctgcatgctcatttacgngggcgtacgtaccggaactccggggtccctacgaccccgtattcgagtcggcaagggcggtcgtagggacagtatttcactctacactacncacgcacgcngcgacgtacagagtagtgtagtagttagtttattntcgacatactaattacttacttacttcctcctacgtaacggtaccggttaccggaacgaaacgggtaacgtaaaggttacgaaacttaaccgaaacggtacgtcggtacgtacgttacgtaaccttaacgtaacg

SEQ ID NO: 379017 - DNA, 604 bp, Homo sapiens
  misc_feature: GZ8MTXP01BKLO0.22.14.B03.1.454.CMB.2.raw
  modified_base (456)..(456): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggagggccaccatcaactgcaagtccagccagtagttatttttacagctacccaaccaataagagttactagtctggtcagcaagaaaccaggacatcgtcctgcactgctctatttacgtcgggcgtccgtacccggggtactcccgggggtccctcggtaccccgtattcgaggtcggaccgaagggtccggggtcgtggggactaggtactttccgactctaccaccctatcagcacgccctagcaggtctaggaagngtgtggtacttaggttttattatggtacagtactaattactttactacttccctctacgtaacgtaacgttcgggaacccttaaaggggtaacctaagggttacgaaacttacgaaaacgtcgtgtacggcttacggcttaacctaag

SEQ ID NO: 379018 - DNA, 545 bp, Homo sapiens
  misc_feature: GZ8MTXP01BU4V5.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagtagttatttttacagctccaccaataagagttacttagctggtccagcaagaaaccaggacatcgtcctgcactgctctatttacgtgggccgtccgtacccgggaacgtcccggggtccctgaccccgattcgaggtcgcgaaggcgggtcgtgggacagtatttcactctcaccatcagcagcctagcaggctagagatgtgacgttagttttattattgtcaagtctaaattattatacttcctctgaagtcgttcggaccgaaagggaccaagggttagaaacttacgaaacgtacgtgcgccttagccttaactg

SEQ ID NO: 379019 - DNA, 588 bp, Homo sapiens
  misc_feature: GZ8MTXP01ADXXI.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccacatcaactgcaagtccagccagagttatttttacagctaccaccaataagagttactagctggtccagcagaaaccaggacatcgtcctgcactgactaatttacgtgggcctaccgtacccggggactcccgggggtccctagaccgattcgagtcggcaggcgggtctgggacagtatttcactcacacatcagcacgcctgacaggctagaagatcgagctagggtttattacgttgaccgaagtactaaattacttaacttaacttcccctacttacgaagtaaccgggtttcggaaccgaaacggggaaccgtaaagggtacggaaacttacgaaaaccgtaagtggtaacgggacttacggacctaacgttaacgttccg

SEQ ID NO: 379020 - DNA, 749 bp, Homo sapiens
  misc_feature: GZ8MTXP01CCJY7.22.14.B03.1.454.CMB.2.raw
  modified_base (321)..(321): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtggcgagagggccaccatcaactgacaagtccagccagtagttatttttacagtcctacccaaccaataagtagttactagctggtcagcaacgaaaccaggacatccgtcctgcactcgctctactttacgngggtccgtaccgtacccgggtaacgttccccgggggtccctcggacccccgtattcgaggtcggcgtaacgggtcccggggttcgtacggggaacctaggttactttccaccgttcctacccaacccgtatccccgaagcccaccggtcccgtacgggaccgtaaggggtccttaaagggaagtacggttgggttcgggttaacgtttaacggttttttaagtttaactttcgggtaacctaaggtaacttaaatttaacgtttaacttacctttcccccttaaccgttacggtaacggttaaacccggtttcccggggaaacccggttaaacgggggtaaacccgtaaaggggttaaacgggttaaaacttaccggaaaaacggtaccgttgggtacgggtaccttacggaacccttaaccttaacg

SEQ ID NO: 379021 - DNA, 664 bp, Homo sapiens
  misc_feature: GZ8MTXP01C75C0.22.14.B03.1.454.CMB.2.raw
  modified_base (438)..(438): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagtagttatttttacagctaccaaccaataagtagttacttagtctcggttcagacaacgaaacgaacggacataccgtcctcgcactcgtctctacgttacgttcgggtcggtccgtacccgggtaaccgtcccggggtcccgtcggacccgtacttcgagtcggcgaacggcgggtcggtacgggacgacgtacttacgtactctcaccctancgacgcacgtccgtgccgaaggcgtagaagtattggtcggtacttaaggttttattaagttcgtacagactaatttaacttacttacgttcctcccttagaaccggttaacggttcccgggaccgaaaacgggggttaaacccgaaaggggttaaccgaaaagttaaacccgtaaaacgggtaaacgttgggacgggtaccccttagtaaccccgaacccgttaag

SEQ ID NO: 379022 - DNA, 547 bp, Homo sapiens
  misc_feature: GZ8MTXP01EF6WA.22.14.B03.1.454.CMB.2.raw
  modified_base (262)..(262): a, c, t, g, unknown or other
  modified_base (300)..(300): a, c, t, g, unknown or other
  modified_base (307)..(307): a, c, t, g, unknown or other
  modified_base (341)..(341): a, c, t, g, unknown or other
  modified_base (408)..(408): a, c, t, g, unknown or other
  modified_base (425)..(425): a, c, t, g, unknown or other
  modified_base (540)..(540): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaaccaataagagttactanctggtccagcagaaaccaggacatcgtctgcactgctnatttacngggcgtctaccggaatccggggtcctgaccccgnttcagtgcaagcgggtctgggacagtatttcactctacaccatcagcagccctgcaggtcagaaagntgtggcttaagtttatnttgtacagtataattatttatactttcccgtaccttcaagtaccggtttcggacccttaaaggggaccctaaagggttgaaacttacgaaaaccgaagtgtaggccttagaaccnccttaag

SEQ ID NO: 379023 - DNA, 647 bp, Homo sapiens
  misc_feature: GZ8MTXP01ETDS2.22.14.B03.1.454.CMB.2.raw
  modified_base (451)..(451): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagtagttatttttacagtctaccaaccaataagagttacttagctggtccagcaagaaaccaggacatcgtacctgcactgctactatttacgtgggtccgttaccgtacccggggtaacgtcccggggtccctacggaccccgtattacgagtggcaacgggcgggtcgtgggacagtatttcgactctaccactatcgagcacgcctcgcgtagggctaggaaagngttggtacggtacgtttaaggttttattaagttcggtactaagtacttaaattatttaacttcctttaccctaccttcgaacggttaaccggtttccgggaaccgttaaaggggaacccgtaaaggggttaacgaaacttacccggaaaaacgtcgttaacggtcgggtacttacgtaacccgttaaccgttaacg

SEQ ID NO: 379024 - DNA, 650 bp, Homo sapiens
  misc_feature: GZ8MTXP01CFGD0.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagacctcctggctgtgtctcgtggcgagacgggccaaccatcaaactgacaagtccagccagtagttatttttacagctaccaacaataagagttactagctggtccagcaagaaacaggacatcgtcctgcactgctactatttacggtcgggccgtaccggtaaccccggggtaacgtcccggggtccctagacccccgtattcgaggtgcgaagggcgggtctaggggacagtactttcaccttcacaccatcacggcaacgtccgagacgaggcgtaagaagtgtacggtaggttacgttaagttttaattagttacgagtaagtaactaaattaacttaacttaccttaccttccgtacgtaacggtaaccggttaccggtaaccggaaaccgggtaaacggtaaacggttaaacggttaaacgttaaacgtaaacgtaacgtaacgtacgtacgttacgtaaccgttaaccgtaacg

SEQ ID NO: 379025 - DNA, 561 bp, Homo sapiens
  misc_feature: GZ8MTXP01DQTY7.22.14.B03.1.454.CMB.2.raw
  modified_base (427)..(427): a, c, t, g, unknown or other
  modified_base (434)..(434): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagaggccaccatcaactgcaagtccagccagagtatttttacagctccaccaataagagttacttagctggttccagcaagaaaccaggacatcgtcctgcactgctctatttacgtgggtccgtccgtaccccgggaacgtccccggggtccctcggaccccgattcgaggtggcgaaggcgggtcgtgggacagtatttcactctcacatcagcagcctgcaggctagaaagntgtcggntagtttatattgtacagtctaattattatacttcctcctcgaacgtacgtttcggacccaaaggggaaccctaaggttacggaaacttacgaaaaccgtaacgttggtggcttaggccaaccgttaa

SEQ ID NO: 379026 - DNA, 759 bp, Homo sapiens
  misc_feature: GZ8MTXP01BEYKY.22.14.B03.1.454.CMB.2.raw
  modified_base (309)..(309): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagttatttttacagctccacaataagagttactagctggtcagacaagaaaccaggacatcgtcctgcactgctactatttacgngggtcgtaccgtacccgggtaacgtcccgggggtccctcggaaccccgtattcgaggtggccgtaaagggccggggttcgtcggggaactaagggtactttaccgaacttccttaccgaaaccctagttccaaggccgtaaacgtcccgttacggaccgtaacgggtaccttagggaaaacggtgtttaacgggttcggggttaaccttaaggtttttttaaccgtttaagtttcggtaacccggtaagtaacccttaaagttttaacgttttaactttaacccgttttccccttaccgtaaccggttaaacgggttaaccccggttttccgggggaaaccccgttaaaacggggggtaaaccccgtaaaagggggttacgggttaaaaacttaccggtaaaaacggtccgttaagggttcgggacttacggaaccttaacccggttaag

SEQ ID NO: 379027 - DNA, 639 bp, Homo sapiens
  misc_feature: GZ8MTXP01CXSR8.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggacgggccaccatcaactgacaagtccagccagtagttatttttacagtctaccaaccaaataagtagttacttagctggttccagcaagaaaccaagacatcgtcctgcactgctctatttacgtcgggtcgtaccgtacccggggaacgttccccgggggtccctcggacccccgtacttacgaggttcggccgaacgggtcggggtcgtaggggaactaggtactttccacttctccaacctatacacgcaacgcctaggaccaggcctaggaagatggtcggtagttaggtttttatactttcggactaacgtctaaagtttattacttacttccctactcgtaacggtacgttccggaccgttaaacgggacccgtaaaggttacggaaaattaccgaaaacgttacgtggtcgggtacttggtaacccaacgttaac

SEQ ID NO: 379028 - DNA, 652 bp, Homo sapiens
  misc_feature: GZ8MTXP01B74AJ.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgacaagtccagccagtagttatttttacagtcctaccaaccaataagtagttacttagtcttggttccagacaagaaaccaggactatccgtcctgctactcgcttactagtttacgtcgggtccgttaccgtacccggggtaacgtcccggggtcctacgtaccccgtacttcgaggtcggacgaacgggtcgggtcgtagggaactagtactttccgacttcaccacataccgagccagccctgaccgtagggctaggaaagtgttagggtcggtacttaggtttttattacgtgtacgagtacttaaatttactttactacctttccctccgtagtaacgggttaccgttccgggaaaccgaaaggggtaccctaaaggggttacgttaaacttaccgaaaacggtacttgggtacggccttagtaaccaacgtaac

SEQ ID NO: 379029 - DNA, 581 bp, Homo sapiens
  misc_feature: GZ8MTXP01DKVYH.22.14.B03.1.454.CMB.2.raw
  modified_base (438)..(438): a, c, t, g, unknown or other
  modified_base (481)..(481): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggagggccaccatcaactgacaagtccagccagtagttatttttacagctaccaacaaataagtagttactagtctggtaccagcaagaaaccaggacatcgtcctgcactcgctactatttacgtcgggtcgtaccgtacccgggacgtcccgggtccctcgaccccgtattcaggtcggcgaacggcgggtcgtgggactagtacttcactctacaccatcagcagcctgcagctagaatntggtagacgttattttagttatgacagtacttaattacgtttntacttccctctgaacgttcggttaccggacgttaaacgggaacctaaggggttaacaaacttacgaaaactagtcggtacggcttaacgtcaaccttaag

SEQ ID NO: 379030 - DNA, 583 bp, Homo sapiens
  misc_feature: GZ8MTXP01CXG6Q.22.14.B03.1.454.CMB.2.raw
  modified_base (431)..(431): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagttatttttacagctccaacaataagagttactagctggtccagcaagaaaccaggaacatcgtcctgcactgctctatttacgtgggtcgtccgtacccgggaacgtcccgggggtcctcggaccccgtagttcaggtcggcgaaggccgggtcgtgggacaggtacttcactctcaccatcagcagccctgccaggctagaagngtcgtggacttaggttttattagttcgacaagtactaaattattatacttccctctacgaagtaccggttcgggaccttaaagggtaacccgtaagggttacgaaaattaccgaaaaacggtattggtacggcttacggccaacccgttaag

SEQ ID NO: 379031 - DNA, 569 bp, Homo sapiens
  misc_feature: GZ8MTXP01CVH76.22.14.B03.1.454.CMB.2.raw
  modified_base (434)..(434): a, c, t, g, unknown or other
  modified_base (450)..(450): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttacttagctggtcagacaagaaaccaggacatcgtcctgcactgctctatttacgtgggtccgtccgtacccgggaacgtcccgggggtccctcggaccccgtattcgaggtggccgaagggtcgggtcgtggggacaggtattcactctcaccatcagcacgcctgcaggctagaagntgtgactagtttattntgacagactaattacttatacttccctctcgaacggttcgttccgggaccgaaagggtaacccgaagggttacggaaaacttacgaaaacgactgggtcggcttagcccaacgttaacg

SEQ ID NO: 379032 - DNA, 615 bp, Homo sapiens
  misc_feature: GZ8MTXP01CSGYQ.22.14.B03.1.454.CMB.2.raw
tcagacatacgcgtcacgaccggtgctcgatttagtgtgagtagttccgcggggggagctacaacaggcaggcaggggcagcaagatggtgttgcagacccaggtcttcatttctctgttgctctggatctctggtgcctacggggacattgtgatgacccagtctcagactccctggctgtgtctcgtgggcgagagggccacatcaactgcaagtccagccagtagttatttttacagctaccaacaataagtagttactagtctgtcagcaagaaaccaggacatcgtctgcactgctctatttacgtagggtcgtaccgtaccgggacgtcccggggtcctacggacccccgtattcgagtcggacgaagggtcgggtcgtagggacaggtactttcgactctaccacctatcgaacgcacggtccctaggaccgtagggactaggaaagtgttgtagggtactttaaggttttatagttcgtacaagtaactaatttaattataccttcctacctggaacgttaccggttcggaaaccgttaagggtaaaccgtaaggttaacggaaaattaccaaaacggtatggtacggcttacggtaacaacccttg

SEQ ID NO: 379033 - DNA, 774 bp, Homo sapiens
  misc_feature: GZ8MTXP01DFEWT.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtggcgagagggccaccatcaactgacaagtccagccagtagttatttttacagtctacccaaccaaataagtagttaacttagtctcggttaccagacaaacgaaaccgaggaccatccgtcctgaccactcgcttactatttacgtcgggtccgtaccgtacccggggaacgttccccggggtccctacggacccccgtattcgaggtcggccgaacgggtcgggtcgtgggggtaacctaggttactttaccaccgttacctacccaaccctaagttacccaagccgtaacggtccccgttaggccccgtaaggggtacctaagggaaaagtggttcgggtacggggttaactttaaagggttttttatttaaagttttaccggaataaacgtaactttaaaagtttaaacttttaactttaacctttcccctccgttaaacgtaacgggttaacccgggtttacccgggaaaccccggttaaaacggggtaaaccctaaaagggggttaacggttaaaaacttacccggtaaaaaacccggtaagttcggtaacgggcttacgggaacccttaaccggtaacg

SEQ ID NO: 379034 - DNA, 687 bp, Homo sapiens
  misc_feature: GZ8MTXP01DYAD7.22.14.B03.1.454.CMB.2.raw
  modified_base (307)..(307): a, c, t, g, unknown or other
  modified_base (317)..(317): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccacatcaactgcaagtccagccagtagttatttttacagtctaccaaccaataagtagttacttagtctgtacagacaaagaaccagacatcgtctgcatcgactntactttacgngggtcgtccgtacccgggaacgtcccggggtccctacggtaccccgtagttacgaggtcggcgaacgggcgggtcgaggggactagtacgtttcacctctacacatccgagctacgccgtagcgaggctagaaacgtgtcgtacggtattaagttttagttaacgttcggtaactagtaaccttaagtttaaactttccttaactttcccgtaacccctggtaaaccgggttaccccggtttaccggggaaacccgttaaaggggtaaaccccgggtaaaggggttaaacggaaaaaccgttaacccggtaaaaaccgggtaaccgttgggttaacggccgtttaccggaacccgttaaaccctttccgg

SEQ ID NO: 379035 - DNA, 729 bp, Homo sapiens
  misc_feature: GZ8MTXP01DMBXS.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggagggccaccatacaactgacaagtccagaccagtagttatttttacagtcctaccaaccaataagtagttactagtctggtccagacaagaaaccaggacatccgtacctgacactcgactactatttacgtcgggtccgtaccgtaacccgggggaacgttccccgggggtaccctacggaacccccgtacgttacgagggtcggacgtaacgggccggggttcggtacggggaccgtaaggtactttaccaccttctcccaacctactacgacgactacgcccgtgaccgagggtctaaggtaaagtggtcggttacggtacgtttaaggtttttaattagttcggttaccaagtacttaaatttaactttacttaccttaccccgttacccttacggtaaaccggttacggtttaccccgggaaaccggttaaacggggtaaacccgtaaaggggttaaacggttaaaacttaacccgtaaaaacggtaacgttgggtaccggtacttaccggaaccttaacccgttaa

SEQ ID NO: 379036 - DNA, 642 bp, Homo sapiens
  misc_feature: GZ8MTXP01B9X5O.22.14.B03.1.454.CMB.2.raw
  modified_base (405)..(405): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgacaagtccagccagtagttatttttacagtcctaccaaccaataagtagttacttagtctggtccagacaacgaaacagacatcgtcctgcactcgtctctatttacgtcgggtccgtaccggtacccgggtaacgtcccgggggtccctacggacccccgtacttcgaggtcggcgaacgggtcgggtcgngggactagtacttcacctctacacctatacagcacgcctagaccgagggactaggaagtagttggtacggtattaagtttttagtagttcgtaccaagtacttaaatttattacttactttccctctcgaacggttacggttccgggaacgttaaacgggaaaccgtaaggttaacggaaacttaccggtaaaaacgtcgttaagggtcggaccttacggaacccgttaaccttaag

SEQ ID NO: 379037 - DNA, 585 bp, Homo sapiens
  misc_feature: GZ8MTXP01A3QFA.22.14.B03.1.454.CMB.2.raw
  modified_base (442)..(442): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgacaagtccagccagtagttatttttacagctaccacaataatagttactagtctgtcagcaagaaccaggacatcgtctgcactgctctatttacgtcgggtccgtaccgtaccccgggtaacgtcccggggtccctcggtaaccccgtacttcgaggtggcgaagggccgggtcgtgggacagtactttcactctacaccctatcagcacgcctagcagctagaagtntgtggtacttaaggtttattagttgtacagtacttaattatttactacttcctcctcgaacgtcgttcgggaccaaagggtaaccgtaagggttagaaacttaccgaaagtacgtcggtggccttagaaccgttaaccttaag

SEQ ID NO: 379038 - DNA, 664 bp, Homo sapiens
  misc_feature: GZ8MTXP01CTJUH.22.14.B03.1.454.CMB.2.raw
tcagacatacgcgtcacgaccggtgctcgatttagtgtgagtagttccgcggggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggagggccaccatcaactgcaagtccagccagtagttatttttacagtcctacccaaccaaataagtagttacttagtctggttcagacaagaaaccaggacatcgtcctgccactcgcttactatttacgtcgggccgtaccgtacccgggaacgtcccggggtccctcggacccccgtattacgaggtcggcgaacgggtcgggtcgtgggacagtattcactctcaccatcacgtcacgccctgaccgtagggcttagaaagtgtagggtcggtactttaaggttttattaagtcggtacaacgtacttaaattaacttacttaaccttccctaccgtctaacgggtacccgtttaccgggaaacccgaaacgggggtaaacccgtaaagggttaacggaaaacttaaacccggaaaacgtaaaccgttgggttaccgggacttacggaaccgttaacccttaag

SEQ ID NO: 379039 - DNA, 631 bp, Homo sapiens
  misc_feature: GZ8MTXP01BC5NK.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgacaagtccagccagtagttatttttacagctacccaaccaataagtagttacttagctggttccagcaagaaaccaggacatccgtcctgctactgctactatttacgtgggccgtccgtacccgggtaacgtcccgggggtccctacggacccccgtattcgaggtcggacgaagggccgggtcgtggggaacaggtactttcacttctacaccatcagctacgctacgcaggtctaggaagtatgggtacggtattaagttttattagttgtacaagtactaatttaattacttacttaccctccgtactaacggtaccgttaccgggaaccgttaaacggggacccgtaaaggggttacgttaaaacgttacgaaaaccgtacgtggtacgggacttaggaacccttaacgtaacc

SEQ ID NO: 379040 - DNA, 612 bp, Homo sapiens
  misc_feature: GZ8MTXP01A54K6.22.14.B03.1.454.CMB.2.raw
  modified_base (445)..(445): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagttatttttacagctaccaaccaataagagttacttagctggttccagcaagaaaccaggacatcgtcctgcactgctctatttacgcgggcgtccgtacccgggaacgttcccggggtccctcggaccccgtattcgaggtggccgaaggccggggtctggggactagtatttccactctcacctatcacgctacgccctaggcaggtactaggaaagngtgtgggacttaaggttttattattacggtacagtctaaattactttactactttccctctcgaacggtaccgtttaccgggaacccgaaaggggtaacccgtaaaggggttacggaaaacttaccgaaaacggtacctggtacggacttgaaccttaaccgtaacg

SEQ ID NO: 379041 - DNA, 620 bp, Homo sapiens
  misc_feature: GZ8MTXP01C95P5.22.14.B03.1.454.CMB.2.raw
  modified_base (437)..(437): a, c, t, g, unknown or other
  modified_base (612)..(612): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgacaagtccagccagagttatttttacagctaccaaccaataagtagttactagtctggtcagcaaagaaccaggacatccgtacctgctacgtcgctactacgtttacgtcgggtaccgtccggtaacccgggtaacgttcccggggtcctacggaccccgtacgttcgaggtcggacgaacgggtcgggtcgtaggggactagtactttcacgtctacactancagcagtcctgccgaggtctaggaagtagtggtacgtacgttaagtttattaagttcgactagtactaaattacttataccttcctctcgtaacggtccgttaccggaccgaaaggtaacccgtaagggttaaacgaaacttacgtaaaacggacttgggacgcttacggaaccnccgttaag

SEQ ID NO: 379042 - DNA, 654 bp, Homo sapiens
  misc_feature: GZ8MTXP01CZAAA.22.14.B03.1.454.CMB.2.raw
  modified_base (468)..(468): a, c, t, g, unknown or other
  modified_base (517)..(517): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagacgggccaccatcaactgacaagtccagccagtagttatttttacagtctaccaacaaataagtagttacttagctggtacagacaagaaaccaggacatccgtcctgacctactgtctactatttacgtcgggtcgtaccgtacccgggaacgtcccggggtccctacggtaccccgtattcgaggtcgcgaacgggcgggttcgtaggggactagtacttccgactctaccaccctatccagcgacgtccctagccgagtcgaggaaagngtggtaggactttaaggttttatttaagtgtaccaagtacttaaatttnttaaacttcttcccctcttaccgaaaggttccccgggtttacgggaacccgttaaacgggggtaaacctaaggggttaaaggttaaaaccttacccgaaaagggttactgggttacgggcttacgtcccaaccttgg

SEQ ID NO: 379043 - DNA, 793 bp, Homo sapiens
  misc_feature: GZ8MTXP01AKX4E.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatcgacccagtctccagacctccctggctgtgtctcgtggcgaggacggccaccatacaactgacaacgtccagccagtagttatttttacacgtctaccaacaataagtagttactagtctgtacagcaacgaacgagactacgtccgtcctgctactcgtctactatttacggcgggtccgttacccggtaacccgggtaaccggttcccggggtaccctacggtaccccgtacgtacgaggtcggacgtaacgggtccgggttcgtaggggtaaccgtagttacctttaccgaccttcctacccaaccgtataccggaagtcccgacgtccgtacggacgtacgggtactaacgggtaaacgtcggttagggtaccgttacgtttaaaggttttttacgttacgttacgtaaaccgtaagttaaacctttaaattttaactttaccttaacccgtttccccttaccgtaccgggttaaacggttaccccgggtttaaccgggggaaaacccgttaaaaccgggggtaaacccttaaaaaggggggttaaaccgttaaaacccgttaaacccgggtaaaacgggttaccgttcggggttaacccggctttaccggaacccgttaacttttaacccgg

SEQ ID NO: 379044 - DNA, 643 bp, Homo sapiens
  misc_feature: GZ8MTXP01CNA56.22.14.B03.1.454.CMB.2.raw
  modified_base (318)..(318): a, c, t, g, unknown or other
  modified_base (484)..(484): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctcagactccctggctgtgtctcgtgggcgaggagggccaccatacaactgacaagtccagccagtagttatttttacagtctaccacaataagtagttactagctggtacagacaagaaaccaggacatcgtcctgcactgctactatttacgngggtcgtaccgtacccgggaacgtccggggtcctgaccccgtattcgaggtcggcgtaacgggcgggtcgtgggaactaggttactttacactctaccacctatcaagcacgcgtagacgaggctagaaatcgtggtacggattagtttattagtacgtacaagtntaatttaacttacttctttaccctccgtaacgtaacgggttaccggttcgggaaaccgttaaaggggtaaaccctaagggggttaacgaaaacttaaccggaaaaacccgggtagtttcggggaacggttccgttaacgaacccgttaacccttaacgg

SEQ ID NO: 379045 - DNA, 735 bp, Homo sapiens
  misc_feature: GZ8MTXP01DWKWX.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggacgggccaccatcaactgacaagtccagccagtagttatttttacagctaccaacaataagtagttacttagctggtcagacaagaaaccaggacatcgtcctgcactgctactatttacgtgggtaccgtaccgtaccccgggaacgtcccgggggtccctacggtaaccccgtattacgaaggtcggaccgtaaagggttcgggtccgtaggggaaccgtagttacgttttaccaccttacctacccaaaccctagttacccaacgggacctaacgggcccttacggacgtaacgggaccttaagggaaaacgtgttacgggtacgggtacctttaaaggtttttatttaaaccgttggtacctaaaggttcctaaaatttaagtttaacttaaccttttcccctaccgtttaccgaaacgggtttaacccggttccggggaaaccgaaaacggggtaacccgtaaaggggttaaacggaaacttaaccggaaaaacgtcgttaagggacggtcttacggtaaccgaaccttaacg

SEQ ID NO: 379046 - DNA, 618 bp, Homo sapiens
  misc_feature: GZ8MTXP01A7N4T.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtggcgaggagggccaccatcaactgcaagtccagccagtagttatttttacagcctaccaaccaataagagttacttagtctggtccagacaacgaaaccaggacatccgtcctgcactgcctctacgtttacgtcgggtcgtaccgtacccgggaacgttcccggggtccctcggaccccgtattcgaggtcggcgaagggcgggtcgtagggactagtactttaccactctacaccatcaagcacgcctcgacaggctagaagtagtggtcggagttagttttatagttagtacgatacaatttacttaattaccgttcctcctacgtaacgtaccggttccgggaccgttaaacgggtacccgaaaaggggttacgaaaacacgtaaaaaccggtctaagggtacgcgttacgaaccttaacgtaac

SEQ ID NO: 379047 - DNA, 574 bp, Homo sapiens
  misc_feature: GZ8MTXP01EYIAQ.22.14.B03.1.454.CMB.2.raw
  modified_base (400)..(400): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggagggccaccatcaactgcaagtccagccagagttatttttacagctaccaaccaataagagttactagctggtccagcaagaaaccaggacatcgtcctgcactgctctatttacgtgggtcgtccgtacccgggaatcccgggggtcctgaccccgtattcaggtggcaaggcgggtcgtgggacagtctttcactctcacntcagcagctgactaggctagagatgtggctagttttatatcgacagactaattattacttacttccctcctcgtaacgttaccggttaccggaacccgttaaagggtaacccgtaagggttaacgaaacttaccgaaaacgtacttggtacggcttagaacccttaaccgtaag

SEQ ID NO: 379048 - DNA, 543 bp, Homo sapiens
  misc_feature: GZ8MTXP01DP3LQ.22.14.B03.1.454.CMB.2.raw
  modified_base (299)..(299): a, c, t, g, unknown or other
  modified_base (373)..(373): a, c, t, g, unknown or other
  modified_base (383)..(383): a, c, t, g, unknown or other
  modified_base (451)..(451): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttattttttacagctccaccaataagagttactagctgtcagcagaaaccaggacatcgtcctgcactgctntatttacgtgggcgtccgtacccgggaactcccggggtccctcgaccccgtattcaggtgcgaaggcgggtcgngggacaggtntttcactctacaccatcagcagccctgcaggctagaagatggtaggcttagtttattagttgcaagtntaaattattatctttccctctcgaagtcgttcggacaaaggggacctaagggttagaaacttacgaaacgatgtacggcttagccaactaac

SEQ ID NO: 379049 - DNA, 661 bp, Homo sapiens
  misc_feature: GZ8MTXP01BWZ7O.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgaggagggccaccatcaactgcaagtccagccagagttatttttacagctaccacaataagagttactagctggtcagcaagaacaggacatcgtcctgcactgctactatttacgtgggccgtccgtaaccccgggaacgttccccgggggtaccctcggtaacccccgtacttacgaggttcgggcgtaacgggtccggggtcgtagggggaaccctaggtacttttaccgaccttactaccacccgtaatccaaggccaaacggtcccgttacggaccgtagggtcctaggaaagtgtaggtcggtacttaggttttattagtcgtacgtatactaaattactttatacttcctcctaacgtaacggtacgtttaccgggacccgaaaggggtaaccctaagggttacggttaaacttaccgtaaaacggtaacgttcggtacggacttggaacccaaccttaacg

SEQ ID NO: 379050 - DNA, 564 bp, Homo sapiens
  misc_feature: GZ8MTXP01ER5O2.22.14.B03.1.454.CMB.2.raw
  modified_base (416)..(416): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagtatttttacagctccaccaataagagttactagctggtccagcaagaaaccaggacatcgtcctgcactgctcatttactgggctccgtacccgggaatcccggggtccctgaccccgattcagtggcaaggcgggtctgcgacagtatttcactctacaccatcagcagccctgccaggctgaagatgngggcttagtttattattgtcagtactaaattattatacttccctctaacacgttacgttccggaccgaaaggggtacccaaaggggttcggaaaacttaaccgaaaaacggtaaccgttggtacgggacttaacggaaccgtaacccg

SEQ ID NO: 379051 - DNA, 563 bp, Homo sapiens
  misc_feature: GZ8MTXP01A67Y0.22.14.B03.1.454.CMB.2.raw
  modified_base (462)..(462): a, c, t, g, unknown or other
  modified_base (486)..(486): a, c, t, g, unknown or other
  modified_base (541)..(541): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagaggccaccatcaactgcaagtccagccagtagttatttttacagctaccaacaataagagttactagctggtccagcaagaaaccaggacatcgtcctgcactgctactatttacgtgggccgtaccgtacccgggaacgtcccggggtccctcgacccccgtattcgaggtggcgtaacggcgggtcgtaggggacagtactttcgactctacaccatcagcagccctagcaggcagaatagtgtaggcttaagttttatattganagtactaattattatactttcccnctcaagtaccgttcggacgaagggacctaaggttagaacttacaaacggtactgnggacttcggaaccaacgtaacg

SEQ ID NO: 379052 - DNA, 781 bp, Homo sapiens
  misc_feature: GZ8MTXP01DVN49.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgacaagtccagccagtagttatttttacagctaccaaccaaataagagttactagctggtccagcaagaaaccaggacatcgtacctgcactgctactattttacgtcggggtccgtaccgtaaccccgggaacgttccccgggggtccctacggaaccccccgtacgtttaccgaaggttcgggaccgtaacgggtccggggttcggtacgggggaacctaacgggttaacttttacccgaactttcctaccaaccctaagttaccaaacggcctaacggaccccgttggaccccgtaaggggcccttagggaaaagtagttgggttacgggtactttaaagggtttttaatttaacgtttggtacctaaggtaaccttaaagttttaaattttacttaaccttttccccgttaccttaccgtaaacgggtaccggttttacccggggaaacccgttaaaacgggggtaaacccgtaaaagggggttaaaccgggttaaaattaaacccggaaaaccgtaaaccgttcgggttaaggggccctttaggaaccccgttaacccgttaac

SEQ ID NO: 379053 - DNA, 680 bp, Homo sapiens
  misc_feature: GZ8MTXP01EXROQ.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgcaagtccagccagtagttatttttacagtctaccaaccaataagagttactagctggttccagcaagaaaccaggacatcgtacctgcactgctactatttacgtcgggtccgtaccgtacccgggtaacgtcccgggggtaccctcggaccccgtattcgaggtcggcgaacgggtcgggtcgtagggacagtactttaccgactcgtaccaaccatacgaacgccgacgtcccgttaggacccgtaggggtactaggaaagtagttgggtacgggtacttaaggttttttaattaagtttcgggttacaagtaccttaaatttaatttaacttaacctttcccctaccgtacgtaacggttacccggtttacgggaacccgttaaacggggaacctaaaggggttaacgaaacgttaccaaaaacgggttacgtggttccgggcttacggaaccttaacttaacg

SEQ ID NO: 379054 - DNA, 697 bp, Homo sapiens
  misc_feature: GZ8MTXP01CNAYX.22.14.B03.1.454.CMB.2.raw
  modified_base (689)..(689): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggacgggccaccatacaactgacaacgtccagccagtagttatttttacagtctaccacaatagtattactagtctgtcagacaacgaaccaggactactccgtcctgaccactcgcttactacgtttacgtcgggtccgtacccggtacccgggtaaccgttcccggggtccctacggtaccccgtacttacgaggtcggacgtaacgggtccggggttcgtacggggtaactacggttacctttaccacctttccacctacctaactccgaacgctaccgtacccgtggaccgtacggtccgttaaggaagtagttggggtacgttacgtttaaggttttagtttaagttcgaactacgtaactaattttacttaattcccttaccctactcgtaacggttcccggttaccgggaacgaaacggggtaacctaagggttaacggttaaacttaccgtaaaacggtacgttcgtagggccttacggtaacccnctttaacg

SEQ ID NO: 379055 - DNA, 562 bp, Homo sapiens
  misc_feature: GZ8MTXP01DP27O.22.14.B03.1.454.CMB.2.raw
  modified_base (445)..(445): a, c, t, g, unknown or other
  modified_base (495)..(495): a, c, t, g, unknown or other
  modified_base (541)..(541): a, c, t, g, unknown or other
  modified_base (551)..(551): a, c, t, g, unknown or other
  modified_base (562)..(562): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgacaagtccagccagagttatttttacagctccaaccaataagagttactagtctggtcagacaagaaaccaggacatcgtctgcactgctactatttacgtgggtcgtaccgtacccggggtaactcccgggggtccctagtaccccgtattcgaggtcggacgaacgggtcgggtcgtagggaaccagtactttacactctacacctatcagcagtcagcaggctagaaagntgtggacttaaggttttaattagttgacatataattattatacttcctcntaacgcgttcggacaaagggtaaccaaggttacgaaattaccaaanactgtcggcngaaccaacgtn

SEQ ID NO: 379056 - DNA, 650 bp, Homo sapiens
  misc_feature: GZ8MTXP01AH13I.22.14.B03.1.454.CMB.2.raw
  modified_base (242)..(242): a, c, t, g, unknown or other
  modified_base (322)..(322): a, c, t, g, unknown or other
  modified_base (642)..(642): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagactccctggctgtgtctcgtggcgaggacgggccaccatcaactgcaagtccagccagtagttatttttacngcctaccaaccaataagtagttactatcttggtccagacaagaaacccaggacatcgtcctgccactgctctatttacgngggtccgtaccggtacccgggtaacgtcccggggtccctcgacccccgtattacgaggtcggacgaacgggccgggtcgtacggggaaccagttactttcacttcgttacccacccattccgaaggccacggacccgttggaccgaggtaccgtaggaaacgtggtggtacggtacttaaggttttaattagttgtactaagtactaaatttagttaacttcttaccctaccgttacgaacggtacgttcccgggaacgaaacgggtaacctaaggggttacaaattaaccgaaacgtacgttcggcggacttggaaccnccgtaacg

SEQ ID NO: 379057 - DNA, 639 bp, Homo sapiens
  misc_feature: GZ8MTXP01C5FGW.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagtatttttacagctccaccaataagagttacttagctggttccagtcagaaaccaggacatcgtcctgcactgctcatttacgtgggcgtcgtacccgggaactccggggtcctcgaccccgtattcgagtggcaagggtcgggtcgtcgggactacggtactttcgaactctaccacctatccaggcagcccctagccaagggcctaggaagtagtggtacgggacttaaggtttttaaattagttggtacctaagtcctaaattaactttataactttcccctccgttacgtaacgggttaaccgtttccggggaacccaaagggggtaaaccccaaaggggttaccgggaaattaacccgtaaaaacggtaaaccgtgggttacgggaccttacgaaccgaacccttaacg

SEQ ID NO: 379058 - DNA, 588 bp, Homo sapiens
  misc_feature: GZ8MTXP01DSQOA.22.14.B03.1.454.CMB.2.raw
  modified_base (377)..(377): a, c, t, g, unknown or other
  modified_base (450)..(450): a, c, t, g, unknown or other
  modified_base (456)..(456): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttattttttacagctccaaccaataagagttactagctggttccagcaagaaaccaggacatcgtcctgcactgctcatttacgtgggcgtcgtacccgggaatcccggggtccctgacccccgtattcgagtggcgaacggcgggtcgngggacagtatttcactctcaccatcagcagccctagccaggctagaagatgtggacttagttttattattgtnaacgtnaaatttattacttacttccctacctctaaggtaccgttcgggacccgttaaaggggaaccctaagggttaggaaaacttaccgaaaacgtaaaccgtggttacgggacttacggaaccttaaccccgttaag

SEQ ID NO: 379059 - DNA, 606 bp, Homo sapiens
  misc_feature: GZ8MTXP01EF3WD.22.14.B03.1.454.CMB.2.raw
  modified_base (485)..(485): a, c, t, g, unknown or other
  modified_base (491)..(491): a, c, t, g, unknown or other
  modified_base (505)..(505): a, c, t, g, unknown or other
  modified_base (583)..(583): a, c, t, g, unknown or other
  modified_base (606)..(606): a, c, t, g, unknown or other
tcagacatacgcgtcacgaccggtgctcgatttagtgtgagtagttccgcggggggagctacaacaggcaggcaggggcagcaagatggtgttgcagacccaggtcttcatttctctgttgctctggatctctggtgccgtacggggacattgtgatgacccagtctccagactccctggctgtgtctcgtgggcgaggagggccaccatcaactgcaagtccagccagtagttatttttacagtctaccaacaataagtagttactagtctcggtcagacaagaaaccaggacatcgtctgcatcgctactatttaagtcgggtcgtaccgtacccgggtacgtcccggggtcctacggaccccgtacttcgaggtcggacgaagggcgggtcggtaggggaactacggtacttaccgactcgtaccacagtcacgctacggcctaggcaggctagaagagtcggtagtacttaaggtttttanacgttnacgatactaaattnttaactcttcctcacggtaacgtccggttacgggaccttaaaggggacctaaggttaacggaacttacgaaaacggtntggtacgcttacgccttaacgtn

SEQ ID NO: 379060 - DNA, 830 bp, Homo sapiens
  misc_feature: GZ8MTXP01CKQU6.22.14.B03.1.454.CMB.2.raw
  modified_base (273)..(273): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggagggccaccatcaactgcaagtccagccagtagttatttttacagtctaccaacaataagagttactagctgtcancaagaaccagacatcgtctgcactgctactatttacgtgggtcgtaccgtacccggaacgtcccggggtccctcggaacccccgtattacgagtcggaccgaagggtccggggtccgtaggggtaacctaaacgggttacttttaccaaccttcctaccctaacccaacttccaacggccaaacggtccccttaggacccgtaaaggggccttaagggaaacgtaagttcgggttaggggtaaccgttttaaagggttttttaaacttttaacggtttggttaaaccctaaagggttaaccttaaaacgttttaaattttaaactttaacccgttttaccccccgttaacccttttaaccgggaaaccggggtttaaaccccggttttaccccgggggaaaccccgaaaaaccggggggttaaaacccccggtaaaaagggggttttaaaaccggggaaaaaacctttaaaacccgggtaaaaaaacccgggttaacccgtttaacgggggttaaggggcccctttaagggtaaccccgttaaaaccccgtttaacg

SEQ ID NO: 379061 - DNA, 703 bp, Homo sapiens
  misc_feature: GZ8MTXP01DCL13.22.14.B03.1.454.CMB.2.raw
  modified_base (500)..(500): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggacgggccaccatccaactgacaagtccagccagtagttatttttacagtcctaccaaccaataagtagttactagtctggtcagcaagaaaccaggacatcgtcctgccactgctactagtttacgtcggggtcgtaccggttaaccccggggaacgttccccgggggtccctacggtaacccccgtattcgtaggtcggacgaacgggtccgggtcgtagggaacgtacggttacttaccgaccttcctacctacccagtaccaggctaacggccctaggaccaagggtcctaaggaaacgngttacgggtagggtactttaaggttttattacgtttgaccgtaagtaccttaaatttatttaacttcgtttacccctacccttacgtaacggttaaccggttaccgggaaccgttaaaacgggggtaacccgtaaaggggttaaacggaaacttaacggaaaacccggtattgggtacgtacgttacgaaccgaaccttaacg

SEQ ID NO: 379062 - DNA, 658 bp, Homo sapiens
  misc_feature: GZ8MTXP01CL2HX.22.14.B03.1.454.CMB.2.raw
tcagacatacgcgtcacgaccggtgctcgatttagtgtgagtagttccgcggggggagctacaacaggcaggcaggggcagcaagatggtgttgcagacccaggtcttcatttctctgttgctctggatctctggtgcctacggggacattgtgatgacccagtctccagacctccctggctgtgtctcgtgggcgaggacgggccaccatacaactgcaagtccagccagtagttatttttacagtcctaccaaccaataagtagttactagtctggtccagacaacgaaaccaggacatccgtcctgcactgctactagtttacgtcgggtacgtaccggtacccgggtaacgtcccggggtccctacggaccccgtattacgaggtcggaccgtaacgggtcgggtcgtagggtactaagtactttccgacttacctaccacctatacgacgcacggcctaggcgaggtctaggaagtagtcggtaggtacttaaggttttattatcggtactagacttaattacttacttacttccctaccgtgtaacggttacgttccgggtaaccgaaagggtaaacccgtaagggttaaacggaaacttaaccggaaaacgtacgtcggtacggtacttaccgtaaccgttaacttaaccg

SEQ ID NO: 379063 - DNA, 526 bp, Homo sapiens
  misc_feature: GZ8MTXP01EE7UK.22.14.B03.1.454.CMB.2.raw
  modified_base (303)..(303): a, c, t, g, unknown or other
  modified_base (312)..(312): a, c, t, g, unknown or other
  modified_base (347)..(347): a, c, t, g, unknown or other
  modified_base (391)..(391): a, c, t, g, unknown or other
  modified_base (411)..(411): a, c, t, g, unknown or other
  modified_base (458)..(458): a, c, t, g, unknown or other
  modified_base (502)..(502): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggagggccaccatcaactgcaagtccagccagagttatttttacagctaccaccaataagagttacttagctggtcagacaagaaccaggacatcgtctgcactgctntatttacgngggcgtccgtaccggactccgggtcctgaccccgntcagtgcgaacggcggtcgtggacagtctttcactctacactancagcacgctgcaggtcaganagtgtggcttagtttattattgtacagataattattatacttctctnaagtacgttcgacgttaaggacctaagggcgaaattaccgaaanacgtgtcggcttcgcgttcctaag

SEQ ID NO: 379064 - DNA, 809 bp, Homo sapiens
  misc_feature: GZ8MTXP01B7OSC.22.14.B03.1.454.CMB.2.raw
  modified_base (297)..(297): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtggcgagagggccaccatcaactgcaagtccagccagtagttatttttacagctaccaacaataagagttactagtctggtccagacaagaaaccaggactatcgtccngcactgctactatttacgtgggccttccgtacccgggtaacgtcccggggtccctcggaacccccgtagttcgaggtcggacgtaacgggtccgggtcgtacggggaactacggttactttcccaccttactacccaaccctagtaccgaacggccctaacggtccccgttagggacccgtaagggggtaccttaaggggaaaaacgtcggtttaggggttacccggggttaacgtttaaggggttttttttaaactttaaacgtttcggggttaacaaaccggtttaacttaaaagttttaacgtttaaacctttaaccggttttccccccttaccggttaacttaaaccggggtacccggtttttaacccggggaaacccgttaaacgggggtaaaaccccgtaaagggggttaacgggttaaaaaaccttaacccggtaaaaaaccgggtaaccggttgggtttaacccgggggcctttaacggggaacccttaacccccggtttaaag

SEQ ID NO: 379065 - DNA, 590 bp, Homo sapiens
  misc_feature: GZ8MTXP01ED4AJ.22.14.B03.1.454.CMB.2.raw
  modified_base (412)..(412): a, c, t, g, unknown or other
  modified_base (443)..(443): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgaggagggccaccatcaactgacaagtccagccagtagttatttttacagcctaccaaccaataagagttacttagtctggtcagcaagaaaccaggacatcgtcctgactactgctactactttacgcgggtccgtaccgtaacccgggtacgtcccgggggtccctcgaccccgtattcgaggtgcgaacggcgggtcgtgggacagtacttcactcnctaccatcagcagcctgcaggctagaaacgntgtcgtagttagttttattatgtacagacttaaattacttactacttccctctgaacgttccgttcggaccgttaaacgggaacctaagggacgttaaacttaccgaaaacgtacgtggtacggcttacggaaccttaacgttaacg

SEQ ID NO: 379066 - DNA, 546 bp, Homo sapiens
  misc_feature: GZ8MTXP01DJZ8K.22.14.B03.1.454.CMB.2.raw
  modified_base (315)..(315): a, c, t, g, unknown or other
  modified_base (484)..(484): a, c, t, g, unknown or other
  modified_base (540)..(540): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgcaagtccagccagagttatttttacagctacccaaccaataagagttactagtctggtcagcaagaaaccaggacatcgtcctgcactgctactatttacgngggtcgtccgtacccggggtaactcccggggtcctcggtaccccgatttcaggtggccaacggtcgggtcgtggggaccagtactttcactctcaccatcagcagcctgcaggctggaaactgtgtggcttaagttttattattgtacagctaattattatatcctctnaagtaacgttcggacaaaggtacaggttacgaattacaaagtactgtggcttcgcnccgtaa

SEQ ID NO: 379067 - DNA, 695 bp, Homo sapiens
  misc_feature: GZ8MTXP01A5G31.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgcaagtccagccagtagttatttttacagtctaccaaccaataagtagttactagtctggttaccagcaagaaaccaggacatcgtcctgccactgccttactacgtttacgtcggggtccgttaccggtaaccccggggaacgttcccgggggtcccctacggtaaccccccgtattcgaaggtcggaccgtaacgggtccggggttcgtaggggaaccctaaggtacttttaccgaccgtccttacccaaccctacttaccgaacggcctaacggtcccgttaggaccgtagggtcctaggaaacgtagttggtacgggtacttaaggtttttaattacgttgtacgaagtactaaatttacttaacttactttccctctacgtaacgttaccggttacggaccgaaagggtaacccgtaagggttacggttaaacttacgaaaaacgtcgtaaggtcgacttcgaaccgttaacttaacg

SEQ ID NO: 379068 - DNA, 628 bp, Homo sapiens
  misc_feature: GZ8MTXP01DCC1L.22.14.B03.1.454.CMB.2.raw
  modified_base (448)..(448): a, c, t, g, unknown or other
  modified_base (501)..(501): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgacaagtccagccagtagttatttttacagctccaaccaatagtagttactagtctcgtcagcaagaaaccaggacatcgtacctgacactcgtctactatttacgtcgggtccgtccgtaacccgggtaacgtcccgggggtcctacgaccccgtacttcgaggtcggcgaacgggtcgggtcgtgggactaggtactttcactctacaccatcagcagcctgcgagctgaaagntaggtccggtattaaggtttttattaagttggtacaggtactaatttaacttntactttcccggtctgaaccggttacgttccgggacccttaaaggggaaacccgtaagggttaaacggaaacttaaccgaaaacgggaactttcgggttaacgggcttacggcccttaaacctttcgg

SEQ ID NO: 379069 - DNA, 611 bp, Homo sapiens
  misc_feature: GZ8MTXP01BMZH4.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggagggccaccatcaactgcaagtccagccagtagttatttttacagctaccaaccaataagagttactagctggtccagcaagaaaccaggacatcgtcctgccactcgctactatttacgcgggtcgtccgtacccggggtaacttccccgggggtcccctcggacccccgtatttcgaggttcggacgaacgggtccggggtccgtggggaaccctaggtacttttccacttcctaccacctatccagcagcccgtagacgaggtcctagaaagtgtggtagggacttaaggttttatttagtcgtacaagctaaattattatacttccctctcgaaggtacgttccggaacttaaagggacctaaagggttacgaaacttacgaaaacgtagtgtagcttagccttaactcg

SEQ ID NO: 379070 - DNA, 599 bp, Homo sapiens
  misc_feature: GZ8MTXP01BYE34.22.14.B03.1.454.CMB.2.raw
  modified_base (440)..(440): a, c, t, g, unknown or other
  modified_base (456)..(456): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttacttagctggttccagcaagaaaccaggacatcgtcctgcactgctctatttacgtgggtccgtccgtacccgggacgtcccgggggtccctcggacccccgtattcgaggtcggcgaacgggtcgggtcgtgggactaggtactttcgacttctcacctatcagcagcctgcaggctagatgngtgcgtagtttacttnttagtcagtactaagttatttactcttacccgtctacgtaacggtaccggttccgggaaccgaaacggggtacccgaaaggggttacggaaaacttcggaaaaacccggtagtcggtacgggcttacgaacccttaactaacg

SEQ ID NO: 379071 - DNA, 724 bp, Homo sapiens
  misc_feature: GZ8MTXP01EED7G.22.14.B03.1.454.CMB.2.raw
  modified_base (243)..(243): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagactccctggctgtgtctcgtgggcgaggacggccacatcaactgacaacgtccagccagtagttattttacanctaccaacaaataagtatactagtctggtacagacaacgaaaccagacatcctctgacactgctactagttacgtcgggacgtaccgtaacccgggtaacgttcccggggtcctacgacccgtacgttacgaggtcggaccgtaaacgggtcccgggtgtacgggggtaaactacgggtttaaccttttaccgaaaccttccgttaaccaaacccctaagttaccgaacgaccgaaccgtcccgtacggacccggtagtacccgtaggaaacgtagttcgggtagtagtttaggttttaattacgtgtaactaacgtaataactttaaagtttactactttacccctcgtaaccggaacgttaaccgggttccggaaaaccggttaaaccgggaaagttaaaacgggggttaaacaaaaacgttaccgtaaaaaccggtaggttcgggacggttacttacggaacccgttaacgttaaccg

SEQ ID NO: 379072 - DNA, 734 bp, Homo sapiens
  misc_feature: GZ8MTXP01CEJ4N.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgacaagtccagccagtagttatttttacagctacccacaataagagttacttagtctggtccagacaagaaaccaggacatcgtcctgaccactgctctatttacgtcgggtccgtaccgtaccccgggtaacgtccccggggtccctcggtacccccgtattcgaggtcggccgaacgggtccgggtcgtacggggactacggttactttccgacttctaccaaccctatccgaacggcctaacgccccgtaggaccgtaacgggccttagggaaagtacgttggggttacggtactttaaaggggtttttaagtttacttacggggtaccaaaggttaccttaaatttaactttaacttaacctttcccctacccgttacggtaaacgggttaccccggtttaaccggggaacccgggttaaacggggtaaacccgtaaagggggttacccggaaaaaacgttacccggaaaaaccgtacgtttgggaacgggtcccttacggaacccgttaacttaaccg

SEQ ID NO: 379073 - DNA, 567 bp, Homo sapiens
  misc_feature: GZ8MTXP01CNAZP.22.14.B03.1.454.CMB.2.raw
  modified_base (357)..(357): a, c, t, g, unknown or other
  modified_base (414)..(414): a, c, t, g, unknown or other
  modified_base (417)..(417): a, c, t, g, unknown or other
  modified_base (467)..(467): a, c, t, g, unknown or other
  modified_base (490)..(490): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgcaagtccagccagagttatttttacagctaccaccaataagagttacttagtctgtccagcaagaaaccaggacatcgtcctgcactgctctatttacgtgggtcgtccgtacccgggaacgtcccggggtccctgaccccgtnttcgaggtcggcgaacgggcgggtcgtggggactaggtactttcactctacacctancgngcacgcgagacgagtctagagtgtggtagtacgttaagtttattgtcganaagtattaattattactcttccnctcgaacgtcgttcgaacgaggaacgtaggaacgttaacttacgaaacgtagtggtcgacttcgtaaccttcgtaag

SEQ ID NO: 379074 - DNA, 628 bp, Homo sapiens
  misc_feature: GZ8MTXP01APRGZ.22.14.B03.1.454.CMB.2.raw
  modified_base (455)..(455): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgcaagtccagccagtagttatttttacagtcctaccaccaataagagttactagctggtcagcaagaaccaggacatcgtcctgctactgtctctatttacgtcgggccgtaccggtacccgggaacgtccccgggggtccctcggacccccgtattcgaggtcggcgaacgggcgggtcgtggggacaggttacttcactctccacctatacgacgcgacgcctaggaccaggctagaaagngtgtcgagttaagtttattagtgactagtattaattattattacttacccctcgtcgaaggtaacccggttccggaaaccgttaaacggggtaaaccgtaaagggttacgttaaaacttacccgtaaaaacggtacgtgggttacgggacttacgaacccgttaacgtaaccg

SEQ ID NO: 379075 - DNA, 580 bp, Homo sapiens
  misc_feature: GZ8MTXP01C4O4Z.22.14.B03.1.454.CMB.2.raw
  modified_base (429)..(429): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagttatttttacagctccaaccaataagagttactagctggtccagcaagaaaccaggacatcgtacctgcactgctactatttactcgggcgtccgtaacccgggaactcccggggtccctcggaccccgtattcgaggtcggcaagggtcgggtcgtggggacagtactttcactctcacatcagcagcctgcaggctgaaantgtggctaagtttatatgtcaagctaatattatacttccgtctcgtaaggtccgttacggaccgaaaggggacctaaaggggttaacgaaaacttacgaaaaacccggtaagttgggtaacgggtccttacgggaacccaacccgtttaag

SEQ ID NO: 379076 - DNA, 728 bp, Homo sapiens
  misc_feature: GZ8MTXP01EK2GA.22.14.B03.1.454.CMB.2.raw
tcagacatacgcgtcacgaccggtgctcgatttagtgtgagtagttccgcgggggagctacaacaggcaggcaggggcagcaagatggtgctgcagaccccaggtcttcatttctctgttgctctggatctctggtgcctacggggacattgtgatgacccagtctccagactccctggctgtgtctcgtgggcgagacgggccaccatcaactgacaagtccagccagtagttatttttacagtctaccaaccaaataagtagttaacttagcttggttccagacaagaaaccaggacatccgtctgcactgctactatttacgtgggtcgtaccgtaacccgggaacgtcccggggtccctacgaccgtattcgaaggtcggacagggtcgggtcgtaggggactaggtactttcgaccttacctaccaaccctattaccgaagaccgaacggtcccttacggacgtaacggggaccttaacgggaaacgtaaggttgggttacggggggtacttttaaggggtttttaactttacgttaggtacctaaggttaaccttaaaagttttacttaacgtttaaacccttcccctttacctaacggtaaccggttaaaccggttttaccggggaaaccgtaaaacgggggtaacccgttaaaaggggttaacgaaaacgttaaccgaaaaacgtaaccggttaggtacggacttcgggaaccctaaccg

SEQ ID NO: 379077 - DNA, 817 bp, Homo sapiens
  misc_feature: GZ8MTXP01AZCN6.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagacgggccaccatcaactgcaagtccagccagtagttatttttacagcctaccaaccaataagtagttactagtcttgtaccagacaacgaaaccaggacatcgtcctgccactcgctactacgtttacgtcgggtccgtaccgtacccggggtaacgtccccgggggtccctacggacccccgtagttcgaggtcggcgtaacgggtccgggtcggtcggggtaacgaggttaccttttaccgtaaccctccttacccaaccctagttacccgaacggtccgaacggtccccgtagggtaaccggaaccgggtacgttaagggaaaacggttaggtttagggttcggggttaacccgttttaaagggtttttaacctttaaagtttccggggtaactaaacccggttaacttaaaactttttaagtttaaaccttttcccgtttacccccgttaccttaccgggtaaaccggttaacccgggggttttacccgaaacccgggttaaaacgggggtaaaaccccgtaaagggggttaaaccggttaaaacttaaacccgggaaaaccggtacggttaacccggttggggaacctttaccgggaacccttaacccttaaccgg

SEQ ID NO: 379078 - DNA, 720 bp, Homo sapiens
  misc_feature: GZ8MTXP01AU3M8.22.14.B03.1.454.CMB.2.raw
  modified_base (708)..(708): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgcaagtccagccagtagttatttttacagctccaaccaataagtagttactagtctggtcagacaagaaaccaggacatcgtcctgcactgcttactactttacgtcgggtccgtaccgtacccgggtaacgtcccggggtccctacggtaacccccgtattacgaacggtcggggcgtaaacggggtccggggttccggtacggggaaacccgtaaggttacctttaccgtaacccgttccgttaacccgaacccctaagttaccgaacgtccgaaaccggccctttacgggacccgtaaggggtccgtaaggtaaaacggtcgttagggtaccgggtactttaaaggtttttacgtttaagtacgggttacaaggttacctaaagtttattttaacttaccttcccgttcctagaacggttaaccggttccgggaaacgttaacgggaccgtaaggttacggaaacttacgaaacgtactgggtacgcgttacnccgaaccttaag

SEQ ID NO: 379079 - DNA, 723 bp, Homo sapiens
  misc_feature: GZ8MTXP01B5F9T.22.14.B03.1.454.CMB.2.raw
  modified_base (678)..(678): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagacctccctggctgtgtctcgtgggcgagacgggccacatacaactgacaacgtccagaccagtagttattttacacgtctaccaacaaataagtagttactagtctcggtacagacaacgaaaccgagacactcgtacctgaccactgaccttacgtatttaccggtcgggtccgtaccggtacccggggtaacgtacccgggtacccgttaggaaccccgtacttcgaacggttcggaccgtaaaggggtccgggtccgtaggggtaaacccgtagttaaacgtttccaccttacctaccaaccctactacgacggacctacggcccgttacggaccgtaggtacgtaaggaagtaggtaggtagggttaacgtttaagttttaagttacgttaggtaacctaagaactttaaattaactttaacgttacttacccgtacctacgtaaccggtaccggttaccgggaccgttaaaggggtaacccgtaaaggggttaaccgttaaanaaccggtaaacgacgtaaggtggaccttacgaaccgttcttaacg

SEQ ID NO: 379080 - DNA, 614 bp, Homo sapiens
  misc_feature: GZ8MTXP01AG688.22.14.B03.1.454.CMB.2.raw
  modified_base (454)..(454): a, c, t, g, unknown or other
  modified_base (475)..(475): a, c, t, g, unknown or other
  modified_base (511)..(511): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagtctaccaccaataagagttactagctggtccagcaagaaaccaggacatcgtcctgcactgctactatttacgtgggtccgtaccgtaccccggggtaacgtccccgggggtccctcggacccccgtattcgaggtcggcgaaggtccggggtcgtgggaactaggtactttcactctacacccatcacgcagccctggcagggcctaggaagtntaggtgacgttagtttaactnttggtacagtataatttattacttacttccctcctntaacggtcgttcgggaacccgaaggggtaccctaaagggttacgaaaacttcccggaaaacggttcgtggtacgggtccttacggaacccttaacgttaaccg

SEQ ID NO: 379081 - DNA, 639 bp, Homo sapiens
  misc_feature: GZ8MTXP01ATHRT.22.14.B03.1.454.CMB.2.raw
tcagacatacgcgtcacgaccggtgctcgatttagtgtgagtagttccgcggggggagctacaacaggcaggcaggggcagcaagatggtgttgcagacccaggtcttcatttctctgttgctctggatctctggtgcctacggggacattgtgatgacccagtctccagactccctggctgtgtctcgtggcgagacgggccaccatcaactgcaagtccagccagtagttatttttacagtctaccaacaataagtacgttacttagcttggtacagacaagaaaccaggacatcgtcctgacactgctctatttacgtcgggtaccgtaccggtacccgggtaacgttcccggggtccctcggaccccgtattcgacgtggcgaacggcgggtcgtcgggactagtactttccgactctacacctatacaacggctaacggcccgtagaccgaggtcgttaaggaacgtagttacgggtggtaacctttaaggttttacttaacgttggttacaacgtacttaaattatttacttaccttcctacctaggtaacggtaaccggttcgaaaccgttaacgggaaacctaagggttacgaaattaccgaaagtacgtggtacgcttacgcttaacgtc

SEQ ID NO: 379082 - DNA, 651 bp, Homo sapiens
  misc_feature: GZ8MTXP01DKM97.22.14.B03.1.454.CMB.2.raw
tcagacatacgcgtcacgaccggtgctcgatttagtgtgagtagttccgcggggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggagggccaccatcaactgcaagtccagccagtagttatttttacagtcctaccaaccaaataagtagttactagtctggttacagacaagaaaccaggacatcgtctgcactgctctatttacgtgggtccgtaccgtacccgggtaacgtcccggggtccctcgtaccccgtattcgaggtcggcgaacgggtcgggtcgtaggggacagtacttcactctaccacctatcgaagtcacgtccctagaccgtagggcttaaggaagtagttgggtaccgggtatttaaaggtttttaacttagttcgtaccaagttactaaatttaactttactaacctttccctacctcgtaaacggttccggttaccgggaacccgttaaaggggaacccgtaaaggggttacgttaaaacttaccgaaaacgtcgtgtcgggcttacgccttaaccgtaa

SEQ ID NO: 379083 - DNA, 645 bp, Homo sapiens
  misc_feature: GZ8MTXP01AGAPY.22.14.B03.1.454.CMB.2.raw
  modified_base (325)..(325): a, c, t, g, unknown or other
  modified_base (403)..(403): a, c, t, g, unknown or other
  modified_base (453)..(453): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtggcgagacgggccaccatacaactgacaagtccagccagtagttatttttacagtctaccaaccaaataagtagttactagtcttcggtccagacaagaaaccaggacatccgtcctgcactcgctctatttacgngggtccgtaccggtacccgggacgtccccgggggtcctacggacccccgtattcgaggttcggcaagggtcgggtcgngggacctagtacttcactctacactatcagcacgctagcagctagaagtntggtcgattaggtttattacgtcgtacctaagtctaaatttactttacttacttccccgtcctagtaacggtaaccggtttaccggaacccggttaaacgggggaacccgtaaaggggttacgttaaaacttaaccggaaaaccgggttatcggggttacgggaccttacgggtaacccttcggtttaaccg

SEQ ID NO: 379084 - DNA, 615 bp, Homo sapiens
  misc_feature: GZ8MTXP01BWVJ1.22.14.B03.1.454.CMB.2.raw
  modified_base (306)..(306): a, c, t, g, unknown or other
  modified_base (315)..(315): a, c, t, g, unknown or other
  modified_base (384)..(384): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtggcgagacgggccaccatcaactgacaagtccagccagtagttatttttacagtctaccaacaataagagttactagtctggtccagcaagaaaccaggacatctctgcactcgctntactttcgngggtccgtccgtacccgggtacgtcccggggtcctacgacccgtactcgagtgacgtacggcgggtcgngggtactagtacttccgactcgtaccacctagtacgtacgccgacgtaccgtcggacgtaggccttaggaagtagtggtacgggtattagtttattatggaccagtactaatttacttactacttcctaccgtgaacgtaccgttcggaacgaacgggtaaaccgaaggttaacggaaaccttaacgaaaccggtacgtggtaccggtcttacggaaccgttaacttaacg

SEQ ID NO: 379085 - DNA, 567 bp, Homo sapiens
  misc_feature: GZ8MTXP01AS5AU.22.14.B03.1.454.CMB.2.raw
  modified_base (237)..(237): a, c, t, g, unknown or other
  modified_base (270)..(270): a, c, t, g, unknown or other
  modified_base (300)..(300): a, c, t, g, unknown or other
  modified_base (422)..(422): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagttatttttacngctccacaataagattactagctggtccagcanaaccagacatcgctgcatgctcatttacgngggtccgtcgtacccgggacgtccggggtccctgaccccgtattcgagtcgcaagggtcgggtcgtgggaccagtatttcacgtctacacctatccagcacgtccgagaccaggcctagaanagtgtacgggtactagtttacttattggtactagctaattattacttacttcctctcaacgtcgttcggaccaagggtaaccaagggttacgaaacgttacgaaaaccgtagtcggttacgcgttacgaaccgttaaccgtaacg

SEQ ID NO: 379086 - DNA, 736 bp, Homo sapiens
  misc_feature: GZ8MTXP01ETTVL.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagactccctggctgtgtctcgtgggcgaggacgggccaccatacaactgacaagtccagaccagtagttatttttacacgtcctaccaaccaataagtagttactagtcttcggtccagcaacgaaaccaggacagtcgtcctgcactcgctactactttacgtcgggccgttaccgtacccgggtaacgtccccgggggtccctcggaacccccgtagtttcgaaggttcgggaccgtaacggggtccggggtcgtaggggaacctaggttacttttaccgacttcctaccgaaccctataccgacgtcaacgcccgttacggccgtaggacgtaaggaagtagttcggtacgggtattagtttttaataagttcgtaacgtaaggtaccttaaatttaactttaactttaccctttccccttacccgttagtaaccgggttacccggtttaacgggaaacccggttaaaacggggtaaacccggtaagggttaaacggttaaaacttaacccggtaaaacggaccgttaagggtcggtaccttacggtaaccttaaccgttaaccg

SEQ ID NO: 379087 - DNA, 770 bp, Homo sapiens
  misc_feature: GZ8MTXP01AMX52.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgaccagtctccagactccctggctgtgtctcgtgggcgaggagggccaccatcaactgacaagtccagccagtagttatttttacagtctaccacaataagtagttactagctggtccagacaagaaccgagactatcgtctgcactcgctctacttacgtcgggcgtaccggtaccgggtacgtcccggggtcctagaccccgtattcgaggtcgcgaacgggtcgggtcgtcgggactagtacgtttcactctaccacctatacgacgccacggtcctacggaccgagggtaccgtaaggaaacgtacggttgggttacgggtaaccttttaagggtttttaacttttaagttcgggttaaaccctaagggttaacccttaaaagttttaaacgtttaacgtttaacccgttttcccccttaacccgtttaacccggtaacggggtttaaacccccggggttttaccgggggaaaacccgggttaaacgggggtaaaccccgttaaaagggggttaaacggttaaaaccgttaaaaccccgaaaagggttaaaccccggtttgggttaaaccggggtcctttaccgggaacccttaaacccggtttaacccg

SEQ ID NO: 379088 - DNA, 592 bp, Homo sapiens
  misc_feature: GZ8MTXP01BQBIU.22.14.B03.1.454.CMB.2.raw
  modified_base (457)..(457): a, c, t, g, unknown or other
  modified_base (586)..(586): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgcaagtccagccagtagttatttttacagctaccaacaataagagttactagtctggtcagcaagaaacaggacatcgtcctgcactgctactatttacgcgggtcgtaccgtaccccggggtaacgttcccgggggtccctacggaccccgtattcgaggtcggccgaacgggtccggggtcgtgggaacaggtactttccgactctacaccctatcagcagccctaggcgaggctagaaagtntggtcggtacttaagttttacttagtcgtacgaatctaaattattactcttccctctacgaacgtcggttcggaccgaagggaacctaagggttagaacttacgaaacgtactggtggcttacgaaccncgtaac

SEQ ID NO: 379089 - DNA, 578 bp, Homo sapiens
  misc_feature: GZ8MTXP01BZ2B5.22.14.B03.1.454.CMB.2.raw
  modified_base (406)..(406): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgcaagtccagccagtagttatttttacagctccacaataagattactagctggtcagcagaacaggacatcgactgccactgctctatttacgtcgggtcgtccgtaccccggggaatcccgggggtccctggacccccgtatttcgaggtcggcaacggcgggtcgtggggactagtactttcactctcacgntcagcagcctagcagctgaatgtgtcgtagtagttttatactgtacaagtctaaattattacttacgttcccctctactaacggtaacgtttccgggaaccttaaaggggacctaaaggggttaggaaaacttacggaaaacgcttggtcgacttcgaaccttaaccgttaa

SEQ ID NO: 379090 - DNA, 658 bp, Homo sapiens
  misc_feature: GZ8MTXP01D2DHJ.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacagttgtgatgacccagtctccagacctcccgtgctgtgtctcgtgggcgaggagggccaccatacaactgacaagtccagccagtagttatttttacagcctaccaacaataagtattactagtctgtaccagcaacgaaccaggacatccgtctgaccacgtgcctatactttaccgtgggacgtaccgtacccggaacgtcccggggtcctcgaacccccgtattcgaggtcggacgaacgggcgggtcgtagggacctagttacttcactctaccactatcaacgtcacgtccgtacgaccgagggtctaggaaagtgtcggtgtacgttaaggtttatttagtagtaccaagtacttaaatttaagttattacccgttacctccgtaagtaacggtaccggttccgggaaaccgaaacggggtaaacccgtaaggggttaaagaaaacgttacccgtaaaaccgggtacgttgggttaacggccttaccggaaccttaacccggttg

SEQ ID NO: 379091 - DNA, 529 bp, Homo sapiens
  misc_feature: GZ8MTXP01AFHMQ.22.14.B03.1.454.CMB.2.raw
  modified_base (278)..(278): a, c, t, g, unknown or other
  modified_base (307)..(307): a, c, t, g, unknown or other
  modified_base (445)..(445): a, c, t, g, unknown or other
  modified_base (447)..(447): a, c, t, g, unknown or other
  modified_base (516)..(516): a, c, t, g, unknown or other
  modified_base (523)..(523): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccacatcaactgcaagtccagccagagttatttttacagctccaccaaataagagttactagctggttccagcagaaacnggacatcgtcctgcactgctcatttacgngggcgtccgtaccgggaatccgggggtccctggaccccgtattcgagtcggcaagggccgggtcgtggggaccaggtattcactctcaccatcagcagcctagcaggctagagatgtcggctagtttattattcgtanantaatatatcttcctctgtaacgtcgttcgacgaaggacgtaaggttacgaattacgaagtactgcgacncgtaacncgtaag

SEQ ID NO: 379092 - DNA, 526 bp, Homo sapiens
  misc_feature: GZ8MTXP01CFF3A.22.14.B03.1.454.CMB.2.raw
  modified_base (275)..(275): a, c, t, g, unknown or other
  modified_base (295)..(295): a, c, t, g, unknown or other
  modified_base (305)..(305): a, c, t, g, unknown or other
  modified_base (382)..(382): a, c, t, g, unknown or other
  modified_base (406)..(406): a, c, t, g, unknown or other
  modified_base (415)..(415): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagttatttttacagctaccacaataagagttactagctggtcagcagaacnggacatcgtctgcactgctntagtttacgngggtctccgtacccggagtcccggggtcctgaccccgtatcgagtgcaggcggtgcgggacagtcttcactctcacngtcagcagcctgcagcgtagaagntgtacggtnttaaggtttattgttgcagtacattattatacttcgtactgaagtcgttccgacgaggtaaccgaggacgttaaattacaaacgagttgcgggattcggaacttaaccttg

SEQ ID NO: 379093 - DNA, 569 bp, Homo sapiens
  misc_feature: GZ8MTXP01BLC3Y.22.14.B03.1.454.CMB.2.raw
  modified_base (430)..(430): a, c, t, g, unknown or other
  modified_base (436)..(436): a, c, t, g, unknown or other
  modified_base (481)..(481): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgacaagtccagccagagttatttttacagctaccacaataagattactagctgtcagcaagaacagacatcgtcctgcactgctactatttacgcgggtcgtccgtaccgggtaacgtcccggggtcctcgaccccgtatcgaggtcggcaacggcgggtcgtgggacagtactttcactctaccaccagtccagcacgcctggccaggctaagaagntgcgtntaagttttatattgacagtctaaatttataattcttcctaccttnaaggtcgttccggaaacgttaaacggggaaccctaagggttacgaaaattccgaaaaacgagtcggtaggcttaggccttaactaacg

SEQ ID NO: 379094 - DNA, 608 bp, Homo sapiens
  misc_feature: GZ8MTXP01AR24G.22.14.B03.1.454.CMB.2.raw
  modified_base (310)..(310): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagttatttttacagctccaccaataagagttactagtctggttccagcagaaaccaggacatcgtcctgcactgctctatttacgngggtccgtccgtacccgggaagttcccggggtcccctggacccccgtattcgaaggtcggcgaagggtcgggtctgggggaccaggtactttcacttctacacccgatccagtccagccctagccaggtctaggaagtagtggtagggtaccttaaggttttaatttagttcgtacgtaagtacctaaatttaactttataactttcccctacctcgtaacgtacggttcggaaccaaggggtacctaagggttacggaaacttccaaaacggtactgaggtccttagccgaactaac

SEQ ID NO: 379095 - DNA, 640 bp, Homo sapiens
  misc_feature: GZ8MTXP01BTLYC.22.14.B03.1.454.CMB.2.raw
  modified_base (309)..(309): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgcaagtccagccagtagttatttttacagctccaacaataagattactagctggtcagcaagaacaggacatcgtcctgcatcgctctagtttacgngggccttccggtacccgggtaacgtcccgggggtccctcggaccccgtattcgaggtggcaacgggcgggtcgtgggacagtactttcacgtctcacctatcagcacgccctgaccgagcgagaagtagtgtagggtcttaaggttttaattagttacgtactaacgtactaaagtttaactttaattaaccgtttcccctacccttacggaaccggttaccgtttacccggggaaacccgttaaacggggtaaacccgtaaaggggttaacggaaaacttaaccgaaaacgtacgtaaggtcggtacttacggaaccttaacccgttaag

SEQ ID NO: 379096 - DNA, 661 bp, Homo sapiens
  misc_feature: GZ8MTXP01C7DB3.22.14.B03.1.454.CMB.2.raw
  modified_base (517)..(517): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgcaagtccagccagtagttatttttacagtctaccaacaaataagtagttacttagtcttggtccagacaagaaaccaggacatcgtcctgcactgtctactactttacgtcgggtccgttaccgtaccccggggtaacgtcccggggtccctacgaccccgtacgttcgaggtcggcgaacgggcgggtcgtacgggacgtaggtctttaccactctaccacctatcgaacgccacgtccctaggcgtaacgggctaaggaagtcgttggtacgggtactttaagtttttatagttcgacgtanattaatttattacttacctttcccgtcctaggtaacggttaccgttacgggaaccgttaaacggggtaaccctaagggggttaaacgaaacttaccggaaaaacggttcgtcgggttaccggcttaacggaacccttaacgttc

SEQ ID NO: 379097 - DNA, 663 bp, Homo sapiens
  misc_feature: GZ8MTXP01AB9B9.22.14.B03.1.454.CMB.2.raw
  modified_base (260)..(260): a, c, t, g, unknown or other
  modified_base (308)..(308): a, c, t, g, unknown or other
  modified_base (454)..(454): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagacgggccaccatcaactgcaagtccagccagagttatttttacagctccacaatagattactanctggtcagcaagaaccaggacatcgtcctgcactgctactatttacgngggtcgtccgtacccgggaagtcccggggtccctcggaccccgtattcgaggttcggcgaacgggcgggttcgtaggggactaggtactttcacgtctaccacccatacgaacgcgacgccgtagccgtagggtctaggaaacgtnttcgggttacggtacgtttaagttttaacgtttagttacggtacaagtacttaaatttactttaaacttcctttaccccgtccttacggtaacgttaccgggtttaccgggaacccgaaagggggtaaccctaaaggggttaacgggttaaaaccaccgtaaaaaccgtacgttggtaaccggccgttacgaacccgttaacccttaag

SEQ ID NO: 379098 - DNA, 594 bp, Homo sapiens
  misc_feature: GZ8MTXP01EGQIK.22.14.B03.1.454.CMB.2.raw
  modified_base (594)..(594): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggagggccaccatcaactgacaagtccagccagtagttatttttacagctaccaaccaataagtagttactagtctggtcagacaagaacaggacatcgtcctgcactcgctactactttacgtcgggtccgtaccgtacccgggtaacgttcccggggtccctagaccccgtattcgagtggcgaacgggcgggtcgtgggacagttactttcactctaccacctatcacggcagccctagaccgaggtctagaagtgtaggtcggtattaggttttattacgttgacagtacttaaatatttactactttcctacctcgtaacgtcgttacggacgaaaggtaccgtaaaggttacgaaattaccgaaagtactggtacgcttacgccttaaccgtn

SEQ ID NO: 379099 - DNA, 553 bp, Homo sapiens
  misc_feature: GZ8MTXP01AZ2Q7.22.14.B03.1.454.CMB.2.raw
  modified_base (309)..(309): a, c, t, g, unknown or other
  modified_base (413)..(413): a, c, t, g, unknown or other
  modified_base (463)..(463): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagttatttttacagctccaaccaataagagttactagctggttccagcagaaaccaggacatcgtcctgcactgctcatttacgngggcgtcgtacccggatcccggggtcctgaccccgatcgagtggcgaagccgggtctggggacagtatttcgactctcaccatcagcagcctgcaggctagaanagtgtggctagtttattagtgtacagactaattaattatacttcctactntaagtacgttccggacaaacgggtaccaaagggttaacgaaaacgttaccgaaaacgtaccgtggcgggtcttacgaaccgttaacgtcg

SEQ ID NO: 379100 - DNA, 764 bp, Homo sapiens
  misc_feature: GZ8MTXP01AYSVZ.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagtagttatttttacagtctaccaccaataagagttactagctggtccagcagaaaccaggacatcgtcctgacactgtctactatttacgtcgggtccgttaccgtacccggggtaacgtccccgggggtcccctacggtaacccccgtactttcgaggtcgggccgaaacgggtccggggtcgtggggaacctacgggttactttaccgaccttctaccaccctatccgaaggccctaacggtccccgttagaccggtaacgggtaccgttaaggaaaacggtacgtggggttacgggtaccgtttaagggttttttaatttaaaccgtttggtacctaaggtaccttaaaatttattttaaacttaaccctttcccttacccgttacgtaaacgggttaaccccgggtttaccggggaaacccgaaacgggggtaaacccgtaaacgggggttaacggttaaaaacttacccggtaaaaaaccgggtacgttcgggtttaacggggcccttaacgggaacccttaaccccgggtttaag

SEQ ID NO: 379101 - DNA, 877 bp, Homo sapiens
  misc_feature: GZ8MTXP01EO017.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggacgggccaccatcaactgacaagtccagccagtagttatttttacagctaccaacaaataagtattactagctggtccagcaagaacagacatcgtctgctactgctactatttacgtgggtccgttaccggtaacccgggtaacgttcccgggggtaccctacggtaacccccgtacgtttacgaagggtcggaccgtaaacgggtccgggggttccgtagggggaaaccgtaacggttaccgtttttacccgaaccgttacccgttacccgaaacccctaaagtttacccgaaacggggtcccaaaccggtccccggtttaacgggaccggtttaaaaccggggggtacgttaaacgggtaaaacggttacggtttacggggttaaccggtttaacgggtttttaaaggttttttaaacgtttaacggttaccggtaaacgtaaacgtttaaactttaaagttttaaaccgttttaacgtttaccccgtttaccccgttaacccgttaacgggttaaacccgggtttaaacccgggttaaccggggaaacccggttaaaacggggtaaacccggtaaaaacggggttaaacgttaaaaaccgttaaaacccggtaaaaaccgggttaccggttaacgggttaaccgggaccttaccggtaaacccgttaacgttaacg

SEQ ID NO: 379102 - DNA, 666 bp, Homo sapiens
  misc_feature: GZ8MTXP01B98O0.22.14.B03.1.454.CMB.2.raw
  modified_base (481)..(481): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggacgggccaccatcaactgacaagtccagccagtagttatttttacagctaccaacaataagagttactagtctggtcagcaagaacagacactcgtcctgcactgtctctacgtttacgtcgggtcgtaccgtaccgggaacgttcccggggtaccctacggaccccgtattcgaggtcggcgtaacggtccgggtcgtaggggtactacggttactttaccaccttcgtaccaccctaatccgaagtccaacgtcccgtaggacccgaggtcctaggaaagtntacggttggactttaaggtttttacttagtggactacgtattaaatttactttactacttccctacgtcgtaacggttacccgttcgggaaacccgttaaagggtaaaccccgtaaggttaaacgggaaaacttccggtaaaacggtacttcgggtacgtcgttacgaacccttaaccggttaag

SEQ ID NO: 379103 - DNA, 570 bp, Homo sapiens
  misc_feature: GZ8MTXP01B9QU6.22.14.B03.1.454.CMB.2.raw
  modified_base (291)..(291): a, c, t, g, unknown or other
  modified_base (396)..(396): a, c, t, g, unknown or other
  modified_base (412)..(412): a, c, t, g, unknown or other
  modified_base (441)..(441): a, c, t, g, unknown or other
  modified_base (446)..(446): a, c, t, g, unknown or other
  modified_base (453)..(453): a, c, t, g, unknown or other
  modified_base (460)..(460): a, c, t, g, unknown or other
  modified_base (470)..(470): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagattccctggctgtgtctcgtgggcgagagggccaccatcaactgcaagtccagccagagttatttttacagctccaacaataagagttactagctggtcagcaagaaccaggacatcgtccngcatgctctatttacgtgggtccgtccgtaccccgggagttcccgggggtccctgacccccgtattcgaggtcggcaaggcgggtcgtgggacagtattcactcncacatcagcagctgcngcagaagtagcgtcgtagtttatatgtanacgtntaaattnttaactnttccctcctntaacggtaccgttcggacccgttaaagggaacccgtaagggttacggaaacttaccgaaaacgtacgttcggtcggtaccttaggcccgttaacgtaacg

SEQ ID NO: 379104 - DNA, 639 bp, Homo sapiens
  misc_feature: GZ8MTXP01AJLRY.22.14.B03.1.454.CMB.2.raw
  modified_base (407)..(407): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgcaagtccagccagagttatttttacagctaccacaataagattactagctgtcagcagaaccagacatcgctgcactgctactatttacgtgggtccgtccgtaacccgggtacgtcccggggtcctacggacccctagttcgaggtcggcaaagggtcgggtcgtaggggacagtactttacactctacaacntcgacgcacggccctgacgaggactaggaaacgtgcggtggtattaggttttattacgttggaccaagtcctaaatttacttaacttccggttaccccttcgcgtaaacggttacgggttcccgggaaacgttaaaacgggggaaaccctaagggggtttaacggaaaaccttaacccggaaaaacggttaccgttggggaacgggttcccacgtaaccccaaggtttaacc

SEQ ID NO: 379105 - DNA, 577 bp, Homo sapiens
  misc_feature: GZ8MTXP01EYSNP.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagttatttttacagctccaccaataagagttactagctggtccagcaagaaaccaggacatcgtcctgcactgctcatttacgtgggcgttccgtacccgggaatcccgggggtccctgaccccgtattcagtggcgaaggcgggtcgtggggacaggtatttcactctcaccatcagcagcctgctagggctagaagtatggtggactagttttattattggtacagtactaaattatttatactttcctccgtataacggtacgtttccgggaccttaaaggggaccctaaaggggttagaaaacttaccgaaaacgtacgttgggtcggacgttacgaacccaacgtaac

SEQ ID NO: 379106 - DNA, 771 bp, Homo sapiens
  misc_feature: GZ8MTXP01A4KTJ.22.14.B03.1.454.CMB.2.raw
  modified_base (311)..(311): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagactccctggctgtgtctcgtggcgaggagggccaccatcaactgcaagtccagccagtagttatttttacagtctaccaaccaataagtagttactagtctggtacagcaagaaccaggacatccgtctgcactgtacctntaacgtttacgtcgggtaccgttacccgtaaccccgggggtaacgtccccggggtaccctaccggtaacccccgtagtttaccgaaggggtcggaccggtaaacgggtccgggttcggtaacgggggaacctagggttactttacctaccctactaccctaaccctacgttccaaacgtccgaaccggtcccgtacggacccgaggtaaccgttaggaaaacgttaggtccgttagggtaacctttaaggtttttactttaacgttggtaacaccggttaaactaatttaacttttagttaaccctttccctacccttacggtaacgttaacccgggttacggggtaaccccgaaaaggggtaaccccgttaaaaggggttaacgggttaaaaaccttaccgggtaaaaaccggttacgtaacgggttacgggacttaccggaacccttaaactttccgg

SEQ ID NO: 379107 - DNA, 648 bp, Homo sapiens
  misc_feature: GZ8MTXP01DEZ63.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtggcgagaggccaccatcaactgcaagtccagccagtagttatttttacagctaccaaccaataagagttacttagctggttcagcaagaaccaggacatcgtcctgcactcgctactacgtttacgtcgggtcgtccgtaacccgggtaacgtccccgggggtccctacggtacccccgatttcgaggtcggccgtaacgggtcgggtcgtagggacctaacgttactttccgacttcgtaccacctatacgacgcacgtcccgtagacgagggtctaaggaacgtagttggtagggtacttaaaggttttatttacgttgtaacgagtattaattaatttatacttccctcgtcgaacgtaccggttcgggaaccgttaaacgggtaccgtaaaaggggttacgttaaacttaacggaaaccgtaagttcgggacggtcttaccgtccttaaccgtcg

SEQ ID NO: 379108 - DNA, 582 bp, Homo sapiens
  misc_feature: GZ8MTXP01E1GLK.22.14.B03.1.454.CMB.2.raw
  modified_base (238)..(238): a, c, t, g, unknown or other
tcagacatacgcgtcacgaccggtgctcgatttagtgtgagtagttccgcgggggagctacaacaggcaggcaggggcagcaagatggtgttgcagaccccaggtcttcatttctctgttgctctggatctctggtgcctacggggacattgtgatgacccagtctccagactccctggctgtgtctctggcgagagggccaccatcaactgcaagtccagccagagttatttttacngctccaccaataagagttactagctggttccagcagaaccaggacatcgtcctgcactgctctatttactgggctccgtaccccgggaatcccgggggtcccctgaccccgtattcagtggcaagggccgggtctgggacagtactttcactctcaccatcagcacgcctgcgagctagagagtgtggcgtagtttattattggcagactaattaattatacttccctcctcaacggtaccgttccgggacccgaaacggggaacccgtaagggttacgggttaaaacttacccgaaaacgggaacccttgggtcgggtcttacggaaccccttaaccgtaacg

SEQ ID NO: 379109 - DNA, 722 bp, Homo sapiens
  misc_feature: GZ8MTXP01EGOO0.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggacgggcccaccataccaactgacaagtccagccagtagttatttttacagtctaccaacaataagtagttacttagctggtaccagacaacgaaccaggacatcgtcctgcactgctctagtttacgcgggtccgtaccgtacccgggtaacgtcccggggtccctacggaccccgtagttacgaggtcgcgtaacggccgggtgagggacagtactttacaccgtctaccactatccgagccacggtccctaggaccgtaggaccttaaggaaagtcgttagggtaccgggtactttaaaggttttttactttagtacgggttacgaaacgttaacgttaaatttaaacgtttaacttaccctttacccgttacctacggtaaacgggttcccgggtttaccgggaaaccgttaaacgggggtaacccctaaagggggttaaacggttaaaacctttaaaccgggaaaacccggttaacgttcggggttacgggacccttaggtaaccccgttaaactttccgg

SEQ ID NO: 379110 - DNA, 703 bp, Homo sapiens
  misc_feature: GZ8MTXP01D1F7T.22.14.B03.1.454.CMB.2.raw
  modified_base (551)..(551): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggacgggccaccatcaactgacaagtccagccagtagttatttttacacgtctaccaaccaataagtagttacttagcttggtaccagactaagaaccaggacatcgtacctgcactgtacctatacgtttacgtcgggtaccgtaccggtacccgggtaacgttcccggggtaccctacggtaccccgtacttacgaggtcggcgtaaacgggtcgggtcgtagggaactaggttactttcgaccttacgtacaccctataccgacgccaacgtccctaggccgtaagggtctaaggaacgtagttgggtaccgggtacttttaaaggtttttacttaagtcggttaacaacgtnttaaactttatttacttacttccctacctggtaacgttacccggttcggaaaccggaaacgggtaacctaaaggggttaacgttaaaccttaccggaaaaaacccggtcgttggtacccgggtacttaccgtaacccgttaacgtttaaccg

SEQ ID NO: 379111 - DNA, 612 bp, Homo sapiens
  misc_feature: GZ8MTXP01AS1PY.22.14.B03.1.454.CMB.2.raw
  modified_base (240)..(240): a, c, t, g, unknown or other
  modified_base (431)..(431): a, c, t, g, unknown or other
  modified_base (436)..(436): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgcaagtccagccagagttatttttacanctccaaccaataagagttactagctggtcagcaagaaacaggacatcgtcctgcactgctactacgtttacgcgggtccgtaccggtaacccgggtaacgtcccgggggttacccctcggacccccgattcgacggtcggcgtaagggccgggtcgtacgggactaggtactttcgactcgtaccacctancagcngcacgcgagcgagatgtgtgtacgttagtttattatacgtactagtactaattaattacttaccttcctacctacgtaacggtaaccggttacgggaaccgaaacgggaaacgtaaaggttagaaacgttaacaaaacggtgtaacgtcggtacgttacgtaaccttaacgtaacg

SEQ ID NO: 379112 - DNA, 773 bp, Homo sapiens
  misc_feature: GZ8MTXP01DP359.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggacggccaccatcaactgacaagtccagccagtagttatttttacagcctaccaaccaaataacgtagttacttacgtcttacggtaccagacaaacgaaaccgaggaactatccgtcctgacctactcgtcttactagtttacgcgggtccgtaccggtacccggggtaacgttcccgggggtccctacgtacccccgtattacgacggtggaccgtaacgggtccgggtcggtaggggacctaaggtaactttccactctacaccctataccgaaggccacggtccttacggacgtaacgggtcctaagggaaaactcggttagggtagggtttaaccttttaaaggtttttaacgttttacgttacggtaataaccggaattaaaattttaacttttcttaaacccgtttccccgttaacccttacggaaacggggtttacccgttaccggggttaaacccggaaaaacggggtacccggtaaaagggtttaaacgggaaaaacctttaacccggaaaaacggttaaccgttgggttaaccggccctttacggaacccttaaccccggtttaac

SEQ ID NO: 379113 - DNA, 643 bp, Homo sapiens
  misc_feature: GZ8MTXP01CH5AB.22.14.B03.1.454.CMB.2.raw
  modified_base (444)..(444): a, c, t, g, unknown or other
  modified_base (628)..(628): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggacgggccaccatcaactgcaagtccagccagtagttatttttacagtcctaccaacaataagtagtttacttagcttggtaccagacaagaaaccaggactatcgtcctgcactgtctactattacgtcgggtcgtaccgtacccggatcccggggtcctcgaccccgattcgaggtcggcgaacgggcggggtcgtcgggaacctaggtacttacgactctaccacctagtccagcgaccgtccgngtaccgaaggtctaggaagtagtgggtaacgtacgttaaggtttttaactagttcgtacgaagtacttaaattacttttactacccgtttcctacccgttagaaccggttaacgttcgggaacccgaaacgggtaaccgtaagggttaccgaaattacccgaaacgtagtcggtagccgttacnccgttaacgttaacc

SEQ ID NO: 379114 - DNA, 648 bp, Homo sapiens
  misc_feature: GZ8MTXP01AW85V.22.14.B03.1.454.CMB.2.raw
  modified_base (477)..(477): a, c, t, g, unknown or other
  modified_base (545)..(545): a, c, t, g, unknown or other
tcagacatacgcgtcacgaccggtgctcgatttagtgtgagtagttccgcggggggagctacaacaggcaggcaggggcagcaagatggtgttgcagacccaggtcttcatttctctgttgctctggatctctggtgccgtacggggacattgtgatgacccagtctccagactccctggctgtgtctcgtgggcgagacgggccaccatcaactgacaagtccagaccagtagttatttttacagctaccaacaataagtattactagtctggtccagacaagaaccaggacactcgtcctgcactcgctctagtttacgtcgggtccgtaccgtacccgggtaacgtcccggggtacccacggtaccccgtattcgaggtcgggcgaacgggtcgggtcgtaggggaactaggtactttacacctctacccgaaccagtccgaacggcacgccttacggcgtagactaggaagtntaggttacggatttaaggttttattattacggtacaagtactaaatttattacttaccttccctctanaacgggttacgttccgggaaaccgttaaacgggtaaccgaaagggttaacgaaacttacccgaaaacggtacgtgggttcggacttacgaaccttaaccgttc

SEQ ID NO: 379115 - DNA, 591 bp, Homo sapiens
  misc_feature: GZ8MTXP01CCHW3.22.14.B03.1.454.CMB.2.raw
  modified_base (285)..(285): a, c, t, g, unknown or other
  modified_base (380)..(380): a, c, t, g, unknown or other
  modified_base (406)..(406): a, c, t, g, unknown or other
  modified_base (410)..(410): a, c, t, g, unknown or other
  modified_base (412)..(412): a, c, t, g, unknown or other
  modified_base (422)..(422): a, c, t, g, unknown or other
  modified_base (565)..(565): a, c, t, g, unknown or other
  modified_base (585)..(585): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatacaactgacaagtccagccagtagttatttttacagctaccaacaataagagttactagtctggttcagacaacgaacnggacatcgtcctgcatgctctatttacgtgggccgtacgtacccggtacgtcccggggtcctcggaccccgtatcgagtgacgaaggcgggtcgngggacagtacttcgactctcaacctncgancncgtcagacgnggtacagagtgtaggtacgtagtttaagttttatagtacgataacgtattaaatttacttacttaccgttccctcgttacgaacggtttacgttacccggaacgaaacggtaccgtaaggttaacgaaacgttaccaaaggtntcggtcgacttactaacccngttaac

SEQ ID NO: 379116 - DNA, 697 bp, Homo sapiens
  misc_feature: GZ8MTXP01AIO3H.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagactccctggctgtgtctctgggcgagacgggccaccatcaactgcaagtccagccagtagttatttttacagcctacccaaccaataagtagttaacttagctggtaccagacaagaaaccaggacattcgtcctgcactcgtctactactttacgcgggtccgtaccgtacccgggacgtccccggggttccctacggaccccgtattcgaggtggcgaacgggtccgggtcgtaggggacctagtctttaccactcctccaccctatccgaagccgacgtccctagggcgtacgggtaccttagggaaagtgtccgggttaggtacctttaagggtttttaacttagttacgtttaaccgaagttaacttaaatttaacgtttaaactttcccttccccttaccgtaacgtaacgggtacccggttaccgggaaaccggttaaacgggggaaaccctaaggggttaaccgaaacttaccgaaaacggtacgttcggtaacgggcttacggccttaaacccggttg

SEQ ID NO: 379117 - DNA, 875 bp, Homo sapiens
  misc_feature: GZ8MTXP01DZH7R.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgaggagggccaccatcaactgcaacgtccagccagtagttatttttacagactaccaacaataagagttactagtctggtaccagacaagaaaccaggacatctacctgctactcgctctatttacgtcgggtaccgtaccggtaacccgggtaacgtccccggggtccctacggtaccccgtacttcgacgggttcggaccgtaacggggtccgggttcggtacggggaaaccgtaacggttacttttaccccaccgttaccttacccaaaccctagttacccgaacgaccgaaccggtcccgtttacgggacccgtaagggtacccggttaaaggaaaacggttacgtttgggggttacccgggttaactttttaaacgggggtttttttaaacttttaaaggtttcccgggttaaactttaaagggtaaaaccctttaaacgtttttaaaatttttaaccgtttaaaccctttttcccccttacccggtttaaccggtaaaccgggttaaccccgggggtttaacccgggaaaccccgggttaaaacgggggtaaacccggttaaaagggggttaaaacccgggttaaaaactttaaaaccccgggaaaaaaccggttaaccggttaagggtaccgggggttacccttaacgggaaccccgttaaaccccttttaacggg

SEQ ID NO: 379118 - DNA, 711 bp, Homo sapiens
  misc_feature: GZ8MTXP01CPSMX.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagacgggccaccatcaactgcaagtccagccagtagttatttttacagctaccaccaataagtagttacttagtctggtcagcaagaaacgaggacatcgtcctgcactgctctatttaccgtgggtccgtaccggtaccccggggtaacgtcccgggggtccctcggaccccgtagttcgaggtcggcgaacgggtcgggtcgtaggggacctagttactttccgaccttcaccaaccctataccgacggcaacggcccttaggaccgtagggtcctaaggacgtagttcgggtacggttactttaaggttttaatttgttacgggtacctaagtaaccttaaatttaactttaacttaccttacccgttacccgtcgtaaaccgggttaccggtttacccgggaaaccgttaaacggggtaaacccgtaaggggttaaaccgggttaaaacttaacccggtaaaaaccggacggtttcgggtaccggtacgttacggaaccccttaacgttaaccg

SEQ ID NO: 379119 - DNA, 625 bp, Homo sapiens
  misc_feature: GZ8MTXP01DVC5V.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggagggccaccatacaactgacaagtccagccagtagttatttttacagtctaccaacaataagtagttacttagcttggtacagacaacgaaaccaggacatcgtcctgcactgctctatttacgtcgggtccgttaccgtacccgggtaacgtccccggggtccctacgaccccgtattcgaggtggacgacgggtcgggtcgtgggaactagtacttacactctaccactatccagcacgtcccgtagacgaggtctagaaagtgtgggtcgtagttaagttttattagttcgacagtactaaatttacttatacctttcccgtcgtacgtaacgtaccggttacgggaaccgaaagggtaacccgtaagggttaacgaaacttaacccgaaaagtcgttggacggacttacgaaccgttaacgtcg

SEQ ID NO: 379120 - DNA, 567 bp, Homo sapiens
  misc_feature: GZ8MTXP01EIHAA.22.14.B03.1.454.CMB.2.raw
  modified_base (429)..(429): a, c, t, g, unknown or other
  modified_base (433)..(433): a, c, t, g, unknown or other
  modified_base (483)..(483): a, c, t, g, unknown or other
  modified_base (567)..(567): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttactagctggtccagcaagaaaccaggacatcgtacctgcactgctctatttacgcgggtcgtccgtacccgggtaacgtcccggggtccctgaccccgattcgaaggtcggcgaaggcgggtcgtgggacagtactttcactctcaccatcagcagcctagcgaggctagaanttgnggtattaagtttatagttcgacagactaattattactacttcctccgttnaacggtaccgttcgggaaccgttaaagggacctaagggttagaaacttacgaaacgagtgtcggacttcggaaccttaaccgtn

SEQ ID NO: 379121 - DNA, 714 bp, Homo sapiens
  misc_feature: GZ8MTXP01CHIZ8.22.14.B03.1.454.CMB.2.raw
  modified_base (326)..(327): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtcgccgtacggggactattgtgatcgacccagtcctccagacctccctggctgtgtctcgtggcgaggacggccaccatacaactgacaacgtccacgcctaagtagtttaactttttacacgtcctaccaacaaagtaacgtacttactagtcgttcggtaccagacaaacgaaccaggactactccgtcnncctactcgtactcttacgtttacggtcgggtaccggtaccgtaaccggggtaccggtcccgggtacctcggaccccgtctcgacggtcggccgtaacggggtcgggtcgacgggtactaacgttcttaccacgtcctacctaccagtccgaacggtcaccggtcctacgggtacgtacgggtacgtaaggtaaacgtgttacggggttagtacggttttaagttttacttaacgttcgtaacgtaagtaaccttaaatttactttaacttcccttaccgtaccctaggtaaccgtacgggttcccggaaacggttagggtaaccgtaagggttaacgttaaacttacgaaaccggtgttcggaggtccttacgtaaccgaacgttcg

SEQ ID NO: 379122 - DNA, 681 bp, Homo sapiens
  misc_feature: GZ8MTXP01C4ILR.22.14.B03.1.454.CMB.2.raw
tcagacatacgcgtcacgaccggtgctcgatttagtgtgagtagttccgcggggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggacgggccaccatacaactgacaacgtccagaccagtagttatttttacagtcctaccaactaataagtagttactagtctgtccagacaagaaaccgagacatccgtcctgactactcgtacctactagtttacggcggggtaccgtaccggtaacccgggtaaccggttccccgggggtacctaccggtaaccccgtacttacgacgggttcggacgtaacgggtcgggtcggtacgggactaacggttacttccactactacaacccgtataccggacggtccaacgtcccgtaggccgaagggtctaggaaagtgtacggggttacgtagtttaaggttttactaagttgaaccgttaatacttaaatttactttaactccttccgtactagtaacggtacgttacgggaacaaagggtacgtaaggttaacgaacttaaccgaaacgtagtggtaacgtcacgtaaccttaaccgtaag

SEQ ID NO: 379123 - DNA, 809 bp, Homo sapiens
  misc_feature: GZ8MTXP01A9ZD3.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtggcgagagggccaccatcaactgacaagtccagccagtagttatttttacagtcctaccaacctaaataagtagttacttagtcttggttaccagacaacgaaaccgaggactatccgtcctgcctacgtcgctactagtttacgcgggtccgtaccgtacccgggtaacgtcccggggtccctacggaccccgtattcgaggtcggcgtaacgggccgggtcgtaggggaactacggttactttccgactccttaccaacctagtccgaacgccgtacgtcccttacgggccgtaacggggtccgttaaggaaacggttagttacggggttaacgggttaccgtttaaacgggtttttttaaatttacgtttacgggttaacctaaacggttacctttaaaagtttaactttttaaccgttaaaccctttttacccccttcccgttaacggttaaaccgggttaaaccccgggtttaccgggaaaccccgggtttaaaacgggggaaaccccgttaaaagggggttaaaccggttaaaaccgttaaaccgggtaaaaaaccgttacggttaacgggttaccggtaccgtttaacccggaacccttaaccccggtttaag

SEQ ID NO: 379124 - DNA, 662 bp, Homo sapiens
  misc_feature: GZ8MTXP01D45KL.22.14.B03.1.454.CMB.2.raw
  modified_base (381)..(381): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagactccctggctgtgtctcgtgggcgaggagggccaccatcaactgcaagtccagccagtagtttactttttacagtactacccaaacaaataagtagttacttagtcttggtacagacaagaaccaggacatcctctgcactgtcctactactttacgtcgggtaccgtccgtacccgggtaacgttcccggggtcctacgtaaccccgtnttacgaggtcggcgtaacgggcgggtcgtagggactagtactttccactcgaccacactacaggaccacggtccctaggaccgtagggtacaagggaaactggttgggtacggtatttaaaggttttatttaagttcggtacaagtacttaaattactttaactctttacccctacctgtaacgtacggttccgggaacccttaaaggggaaaccctaagggaacggttaaacttaacggaaaaccgtgtaacggtcggacttacgtccccaagtttaacg

SEQ ID NO: 379125 - DNA, 608 bp, Homo sapiens
  misc_feature: GZ8MTXP01ET82L.22.14.B03.1.454.CMB.2.raw
  modified_base (183)..(183): a, c, t, g, unknown or other
  modified_base (468)..(468): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtntctcgtgggcgaggacggccaccatcaaactgacaacgtccagccagtagtttatttttacgagtcctaccaacaaataagtcgttattagtcgttggtaccagacaaagaaaccgaggactactcgtcctgccatcgctactactttacgacgggtctaccgtaaccgggacgttccccgggggtcctacggtaccccgtattacgaggtcggacccgtagggcgggtttcgagggaactggttacttcctaactctaccacagtacaggctcgcgcgcgacgngtagagtagtagtgtacggtagtttattattacgttatatataattattacttacttactactcgtaacgtacgttacggtacgaacggaacgtaagttaacgaacgttaacgtaagtacgtcgtcgacactaacgcgtc

SEQ ID NO: 379126 - DNA, 573 bp, Homo sapiens
  misc_feature: GZ8MTXP01AOEIZ.22.14.B03.1.454.CMB.2.raw
  modified_base (445)..(445): a, c, t, g, unknown or other
  modified_base (470)..(470): a, c, t, g, unknown or other
  modified_base (569)..(569): a, c, t, g, unknown or other
  modified_base (573)..(573): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagttatttttacagctccaccaataagtagttactagtctggttaccagtcaagaaaccaggactatcgtcctgcactgctactaagtttcgtgggtccgtccgtacccgggtaacgtcccggggtccctagaccccgattcgagtcggcgaaggccgggtcgtgggacctagtactttcgacttcaccaccagtcagcacgcccaggccaggctagaagngtgtggacttagtttattgtcgtanagtataattattctacttcctctcgtaacgtcggttacgacgaacggtacgtaagggttacgaacttaccgaaagtcgtcggtcgaccgttccgtaacncgtn

SEQ ID NO: 379127 - DNA, 702 bp, Homo sapiens
  misc_feature: GZ8MTXP01A1PEJ.22.14.B03.1.454.CMB.2.raw
  modified_base (571)..(571): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatcgaccagtctccagactccctggctgtgtctcgtgggcgaggacgggccaccatacaactgacaagtccagccagtagttatttttacagtcctaccaactaataagtacgttactagtcttcgtaccagacaagaaaccaggaactactccgtcctcgctactcgtcctacttacgtttacgcgggtccgttaccggtacccggggtaacgtccccgggggtaccctacggtaccccgtacttacgaggtcggcgaacgggtccgggtcgacgggtaactacggtactttccgaccttctacccaacctagtccgaacgccgtaacggcccttaggacgtacgggtcctaagggaataggttcggtcggtaactttaaggtttttataacgttcgacgaaagtcttaaaactttnttacttaccgttccctactaggtaaccgttacggttcccgggaaacgttaacggggtaaaccgtaagggttaacgaaaccttaccggtaaaacgtcggttggtaccgtcgttacgtaacccttaaccgttg

SEQ ID NO: 379128 - DNA, 557 bp, Homo sapiens
  misc_feature: GZ8MTXP01BOB2D.22.14.B03.1.454.CMB.2.raw
  modified_base (297)..(297): a, c, t, g, unknown or other
  modified_base (305)..(305): a, c, t, g, unknown or other
  modified_base (361)..(361): a, c, t, g, unknown or other
  modified_base (368)..(368): a, c, t, g, unknown or other
  modified_base (391)..(391): a, c, t, g, unknown or other
  modified_base (436)..(436): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtggcgagagggccacatcaactgcaagtccagccagagttatttttacagctccacaatagattactagctggtccagacaagaaccaggacatcgtcctgcactgctnatttacgngggctcgtacccggaatccggggtcctgaccccgtattcgagtcgcaaggcgggtntgggacngtacttcacgtctacactatcancagcctagcagcgtagagagtagtgtggtagtttagttattagtntagataatattattacttcctcctctaacgtacgttcggtaccgaacggaacgtaacggttaaggaacgttaacgaaacgtaaccgtaagtacggtacgttacgtaaccgaaccgtaaccg

SEQ ID NO: 379129 - DNA, 918 bp, Homo sapiens
  misc_feature: GZ8MTXP01D9GAF.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatcgacccagtctccagacctccctggctgtgtctcgtgggcgaggacggccaccatacaactgacaagtccagccagtagttattttacagtctaccaacaaatagtagttacttagtctgtaccagacaacgaaacgtaggacatccgtcctagctacgtcgtcctacgtacttttacgtcggggtaccgttacccggtaacccgggggtaaccgttcccccgggggttccctacggtaacccccgtactttacggaacgggttcggacccggtaaacggggtcccggggttaacgggttaggggaaacccgttaagggtttaaccttttaccccgtaaacccgtttcccgttaaccccgaaaccctaacgttaccccgtaaacggtacccgaaaccgggtttccccgtaacggaccgggtaaacccggtacggttaaacgggaaaacggttgggttaacgggttaccgggttaaacgggttttaaacggttttttttaacgtttaaagttttacccggggttactaaagggttaacccttaaaagttttaaaccttttaaccgtttaaaccgttttcccccttaacccgttaacggtaaacccggggtttaccccgggtttaacccggggaaaaccccgggttaaaacgggggtaaaccccggtttaaaggggttaaaccgggaaaacttaaaacccggttaaaccggtacgttaacggggtaacgtcgttaccgggtaacccttaacgggttttaacccg

SEQ ID NO: 379130 - DNA, 669 bp, Homo sapiens
  misc_feature: GZ8MTXP01EMHL0.22.14.B03.1.454.CMB.2.raw
  modified_base (507)..(507): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagactccctggctgtgtctcgtgggcgaggacgggccaccatacaactgacaagtccagccagtagttatttttacagtcctaccaacaaataagtagttactagtctacggtccagtacaagaaaccgaggacactcgtcctgcctactcgcttactacgtttacggtcgggtaccgttaccggtaacccggggtaacgttcccgggggtaccctacggtaccccgtacgttacgaggttcggacccgtaacgggtcgggttcgtagggactacggttactttccgtaactctaccacctacgtcacgacacgtccctaggacgacgacgtaagaagngtaggtacgtacgtttaagttttattagttcggaactactattaattactttataccttcctacctacgtaacggtccggttaccggacgttaaacgggtaccgtaaggttacggaaacttacgaaaacgtcgtaaggtccgagttactaaccgttaacctg

SEQ ID NO: 379131 - DNA, 775 bp, Homo sapiens
  misc_feature: GZ8MTXP01EVHK7.22.14.B03.1.454.CMB.2.raw
  modified_base (314)..(314): a, c, t, g, unknown or other
tcagacatacgcgtcacgaccggtgctcgatttagtgtgagtagttccgcggggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggagggccaccatcaactgacaagtccagccagtagtttatttttacagtcctaccaacaataagattacttagctggttaccagacaagaaaccaggacatccgtcctgcactgctntacgtttacgcgggtcgtaccgtaccccgggaagtccccgggggtccctcggaacccccgtacgtttcgaggtcggacccgtaagggtccggggtcgttagggggactaggttactttccgaccttctacccaacctatccgagaccgtacgtcccgtacggccgtagggaccgttagaaacggagttagggtacgggttactttaaagggttttttactttaaggtttaccgggtaacctaaggttaacctttaaaagtttaaattttaacgtttaacctttaccccttacccgttacggtaaacgggtttacccggtttaccgggggaaaaccccggttaaaacggggtaaaccccgggtaaaagggggttaccggttaaaaacgttaacccggaaaaacgggttaccggtaaggggttaccgggtaaacttcgggaacccttaaaccggtttaacccg

SEQ ID NO: 379132 - DNA, 637 bp, Homo sapiens
  misc_feature: GZ8MTXP01EOU3X.22.14.B03.1.454.CMB.2.raw
  modified_base (300)..(300): a, c, t, g, unknown or other
  modified_base (451)..(451): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctgtctgtgtctcgtggcgagagggccaccatcaactgacaagtccagccagtagttatttttacagtcctaccaacaataagagttactagcttggtaccagacaagaacctaggacatcgtccngcactgctactatttacgcgggtcctaccgtacccgggtaacgtcccggggtccctagtacccccgtattacgagtcggacgaagggtcgggtcgtagggacctaggtactttcactctacacagtcagcagcctagcaaggtcagaaagntcgtaggtacttaagtttattattcggactagtactaaatttacttacttacttcctaccgtagtaacggtacccgtttacgggaaacccgttaaaggggaaccctaaagggggttacttaaaaacgttcccgtaaaaaccggtacgtttgggacggtacttacggaacccttaacccggttaacg

SEQ ID NO: 379133 - DNA, 679 bp, Homo sapiens
  misc_feature: GZ8MTXP01EYZD7.22.14.B03.1.454.CMB.2.raw
  modified_base (314)..(314): a, c, t, g, unknown or other
  modified_base (441)..(441): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatcgacccagtctccagactccctggcctgtgtctcgtgggcgaggacggccaccatacaactgacaacgtccagccagtagttatttttacacgccttaccaaccaataacgtagttacttagtcgtcgtccagacaacgaaaccgagacatccgtccngcacgtgcttactactttcgcgggtccgtaccgtacccgggtacgtccccggggtcctacgtaccccgtatcaggtcggcgaacgggtcgggtcgtgggactagtcttccgactctacctactaacncgagtccgacgtcgtacgacgtagtacgtagacgtaggttcgttacgttagtttaagttttagttagttacgaactagttaattaactttaactttaccgttccgttaccctaccgtacggtaaccgtaccgggttaaccgggaaccggttaaacgggtaaaccgtaaaggttaaacgttaaacgttaaccgtaaacggtacggtcgtacggtaccgttacgtaaccgttccgtaacg

SEQ ID NO: 379134 - DNA, 514 bp, Homo sapiens
  misc_feature: GZ8MTXP01B09P0.22.14.B03.1.454.CMB.2.raw
  modified_base (402)..(403): a, c, t, g, unknown or other
  modified_base (407)..(407): a, c, t, g, unknown or other
  modified_base (411)..(411): a, c, t, g, unknown or other
  modified_base (427)..(427): a, c, t, g, unknown or other
  modified_base (430)..(430): a, c, t, g, unknown or other
  modified_base (448)..(448): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagtactagctggtcagcagaaaccaggcatcgtcctgcactgctcatttactgggcgtctacccgggaatccgggggtcccctgaccccgattcagtggcaagcgggtctgggacagatttcactctcacccatccaagcagcctgcaggnnagangtgngtagtttattattgtnagnaatatatattcctcctcncacgttcgcgaacggaacgaacggaggaacgaacaaacgaaacgtaacgtggcgcgtcgaaccaac

SEQ ID NO: 379135 - DNA, 617 bp, Homo sapiens
  misc_feature: GZ8MTXP01BV1NY.22.14.B03.1.454.CMB.2.raw
  modified_base (196)..(196): a, c, t, g, unknown or other
  modified_base (391)..(391): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagngggccaccatcaactgcaagtccagccagagttatttttacagtctaccaccaaataagtagttacttagcttggtccagcaacgaaccaggacatcgtcctgcactgctactatttacgtcgggtcgttccgtacccgggtacgtcccggggtcctcggaccccgtattcgaggtcggcgaacgggcgggtcgngggaacagtacttcgactcaccacgatccgagtacacgtccgtaggctagggtcctaggaaacgtgtggtgggtacttaggtttttaatacgtttggtacagtctaaatttactttacgttacttccctctacgtaagtaccggtttccggaacgttaaggggaccctaaagggttacgaaacttacgaaacgtacgttggtcgggacttcgaaccttccgttaac

SEQ ID NO: 379136 - DNA, 691 bp, Homo sapiens
  misc_feature: GZ8MTXP01EH5LB.22.14.B03.1.454.CMB.2.raw
  modified_base (550)..(550): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagactccctggctgtcgtctcgtgggcgagacgggccaccatcaactgacaacgtccagccaagtagtttatttttacagctaccaacaaataagtagttacttagcttcggtacagacaaagaaccgaggactagtccgtacctgactacgtctctactacgtttacgtcgggtaccgttaccggtaccccgggtaacgttcccggggtccctacggtaacccccgtacgttacgaaggtcggtaccgtacgggtcgggtcgtacggggaactagtacctttcacccttactacctaccattacgacgaacgcgtcccgttgaccggagtactaggaaagtgttagggtacgtacgggtttattttaagttattaccggtnaagtcttaaattatttactaactttcccggtaccttacgaacgttacccggttcggaacccgttaaaagggacccgtaaaagggttagttaaaacttcgtaaaaccgtagtccgttaggacttcgtcccttaaagttcccg

SEQ ID NO: 379137 - DNA, 645 bp, Homo sapiens
  misc_feature: GZ8MTXP01B8WZ1.22.14.B03.1.454.CMB.2.raw
  modified_base (310)..(310): a, c, t, g, unknown or other
  modified_base (349)..(349): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaaccaataacgagttacttagctggtccagcagaaaccaggacatcgtcctgcactgctcatttacgngggcgtcgtacccgggaatccggggtccctgaccccgtnttcgagtcggcaagggcgggtcgtggggacagtactttcactctacaccatcagcagcctgccaggctaggaaagatggtcggacgttaaggttttatttaagttcgttacaaggtacctaaatttactttaattaacctttcccttccccgttacgtaacggtaaccggttttccgggaccccgttaaaacggggtaaaccccggaaaaggggttacgggttaaaaacttaccgtaaaaaccgggtaacgttaacggttaacggggtccttaccggaacccgttaaccttaaccg

SEQ ID NO: 379138 - DNA, 619 bp, Homo sapiens
  misc_feature: GZ8MTXP01E3L29.22.14.B03.1.454.CMB.2.raw
  modified_base (261)..(261): a, c, t, g, unknown or other
  modified_base (309)..(309): a, c, t, g, unknown or other
  modified_base (458)..(458): a, c, t, g, unknown or other
tcagacatacgcgtcacgaccggtgctcgatttagtgtgagtagttccgcggggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccacaataagagttactanctgtccagcaagaaaccaggacatcgtcctgcactgctacatttacgngggcgtaccgtaccccgggaagtccccgggggtccctcggacccccgtatttcgaggtggcaaacgggccgggtcgtagggggactaaggtacttttaccaacctctaccaaccctatccagcaacgccctgccgaggcgtagaaagtntggtgcgtaagttttattagttgacaagactaaattattatacttccctcctcgaaggtaccgttcgggaacccgaaaggggaacccgtaaaaggggttacgggttaaaaacttaccggtaaaaacggacttgggtcgggacttcgaaccgaaccttaacg

SEQ ID NO: 379139 - DNA, 561 bp, Homo sapiens
  misc_feature: GZ8MTXP01BXJ2H.22.14.B03.1.454.CMB.2.raw
  modified_base (307)..(307): a, c, t, g, unknown or other
  modified_base (436)..(436): a, c, t, g, unknown or other
  modified_base (452)..(452): a, c, t, g, unknown or other
  modified_base (468)..(468): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccacatcaactgcaagtccagccagtagttatttttacagctaccaacaataagagttactagctggtcagcaagaacagacatcgtacctgcatgctacatttacgngggcgtccgtaacccgggtaacgtcccgggtcctcgaccccgattcgagtcggcgaacggtcgggtcgtaggggaaccaggtactttccaactctcaccctatacagcacgctcggcaaggctagaagngtgtgctagtttactntagtcagactaaattnttactagttccctctgaaagtccgttggaccgaaagggtaccaagggttagaaacttaccgaaagtactggtcggccttaggcttaaccgtaa

SEQ ID NO: 379140 - DNA, 737 bp, Homo sapiens
  misc_feature: GZ8MTXP01DT6IS.22.14.B03.1.454.CMB.2.raw
tcagacatacgcgtcacgaccggtgctcgatttagtgtgagtagttccgcggggagctacaacaggcaggcaggggcagcaagatggtgttgcagacccaggtcttcatttctctgttgctctggatctctggtgccgtacggggacattgtgatgacccagtctccagactccctggctgtgtctcgtggcgagacggccaccatcaactgacaagtccagaccagtagtttaatttttacagtactacccgaaacaaataagtagttaccttagtcttggtaccagacaaagaaaccgagacactcgtctgcagtgctctatttcgcgggtcgtaccgtaccggtacgtccgggtcctacgaccccgattcgaggtcggccgtaacgggccgggttcgtacgggacgtagttactttaccactactccaaaccttgccaagggccttacgacccgttggacgtaggacgttaggaaaaggtcgttaggttcgggtaattttaaagtttttaggtttaccgttaggttacccaaaggttacttaaagttttaaaactttacctttaccgggtttccccttaccggtcttaaaacgggttccccggtttacgggaaaccttaaaacggggggaaacccttaaagggggttaaaagttaaaacccttaacccggaaaaccggtttaaacgtcgggttttaaggggaaccccgtttcgaaccccgtttaaacccgtttg

SEQ ID NO: 379141 - DNA, 523 bp, Homo sapiens
  misc_feature: GZ8MTXP02GMB1I.22.14.B03.1.454.CMB.2.raw
  modified_base (307)..(307): a, c, t, g, unknown or other
  modified_base (404)..(404): a, c, t, g, unknown or other
  modified_base (446)..(446): a, c, t, g, unknown or other
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggttccagcagaaaccaggacatcgtcctgcactgctcatttacngggctctacccgggaatccggggtcctgaccccgatcagtggcagcgggtctgggacagatttcactctcaccatcagcagccctgcaggctgaagntgtggcagtttatattgtcagcaattattatattcctacctnacgtaccgttcggacctaaagggggaccaaagggtacgaaaatcgaaaacgtaactggtacggactggaccaaccta

SEQ ID NO: 379142 - DNA, 536 bp, Homo sapiens
  misc_feature: GZ8MTXP02IHHAN.22.14.B03.1.454.CMB.2.raw
  modified_base (413)..(413): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgaccccagtctccagactccctggctgtgtctctgggcgagagggccaccatcaactgcaagtccagccagagttatttttacagctccaccaataagagttactagcttggttccagcagaaaccaggacatcgtcctgcactgctcatttactgggcgtctacccgggaatcccggggtcctgaccccgattccagtggcaggcgggtcgtgggacagatttcactctcaccatcagcagcctgcaggctagaagntggtgctagttttatattgtacagactaattattaatatttcctccttacaggtacgtttaccggactaaaaggggaccaagggtacgaaatacgaaaacgactgtacggactcgacaccgta

SEQ ID NO: 379143 - DNA, 524 bp, Homo sapiens
  misc_feature: GZ8MTXP02J1BZ2.22.14.B03.1.454.CMB.2.raw
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcattactgggcgtctacccgggaatccggggtcctgaccccgattcagtgcagcgggtctgggacagattcactctcaccatcagcagccctgcaggctgaagatgtggctagtttatattgtcagctaaatattatacttcctctacgacgtacgttcggaccgaaaacgggacctaaaggtcggaaaactacgaaacgtaacgtgtcggactcggacaccta

SEQ ID NO: 379144 - DNA, 577 bp, Homo sapiens
  misc_feature: GZ8MTXP02IXJRK.22.14.B03.1.454.CMB.2.raw
  modified_base (507)..(507): a, c, t, g, unknown or other
tcagacatacgcgtcacgaccggtgctcgatttagtgtgagtagttccgcgggggagctacaagaggcaggcaggggcagcaagatggtgttgcagacccaggtcttcatttctctgttgctctggatctctggtgcctacggggacattgtgatgacccagtctccagactccctggctgtgtctctgggcgaggaggccaccatcaactgcaagtccagccagagttatttttacagctccaccaataagagttactagcttggttccagcagaaaccaggacatcgtcctgcactgctctatttacgtgggccgtccgtaccccgggaacgtccccggggtcccctcggacccccgtattccgaggtcggcgacggtcggggtccgtggggaccaggtactttccactctcacccatcagcagccctggcagggctaggaaagtgtggtggtactagtttttaatattggtacaagtctaaattatttattacttcctacctanaacgtcgttacggaccaaagggaaccaagggtagaaactacaaaacgacgtgtacggctacgacaaccta

SEQ ID NO: 379145 - DNA, 538 bp, Homo sapiens
  misc_feature: GZ8MTXP02HK91L.22.14.B03.1.454.CMB.2.raw
  modified_base (307)..(307): a, c, t, g, unknown or other
  modified_base (407)..(407): a, c, t, g, unknown or other
  modified_base (410)..(410): a, c, t, g, unknown or other
  modified_base (421)..(421): a, c, t, g, unknown or other
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggttccagcagaaaccaggacatcgtcctgcactgctcatttacngggctctaccgggaatccggggtccctgaccccgattcagtggcaggcgggtctgggacagtattcactctcaccatcagcagcctgcaggctgaaagtntgngatagtttatnttgtacagtactaattattatacttcctctacgtacgtacgttccggaccgaaacgggacctaaagggtacgaaaactaaccgaaaacgtactaggtacggactacgacctaactag

SEQ ID NO: 379146 - DNA, 519 bp, Homo sapiens
  misc_feature: GZ8MTXP02GQ92U.22.14.B03.1.454.CMB.2.raw
  modified_base (306)..(306): a, c, t, g, unknown or other
  modified_base (393)..(393): a, c, t, g, unknown or other
  modified_base (408)..(408): a, c, t, g, unknown or other
  modified_base (437)..(437): a, c, t, g, unknown or other
  modified_base (451)..(451): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccacaataagagttactagcttggtccagcagaaaccaggacatcgtcctgcactgctcatttacngggctcgtacccgggaatcccggggtccctgaccccgattcgagtggcaggcgggtctgggacagatttcactctcaccatcagcanccctgcaggctgaanatgtggctagtttatattgtcagcaaatnttatattcctcctnacgtacgttcggaccaaagggaccaaagggtagaaaatacgaaaacgacgtaggtggctcgacaccta

SEQ ID NO: 379147 - DNA, 550 bp, Homo sapiens
  misc_feature: GZ8MTXP02IYYA9.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggttccagcaagaaaccaggacatcgtcctgcactgctcattactgggctctacccgggaatcccggggtcctgaccccgattcgagtggcaggcgggtctgggacagatttcactctcaccatcagcagccctgcaggctaggaagatggtggactagttttatattgtacagactaaatattaatctttaccgtcctactacggtaccgtttcggacccgtaaaggggaaccctaagggtacgaaaactcgaaaacgtacgtggtacggcttacggcctaaccta

SEQ ID NO: 379148 - DNA, 513 bp, Homo sapiens
  misc_feature: GZ8MTXP02FJKSV.22.14.B03.1.454.CMB.2.raw
  modified_base (306)..(306): a, c, t, g, unknown or other
  modified_base (409)..(409): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccacaataagagttactagcttggtccagcagaaaccagacatcgtcctgcactgctctatttacngggctcgtacccggaagtccggggtccctgaccccgatcagtggcagcgggtctgggacagtatttcactctcaccatcagcagcctgccaggctgaagatgnggctagtttatattgcagcaatattatattcctctcagacgttcgacgtaaagggacctaaggtacgaaatacgaaaacgaacgtggacgcgtacgaccactac

SEQ ID NO: 379149 - DNA, 506 bp, Homo sapiens
  misc_feature: GZ8MTXP02GH4ZE.22.14.B03.1.454.CMB.2.raw
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggttccagcagaaaccaggacatcgtcctgcactgctcatttactgggcgtctacccgggaatccggggtccctgaccccgattcagtggcagcgggtctgggacagatttcactctcaccatcagcagccctgcaggctgaagatgtggcagtttatattgtcagcaatattatattcctctcagacgttcggccaaagggaccaaaggtgaaaatacaaaacgaactgtacggctgcaccta

SEQ ID NO: 379150 - DNA, 517 bp, Homo sapiens
  misc_feature: GZ8MTXP02JWA5A.22.14.B03.1.454.CMB.2.raw
  modified_base (399)..(399): a, c, t, g, unknown or other
  modified_base (402)..(402): a, c, t, g, unknown or other
  modified_base (404)..(404): a, c, t, g, unknown or other
tcagacatacgcgtcacgaccggtgctcgatttagtgtgagtagttccgcgggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagattactagcttggttccagcagaaaccaggaaatcgtctgcactgctcatttactgggctctacccgggaatccggggtcctgaccgattcagtgcagcgggtctggggacagatttcatctcaccatcagcagcctgcaggctgaaagntgngntagtttatattgtcagctaattattattacttcctctacagtacgttcggacgaaacgggaccaaaggtacgaaactacgaaaacgtaacgtgtacggactacgaccacatcg

SEQ ID NO: 379151 - DNA, 564 bp, Homo sapiens
  misc_feature: GZ8MTXP02HGHTT.22.14.B03.1.454.CMB.2.raw
  modified_base (308)..(308): a, c, t, g, unknown or other
  modified_base (416)..(416): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggtccagcagaaaccaggacatcgtcctgcactgctctatttacngggtctccgtacccgggaatcccggggtcctgaccccgattccagtggcaggcgggtctggggacaggtatttcactctcaccatcagcagccctgccaggctagaantggtggactagttttatagttgacagactaaattattaattacttcccgtactacgaagtaccgttcggaccaaaggggtaaccctaagggtaggaaaaacttccgaaaaacggtaacttacgggtacgacctacgacctaacgtacg

SEQ ID NO: 379152 - DNA, 561 bp, Homo sapiens
  misc_feature: GZ8MTXP02F8S2Q.22.14.B03.1.454.CMB.2.raw
  modified_base (310)..(310): a, c, t, g, unknown or other
  modified_base (415)..(415): a, c, t, g, unknown or other
  modified_base (419)..(419): a, c, t, g, unknown or other
  modified_base (439)..(439): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggttccagcaagaaaccaggacatcgtcctgcactgctcatttacgngggcgtcgtacccgggaatccggggtccctgaccccgattcagtggcaggcgggtctgggacagtatttcactctcacccatcagcacgccctgcagctagaagntggngctagtttatattgtacagnaaattattatacttcctctctaagtaccgttacggacccgtaaaagggggaccctaaaggggttacgaaaaacttaccgaaaaacggtaaccgttggtacggaccttaggaccaaccttacg

SEQ ID NO: 379153 - DNA, 515 bp, Homo sapiens
  misc_feature: GZ8MTXP02JEFIZ.22.14.B03.1.454.CMB.2.raw
  modified_base (404)..(404): a, c, t, g, unknown or other
  modified_base (407)..(407): a, c, t, g, unknown or other
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggcgtctacccgggatccggggtcctgaccccgattcagtgcagcgggtctgggacagatttcactctcaccatcagcagccctgcaggctgagntgnggctagtttattattgtcagcaattattatattcctctcacgtacgttcggcctaaagggaccaagggtacgaaatccaaaacggaactgtacggctacggacaccta

SEQ ID NO: 379154 - DNA, 535 bp, Homo sapiens
  misc_feature: GZ8MTXP02I4CGF.22.14.B03.1.454.CMB.2.raw
  modified_base (364)..(364): a, c, t, g, unknown or other
  modified_base (411)..(411): a, c, t, g, unknown or other
  modified_base (414)..(414): a, c, t, g, unknown or other
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggcgtctaccccgggaatcccggggtccctgaccccgattcagtggcagcgggtntggggacagatttcactctcaccatcagcagcctgccaggctgaagntgngctagtttatattgtacagactaattattatacttccctctacgtacgtaccgttcggaaccgaaagggaccaagggtaacgaaactacgaaaacgtacgtaggtcgactacgacaaccta

SEQ ID NO: 379155 - DNA, 508 bp, Homo sapiens
  misc_feature: GZ8MTXP02F0SRD.22.14.B03.1.454.CMB.2.raw
  modified_base (307)..(307): a, c, t, g, unknown or other
  modified_base (409)..(409): a, c, t, g, unknown or other
  modified_base (445)..(445): a, c, t, g, unknown or other
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggttccagcagaaaccaggacatcgtcctgcactgctcatttacngggcgtctacccgggaatccggggtccctgaccccgattcagtggcagcgggtctgggacagattcactctcaccatcagcagccctgcaggctgaagatgngctagtttatattgcagcaattattatattctcctntacgtacgttcggaccaaagggaccaaggtagaaatacgaaagaactgtacggctacgcacta

SEQ ID NO: 379156 - DNA, 502 bp, Homo sapiens
  misc_feature: GZ8MTXP02HSXTL.22.14.B03.1.454.CMB.2.raw
  modified_base (305)..(305): a, c, t, g, unknown or other
  modified_base (429)..(429): a, c, t, g, unknown or other
  modified_base (495)..(495): a, c, t, g, unknown or other
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacgggacattgtgatgacccagtctccagactccctggctgtgtctctgggcgagagggccaccatcaactgcaagtccagccagagtatttttacagctccaccaataagagttactagcttggtccagcagaaaccaggacatcgtcctgcactgctcatttacngggcgtctaccgggaaatcccggggtccctgaccccgattcagtggcagcgggtctggggacagatttcactctcaccatcagcagcctgcaggctgaagatgtggcagttttatattgtcagnaatatataatctctcacagttcgcaacggaccgaacgtagaaagtacaaacgaaacagtaggctcncaccaac

SEQ ID NO: 379157 - DNA, 571 bp, Homo sapiens
  misc_feature: GZ8MTXP02H08JH.22.14.B03.1.454.CMB.2.raw
  modified_base (309)..(309): a, c, t, g, unknown or other
  modified_base (376)..(376): a, c, t, g, unknown or other
  modified_base (412)..(412): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgaccccagtctccagactccctggctgtgtctctgggcgagagggccaccatcaactgcaagtccagccagagttatttttacagctccaccaataagagttactagcttggtccagcagaaaccaggacatcgtcctgcactgctcatttacngggcgtctaccccgggaatcccggggtcctgaccccgattcgagtggcaggcgggtctgggacagtntttcactctcaccatcagcagccctgcaggctgaanatggtggctagtttttatagttgtacagtacaaatttattaattacttccctcttacacgtaccggtttcggaccctaaaaggggtaaaccctaagggtacggtaaaattacccgaaaaaccgtaacgttggtacggacttacggaccaacccttaacg

SEQ ID NO: 379158 - DNA, 539 bp, Homo sapiens
  misc_feature: GZ8MTXP02G7X94.22.14.B03.1.454.CMB.2.raw
  modified_base (383)..(383): a, c, t, g, unknown or other
  modified_base (406)..(406): a, c, t, g, unknown or other
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggttccagcagaaaccaggacatcgtcctgcactgctcatttactgggcgtctacccgggaatccggggtccctgaccccgatcagtggcagcgggtctgggacagatttcactctcaccntcagcagcctgcaggctgaaagntgtgatagtttatattgtacagtactaattattatacttccgtactacgtaacgtaccggttacggaccgtaaagggaaccgtaagggtaacgaaaactacgaaaacgtacgtaggtacgactcgaccacgta

SEQ ID NO: 379159 - DNA, 523 bp, Homo sapiens
  misc_feature: GZ8MTXP02JE649.22.14.B03.1.454.CMB.2.raw
  modified_base (301)..(301): a, c, t, g, unknown or other
  modified_base (407)..(407): a, c, t, g, unknown or other
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctnattactgggctctacccgggaatccggggtccctgaccccgattcagtggcagcgggtctgggacagatttcactctcaccatcagcagcctgcagctgaagatgnggctagtttatattgtacagtacaattattatattccctctctaggtaccgttcggacctaaaggggaccaagggtacgaaaactacgaaaacgaactggtacggctagaccacta

SEQ ID NO: 379160 - DNA, 566 bp, Homo sapiens
  misc_feature: GZ8MTXP02HJBYS.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtctgcactgctcatttactgggcgtctacccgggaatccggggtcctgaccccgattcagtggcaggcgggtctgggacagactttcactctcaccatcagcagccctgccaggctgagatgtggctaggttttattattgtacagtacaaattatttattaactttccctacccttcgtaacgtaccggtttcggacccgtaaacggggaccctaaagggtacggaaaacttacgaaaaacggtaccttaggtacggcttacggacaacccttaag

SEQ ID NO: 379161 - DNA, 536 bp, Homo sapiens
  misc_feature: GZ8MTXP02HMGSB.22.14.B03.1.454.CMB.2.raw
  modified_base (305)..(305): a, c, t, g, unknown or other
  modified_base (406)..(406): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttactagcttggtccagcagaaccagacatcgtctgcactgctcatttacngggctctacccgggaatccggggtccctgaccccgattcagtgcagcgggtcgtgggacagtatttcactctcacatcagcagcctgcctaggctagaagntgtggctagttttatattgcagctaatacttatacttccctactcagtacgttcggacctaaaggggaccctaaggggtacgaaaacttacgaaaaacggtactaggtacggacttacggacctaactac

SEQ ID NO: 379162 - DNA, 559 bp, Homo sapiens
  misc_feature: GZ8MTXP02I6RS5.22.14.B03.1.454.CMB.2.raw
  modified_base (412)..(412): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttactagcttggttccagcagaaaccaggacatcgtcctgcactgctcattactgggcgtctacccgggaatccggggtcctgaccccgattcgagtggcaggcgggtcgtgggacagatttcactctcaccatcagcacgcctagcaggctagaagntgtggctagtttatattgtacagtctaatattaatcttcctcctacacgtacgtttcggaccgaaaaggggtaccctaaaggggtacggtaaaacttacgaaaaaccggtaaactcggtacggtacctacggtaccaacccttaacg

SEQ ID NO: 379163 - DNA, 552 bp, Homo sapiens
  misc_feature: GZ8MTXP02G4E46.22.14.B03.1.454.CMB.2.raw
  modified_base (385)..(385): a, c, t, g, unknown or other
  modified_base (407)..(407): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggttccagcagaaaccaggacatcgtcctgcactgctcatttactgggcctctacccgggaatccggggtccctgaccccgattcagtggcagcgggtctgggacagtattcactctcaccntcagcagcctgcaggctgaagntgtggctagttttatattgtacagtacaaattattatattccgtctactacggtaccgtttcgggaccctaaagggggaccctaaaggggtacgaaaattaccgaaaacgtaaaccttggtacgggacttacggaccaccgtaac

SEQ ID NO: 379164 - DNA, 549 bp, Homo sapiens
  misc_feature: GZ8MTXP02HGRGY.22.14.B03.1.454.CMB.2.raw
  modified_base (311)..(311): a, c, t, g, unknown or other
  modified_base (441)..(441): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttactagcttggttccagcaagaaaccaggacatcgcctgcactgctctaatttacngggtccgtcgtacccgggaagtcccggggtccctggaccccgattcgagtggcaggcgggtctgggacagtactttcactctacactatcagcagccctgccaggctagaagagtgtggactagtttatnttgtcaagtctaaattattatacttccctactcaacgtacggttcggaccaaaggggaccaaaggtacggaaactaccgaaaacgtacgtagtcggactagaccacta

SEQ ID NO: 379165 - DNA, 543 bp, Homo sapiens
  misc_feature: GZ8MTXP02JGYLT.22.14.B03.1.454.CMB.2.raw
  modified_base (413)..(413): a, c, t, g, unknown or other
  modified_base (417)..(417): a, c, t, g, unknown or other
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggcgtctaccccgggaatcccggggtcctgaccccgattcagtggcagcgggtcgtgggacagtatttcactctcaccatccagcagccctgcaggctagaagntggnggctagttttatattgtacagctaaattattatacttcctctactagtaccggttcggaccctaaagggaccctaaggttacggaaaattaccgaaaacgtactggtacggactcggaccacctac

SEQ ID NO: 379166 - DNA, 514 bp, Homo sapiens
  misc_feature: GZ8MTXP02JZ57P.22.14.B03.1.454.CMB.2.raw
  modified_base (309)..(309): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttacngggctctacccggaatccggggtccctgaccccgatcagtggcagcgggtctgggacagtattcactctcaccatcagcagccctgcaggctagagatggtgctagtttattattgtacagctaaatattatattcctctcacgtacgttcggaccaaagggaccaaagggtcgaaaatacaaacgaactgtacggctgcaccta

SEQ ID NO: 379167 - DNA, 501 bp, Homo sapiens
  misc_feature: GZ8MTXP02IJGC3.22.14.B03.1.454.CMB.2.raw
tcagacatacgcgtcacgaccggtgctcgatttagtgtgagtagttccgcgggggagctacaacaggcaggcaggggcagcaagatggtgttgcacacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggttccagcagaaaccaggacatcgtcctgcactgctcatttactgggctctacccgggaatccggggtcctgaccccgattcagtgcagcgggtctgggacagatttcactctcaccatcagcagcctgcaggctgaagatgtggcagtttatattgtcagcaatattatattcctctcagacgttcggctaaagggaccaaggtacggaaatacaaacgaactgtaggctgcacta

SEQ ID NO: 379168 - DNA, 559 bp, Homo sapiens
  misc_feature: GZ8MTXP02JRF5F.22.14.B03.1.454.CMB.2.raw
  modified_base (406)..(406): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggttccagcagaaccaggacatcgtcctgcactgctcatttactgggctctacccgggaatccggggtccctgaccccgattcagtggcaggcgggtctgggacagtattcactctcaccatcagcagccctgcaggctgaanatgtgctagtttattatgtacagactaattacttatacttcctcctctacgtacggttcggaccgtaaacggggaccctaaaaggggtacgtaaaactaccgaaaaacggtaaccgttacggtagggtacccttacggacctaaccgttaacg

SEQ ID NO: 379169 - DNA, 527 bp, Homo sapiens
  misc_feature: GZ8MTXP02G2H0T.22.14.B03.1.454.CMB.2.raw
  modified_base (305)..(305): a, c, t, g, unknown or other
  modified_base (379)..(379): a, c, t, g, unknown or other
  modified_base (402)..(402): a, c, t, g, unknown or other
  modified_base (405)..(405): a, c, t, g, unknown or other
  modified_base (416)..(416): a, c, t, g, unknown or other
tcagacatacgcgtcacgaccggtgctcgatttagtgtgagtagttccgcggggagctacaacaggcaggcagggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccataagagttactagcttggttccagcagaaaccaggacatcgtcctgcactgctcatttacngggcgtcacccgggaatccggggcctgccccgattcagtggcagcgggtctggggacagatttcgactctcacntcagcagcctagcaggctgaagntgngatagtttatnttgcagctaaattattacttattcctctacgtacgtacgtcggacgaaacgggtacgtaaggtacggaaactacgaaaacgtacgtggtacggactacggacctaactacg

SEQ ID NO: 379170 - DNA, 500 bp, Homo sapiens
  misc_feature: GZ8MTXP02FJYNG.22.14.B03.1.454.CMB.2.raw
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggttccagcagaaaccaggacatcgtcctgcactgctcatttactgggctctacccgggaatccggggtccctgaccccgattcagtggcagcgggtctgggacagatttcactatcaccatcagcagcctgcaggctgaagatgtggctagtttattattgtcagcaatattatattcctctcagtacgttcggccaaagggaccaaggtgaaatcaaacgactgtagctgcactac

SEQ ID NO: 379171 - DNA, 558 bp, Homo sapiens
  misc_feature: GZ8MTXP02JYF1W.22.14.B03.1.454.CMB.2.raw
  modified_base (317)..(317): a, c, t, g, unknown or other
  modified_base (371)..(371): a, c, t, g, unknown or other
  modified_base (399)..(399): a, c, t, g, unknown or other
  modified_base (403)..(403): a, c, t, g, unknown or other
  modified_base (407)..(407): a, c, t, g, unknown or other
tcagacatacgcgtcacgaccggtgctcgatttagtgtgagtagttccggcgggggagctacaacaggcaggcaggggcagcaagatggtgttgcagacccaggtcttcatttctctgttgctctggatctctggtgccgtacggggacattgtgatgacccagtctccagacctccctggctgtgtctctggggcgagagggccaccatcaactgcaagtccagccagagttatttttacagctccacaataagagttactagcttggttccagcaagaaaccaggactagtcgtcctgcactgctctatttacgngggcgtctacccgggaatccggggtcctgaccccgattcagtgcaggcgggtcngggacagatttcacgttcacaccatcgngccncgcncgcgacgcgagagagtgtgtagtagtttattagttagtagtacgtactaattattattacttacctctactacgtacgtacggaccggaacggaacgaacggtacgtaaacgtaacgaaacgaacgtacgtacggtacgtacgacgactac

SEQ ID NO: 379172 - DNA, 549 bp, Homo sapiens
  misc_feature: GZ8MTXP02I06G0.22.14.B03.1.454.CMB.2.raw
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagtatttttacagctccaccaataagagttacttagcttggttccagcaagaaaccaggacatcgtcctgcactgctcatttactgggctctacccgggatccggggtcctgacccgatcagtgcagcggtcgtgggacagattcactctcacatcagcagcctgccaggctagacgatgtggctagtttattattgtaccagtcaattatttaatactttccctcctacaacggtacgtttccgggaccgaaaggggaccctaaaggggttacggaaaattaccgaaaacgtaacgttaggttacggacttcggacctaacctag

SEQ ID NO: 379173 - DNA, 678 bp, Homo sapiens
  misc_feature: GZ8MTXP02J4W5Y.22.14.B03.1.454.CMB.2.raw
  modified_base (452)..(452): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggacggccaccatcaactgcaagtccagccagtagttatttttacagcctaccaacctaaataagtagttacttagcgttggtaccagacaagaaccaggacatcgtcctgcactgctactacgtttaccgcgggtccgttccgtaaccccgggtaacgttccccgggggtccctacggaccccgtacgttcgaggttcggcgacgggtcggggtcgtaggggaactagtactttccaacttcctccaaccctaacncgacgacgacgcgacgacgacggtacgtaggtagtagttaggtaggttacgttagtttagtttagttacgtacgtaacgtacttaacttaacttaacttaccttacccgtaccgtaccgtaccggtaccggtaccggtaaccggtaaacggtaaacggtaacggtaaacgtaaacgtaaaccgtaaaccgtaacgtacggtacgtaccgtaccgtacctacctacg

SEQ ID NO: 379174 - DNA, 540 bp, Homo sapiens
  misc_feature: GZ8MTXP02HZV2A.22.14.B03.1.454.CMB.2.raw
  modified_base (307)..(307): a, c, t, g, unknown or other
  modified_base (412)..(412): a, c, t, g, unknown or other
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttactagcttggtccagcagaaaccaggacatcgtcctgcactgctcatttacngggctctaccgggaatccggggtcctgaccccgattcagtggcaggcgggtctgggacagtatttcactctcaccatcagcagccctgcaggctagagatgtggntaggtttatattgtacagacaattattatacttcctcctactagtaccgtttcggacctaaaggggaccctaaagggtaggtaaaataccgaaaaacggtacctaggtcggactacggacaccctaag

SEQ ID NO: 379175 - DNA, 519 bp, Homo sapiens
  misc_feature: GZ8MTXP02GSWAM.22.14.B03.1.454.CMB.2.raw
  modified_base (307)..(307): a, c, t, g, unknown or other
  modified_base (406)..(406): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggtccagcagaaaccaggacatcgtcctgcactgctcatttacngggctctacccgggaatccggggtcctgaccccgattcagtggcagcgggtctgggacagattcactctcacatcagcagccctgcaggctgaagatgngctagtttatattgtcagcaatattatacttcctactctagacgttcggacctaaagggaccaaagggtacggaaaatccgaaaacgactaggtacggctaggaccaacctag

SEQ ID NO: 379176 - DNA, 527 bp, Homo sapiens
  misc_feature: GZ8MTXP02IP7Y6.22.14.B03.1.454.CMB.2.raw
  modified_base (386)..(386): a, c, t, g, unknown or other
  modified_base (407)..(407): a, c, t, g, unknown or other
  modified_base (457)..(457): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttattttacagctccaccaataagattactagcttggtccagcagaaaccaggacatcgtcctgcactgctcattacgtgggctcgtacccggaagtcccggggtcctgaccccgtatcaggtggcaggcgggtctgggacagtacttcactctcaccntcagcagcctgcagctagaanatggtgctagttttatagttgacagactaattattatactttccacctanacgtacgttccggacaaagggaccaagggtagaaactacgaaaacgtactaggtacggactcgacaccta

SEQ ID NO: 379177 - DNA, 535 bp, Homo sapiens
  misc_feature: GZ8MTXP02FZCER.22.14.B03.1.454.CMB.2.raw
  modified_base (308)..(308): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggttccagcagaaaccaggacatcgtcctgcactgctcatttacngggcgtcgtacccgggaatccggggtccctgaccccgattcagtggcagcgggtctgggacagatttcactctcaccatcagcagcctgcaggctagaagatgtggctagttttattattgtcagctaaattattatactttcctctcagtaccgttcggccgtaaagggaccaagggttacggaaaacttacgaaaacgactaggtacggctacggaccacctacg

SEQ ID NO: 379178 - DNA, 516 bp, Homo sapiens
  misc_feature: GZ8MTXP02IN6VV.22.14.B03.1.454.CMB.2.raw
  modified_base (308)..(308): a, c, t, g, unknown or other
  modified_base (405)..(405): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggttccagcagaaaccaggacatcgtcctgcactgctcatttacngggctctacccgggatccggggtcctgacccgattcagtggcaggcgggtcgtgggacagtatttcactctcacatcagcagcctgcaggctgaagntgtggactagtttatattgtacagcaattattaatacttcctcctcacgtaccgttacggaccgtaaagggaccaaggtagaaactacaaaacgtactgtggctgacacta

SEQ ID NO: 379179 - DNA, 516 bp, Homo sapiens
  misc_feature: GZ8MTXP02GKFUE.22.14.B03.1.454.CMB.2.raw
  modified_base (385)..(385): a, c, t, g, unknown or other
  modified_base (398)..(398): a, c, t, g, unknown or other
  modified_base (400)..(400): a, c, t, g, unknown or other
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagtatttttacagctccacaataagagtactagctggttccagcagaaaccaggacatcgtcctgcactgctctattactgggcctcgtacccggaatccggggtcctcgacccgatcagtgcagcggtctgggacagattcactctcacatcagcagcctncagctgaagatgngntagtttatatgtcagcaatattatacttcctctacacgtaacgttcgacccgtaaaggaaccaaggtacgaaaatacgaaaaaccgtatacgtaggacctaggacctaacctaacg

SEQ ID NO: 379180 - DNA, 549 bp, Homo sapiens
  misc_feature: GZ8MTXP02F8CVA.22.14.B03.1.454.CMB.2.raw
  modified_base (294)..(294): a, c, t, g, unknown or other
  modified_base (303)..(303): a, c, t, g, unknown or other
  modified_base (312)..(312): a, c, t, g, unknown or other
  modified_base (425)..(425): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagtagtatttttacagctaccaccaataagagttacttagcttggtccagcagaaaccaggacatcgtccngcactgctntatttacgngggccgtccgtacccgggaatccggggtccctgaccccgtattccaggtcggcgacggcgggtcgtgggacagtatttcactctacaccatcagcacgctagcagctagaagntggtgacttagtttattagttgtatacgataattacttattacttcctctctacgtacgttcgaccgaaagggacctaaggtagaaactacgaaaacgtacgtgtacggctacgacctactacg

SEQ ID NO: 379181 - DNA, 562 bp, Homo sapiens
  misc_feature: GZ8MTXP02H0UKC.22.14.B03.1.454.CMB.2.raw
  modified_base (305)..(305): a, c, t, g, unknown or other
  modified_base (332)..(332): a, c, t, g, unknown or other
  modified_base (394)..(394): a, c, t, g, unknown or other
  modified_base (433)..(433): a, c, t, g, unknown or other
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctcaccaataagagttactagcttgtccagcagaaaccagacatcgtcctgcactgctcatttacgngggctcgaccgggaactccggggtccngaccccgattcagtggcaggcgggtcgtgggacagtatttcactctcacatcagcagcccgngcgagcagagtagtgtagtattagtttattagttcgtanagtactaaattattacttacttccctactacgtacgtaccgttaccggaaccgtaaacgggaaccgtaaagggtaacgaaaacgtaaaccgaaaacgtaacgtacggtacgacgtacgaccaacctacg

SEQ ID NO: 379182 - DNA, 514 bp, Homo sapiens
  misc_feature: GZ8MTXP02FXJJN.22.14.B03.1.454.CMB.2.raw
  modified_base (449)..(449): a, c, t, g, unknown or other
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggttccagcagaaaccaggacatcgtcctgcactgctcatttactgggctcgtacccgggaatccggggtcctgaccccgattcagtgcagcggggtctgggacagatttcactctcaccatcagcagcctgcaggctgaagatgtggctagtttattattgtacagctaattattatattcctctnacgtacgttcggaccaaagggaccaagggtacgaaatacaaaacgactagtacggctagacacta

SEQ ID NO: 379183 - DNA, 586 bp, Homo sapiens
  misc_feature: GZ8MTXP02HRON9.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggtccagcagaaaccaggacatcgtcctgcactgctcatttacgtgggcgtaccgtacccgggaagtcccggggtcctcgaccccgatcgagtcggcacggcgggtcgtggggacagtactttcactctccaccatcagcagcctgcaggctagaagatggtggtctagttttattattgtacagtactaaattattaactacttccgtcttacgaacgtaccggtttcggaaccgtaaaacggggacctaaaggggtacgtaaaacgtaccgtaaaaaccggtaacgttaggttacgggacttacggaccctaacgtaaccg

SEQ ID NO: 379184 - DNA, 593 bp, Homo sapiens
  misc_feature: GZ8MTXP02HATYK.22.14.B03.1.454.CMB.2.raw
  modified_base (309)..(309): a, c, t, g, unknown or other
  modified_base (429)..(429): a, c, t, g, unknown or other
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagacctccctggctgtgtctcgtgggcgaggagggccaccatcaactgacaagtccagccagagttatttttacagtctaccaaccaataagtagttactagcttggttccagcaagaaaccagacatcgtcctgcactgctntattacgtcgggcctcgtaccccgggaagtccccggggtcctgaccccgtattcaggtcgcaggcgggtcgtggggactagtatttccactctacaccctatcaagcagcccgtgaccgngacgtagagtagtaggtggtacgttagtttagttagttacgtagtagtataattaattaacttacttacctcctactacgtacgtaccggtacgaacggtaacggtaacggtaacgtaaacgtaaacgtaaacgtaacgtacgtacggtacgtacgaccactac

SEQ ID NO: 379185 - DNA, 521 bp, Homo sapiens
  misc_feature: GZ8MTXP02H0NE0.22.14.B03.1.454.CMB.2.raw
  modified_base (408)..(408): a, c, t, g, unknown or other
  modified_base (434)..(434): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctcaccaataagagttactagcttggttccagcagaaaccaggacatcgtcctgcactgctcatttactgggcgtctacccgggaatccggggtccctgaccccgattccagtggcagcgggtctgggacagatttcactctcaccatcagcagcctgcaggctgaaagntgtggctagttttatattgtacaganaatatattaattctctctacgacgtcggtacgaacggaaccgaacgtacggaaagtacaaacgaacgtacgtaggacgcgacacaac

SEQ ID NO: 379186 - DNA, 585 bp, Homo sapiens
  misc_feature: GZ8MTXP02H602E.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttactagcttggtccagcagaaaccaggacatcgtcctgcactgctcatttactgggccgtcgtacccgggaatccggggtccctgacccgattcagtggcaggcgggtctggggacaggtatttcactctcacccatcagcagcctgcaggctaggagtatggtaggctaaggtttttaatagttgtacagtactaattattaacttacttcctacctcgtaacgtaaccgtttccggaccaaaaggggtaccctaaaaggggttaccggaaaaattacccgaaaaacgggtaacctagggttaacggctaacggacctaacccgtaacg

SEQ ID NO: 379187 - DNA, 620 bp, Homo sapiens
  misc_feature: GZ8MTXP02IJUDO.22.14.B03.1.454.CMB.2.raw
  modified_base (402)..(402): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttactagcttggttccagcaagaaaccaggacatcgtcctgcactgctctatttactgggcgtccgtacccgggaagtcccggggtcctcgaccccgtattccgagtcggcaggcgggtcgtgggacagtactttcactctcacctanccagcacgcccgtgccagggcctaggaaacgagtgggtaggacttaaggttttttaatagtttaggtacaagacctaaaatttatttaacttactttcccgtacctacgtacggtaaccgtttccgggacctaaaaagggggtacccctaaaggggtaacgtaaaacttaccgaaaaaacggtaacgttcggtacggacctttacggacctaacctag

SEQ ID NO: 379188 - DNA, 536 bp, Homo sapiens
  misc_feature: GZ8MTXP02I98SK.22.14.B03.1.454.CMB.2.raw
  modified_base (412)..(412): a, c, t, g, unknown or other
  modified_base (416)..(416): a, c, t, g, unknown or other
  modified_base (438)..(438): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggtccagcagaaacaggacatcgtcctgcactgctctatttactgggcgtctacccgggaatcccggggtcctgaccccgattcagtggcaggcgggtctgggacaggtatttcacgtctcaccatcagcagccctgcaggctagaagngtgngtacttaagtttatagttgtanagtactaattattatacttcctctactacgtacgtcgacgaacggaacgtaaggtacgaaacacgaaaacgtacgtacggtacgctacgaccactacg

SEQ ID NO: 379189 - DNA, 533 bp, Homo sapiens
  misc_feature: GZ8MTXP02JZH5Z.22.14.B03.1.454.CMB.2.raw
  modified_base (424)..(424): a, c, t, g, unknown or other
  modified_base (440)..(440): a, c, t, g, unknown or other
  modified_base (455)..(455): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagattacttagcttggttccagcagaaaccaggacatcgtcctgcactgctcattactgggcgtctaccgggaatccggggtcctgacccgtatcgagtggcaggcgggtctgggacagtatttcactctcacccatcagcagccctgcaggctagagatggtggctagtttatnttgtacagctaaattnttatacttcctcctnacgtacgttcggaccgtaaagggcctaaaggtcggaaaactacgaaaacgtaacgtggtacggactcgacctactacg

SEQ ID NO: 379190 - DNA, 529 bp, Homo sapiens
  misc_feature: GZ8MTXP02G3FF9.22.14.B03.1.454.CMB.2.raw
  modified_base (417)..(417): a, c, t, g, unknown or other
  modified_base (422)..(422): a, c, t, g, unknown or other
  modified_base (437)..(437): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttactagcttgtccagcagaaaccaggacatcgtctgcactgctctattacgtgggcgtcgtaacccgggaatcccggggtcctgaccccgtattcagtggcaggcgggtcgtgggacagtactttcgactctcaccatcagcagccctgccaggctagaagntgcgntagtttatgttgcanactaattatatacttctctatacgtaccgttcggaccgtaaaggacctaaaggtacgaaaactacgaaaacgattggacgacctgaccacta

SEQ ID NO: 379191 - DNA, 572 bp, Homo sapiens
  misc_feature: GZ8MTXP02G9V3E.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagtactagctgttctagcagaaaccaggacatacgtcctgcactgctctattactgggcgtcgtaccccgggaacgtccggggtcccgtcgacccgacttctagtggtcgaggtcggggtcgtgggacgacggtactttctactcttccacccaattcagcagtccctgcgacggctagaagatgtggctaggtttatattgtcagtactaattattatacttcctcactagaccgtttcggacctaaagggcctaaaagggtcggtaaaataaccgaaaacgaaaccgttggtacgggtacctaggaccaacccgttaag

SEQ ID NO: 379192 - DNA, 518 bp, Homo sapiens
  misc_feature: GZ8MTXP02IQMO6.22.14.B03.1.454.CMB.2.raw
  modified_base (406)..(406): a, c, t, g, unknown or other
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgaccccagtctccagactccctggctgtgtctctgggcgagagggccaccatcaactgcaagtccagccagagtatttttacagctccaccaataagagttactagcttggttccagcagaaaccaggacatcgtcctgcactgctcatttactgggcgtctacccgggaatccggggtcctgacccgattcagtggcagcgggtctgggacagatttcactctcaccatcagcagccctgccaggctgaanatgtggctagttttattattgtacagacaattattatacttcctctcacgtacgttcggaccgtaaagggaccaagggtagaaatacaaaacgaactgtacggctgacacta

SEQ ID NO: 379193 - DNA, 561 bp, Homo sapiens
  misc_feature: GZ8MTXP02G5AG2.22.14.B03.1.454.CMB.2.raw
  modified_base (309)..(309): a, c, t, g, unknown or other
  modified_base (347)..(347): a, c, t, g, unknown or other
  modified_base (388)..(388): a, c, t, g, unknown or other
  modified_base (435)..(435): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggttccagcagaaaccaggacatcgtcctgcactgctctatttacngggtctcgtacccgggaatcccggggtcctgacccgtnttcagtggcaggcgggtctgggacagatttcactctcaccntcagcagcctgccaggctagagatgtggactaggtttatattggtanagtctaaattatttatactttaccctcgttacaacggtaccggtttacggacccgtaaaggggtacccaaagggttaccggaaaattcgaaaaccgtaactgggttacggactacggacaccgtag

SEQ ID NO: 379194 - DNA, 546 bp, Homo sapiens
  misc_feature: GZ8MTXP02F16UZ.22.14.B03.1.454.CMB.2.raw
  modified_base (425)..(425): a, c, t, g, unknown or other
  modified_base (431)..(431): a, c, t, g, unknown or other
  modified_base (441)..(441): a, c, t, g, unknown or other
  modified_base (448)..(448): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggttccagcagaaaccaggacatcgtcctgcactgcctctatttacgtcgggcgtccgtaacccgggaacgtcccggggtccctcggaccccgtattccagtcggcgaggcgggtcgtgggacagtattcactctcaccatccagcagcctgcagctagaantggtgnttagtttatntgtcagntaattattatacttcctactacagtccgttcggaccgtaaaggacctaaggtaacgaactaacgaaaacgtacgtagtcggactacggacctactacg

SEQ ID NO: 379195 - DNA, 524 bp, Homo sapiens
  misc_feature: GZ8MTXP02JHNRV.22.14.B03.1.454.CMB.2.raw
  modified_base (345)..(345): a, c, t, g, unknown or other
  modified_base (374)..(374): a, c, t, g, unknown or other
  modified_base (410)..(410): a, c, t, g, unknown or other
  modified_base (413)..(413): a, c, t, g, unknown or other
  modified_base (416)..(416): a, c, t, g, unknown or other
  modified_base (440)..(440): a, c, t, g, unknown or other
  modified_base (454)..(454): a, c, t, g, unknown or other
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttactagcttggtccagcagaaaccaggacatcgtcctgcactgctcatttactgggctcgtacccgggaatcccggggtccctgaccccgnttcagtggcaggcgggtctggggacagtntttcactctcaccatcagcagcctgcagctagaagntgnggntagtttatattgtacagctaattnttatattcctactntacgtacgttcgacaagggaccaagggttacgaaatacgaaacgtactagtcggactacggacctacgta

SEQ ID NO: 379196 - DNA, 757 bp, Homo sapiens
  misc_feature: GZ8MTXP02J0PLX.22.14.B03.1.454.CMB.2.raw
  modified_base (491)..(491): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagactccctggctgtgtctcgtgggcgaggacggccaccatacaactgacaagtccagcctagtagttattttacacgtcctaccaactaataagtacgttacttagtcgttaggtccagaccgaacgaaaccgaggtactacgttccggtacctcgacctactcgtccttacgttacgtttaccggtcggggtcccgttacccggtaacccggggtaaccgttccccggggtacccctacggtaccccccgtagttcgaggttcggacggtacgggtcggggtcgacggggtactaggttacttacctactctaccacctanaccacggtcacggtcccgaggaccgaggtactagggaaacgtggttggtagtagtttaaacggtttatacgttacggtaaccaagtaacctttaaaatttacttaaacctttccctttacccgttacccgtaaacggttaccgggtaaacccggggttaccgaaacccgggtaaaccggggtaaaccgttaaagggtaaacgtaaaaccgttaaaccgaaacggtaccggttggaccggtacctaccggtaacctacgtttaaccg

SEQ ID NO: 379197 - DNA, 588 bp, Homo sapiens
  misc_feature: GZ8MTXP02HP9KF.22.14.B03.1.454.CMB.2.raw
  modified_base (316)..(316): a, c, t, g, unknown or other
  modified_base (406)..(406): a, c, t, g, unknown or other
  modified_base (469)..(469): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactcccctggctgtgtctctgggcgagagggccaccatcaactgcaagtccagccagagttatttttacagtctccaccaataagagttactagcttggttccagacaagaaaccaggacatcgtcctgcactgcctctatttacgngggtccgtcgtaccggacgtcccgggtcctcgacccgtcttcgagtgcgacgcgggtcgtgggacagtacttcactctaccactatcaancagccctagcgaggtctagaagattggtcgtagtagtttttaatgtttgacagactaaatttnttaattacttccctactacgtacgtaaccggtttccggaaaccgtaaacgggaaccgtaaaggtacggtaaaactacgaaaaccggtaactgggttacggaccgtcgacctaactaacc

SEQ ID NO: 379198 - DNA, 579 bp, Homo sapiens
  misc_feature: GZ8MTXP02IBPLW.22.14.B03.1.454.CMB.2.raw
  modified_base (375)..(375): a, c, t, g, unknown or other
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgaccccagtctccagactcccctggctgtgtctctgggcgagagggccaccatcaactgcaagtccagccagagtatttttacagctccaccaataagagttactagcttggtccagcagaaaccaggacatcgtcctgcactgctcatttactgggccgtctacccgggaatcccggggtccctgaccccgattcgagtggcagcgtgtctgggacagtntttcactctcacatcagcagcctgcaggctagaagatgtggctagtttattatgtcagtctaaattattatacgtttccctaccttcgacgtacgtttccgggaacccgtaaaacggggtaacccgaaaagggtttacggaaaaacgttaacccgaaaaacggtaaaccgttgggtaacgggacctttacggaccctaaacccg

SEQ ID NO: 379199 - DNA, 574 bp, Homo sapiens
  misc_feature: GZ8MTXP02IMQOS.22.14.B03.1.454.CMB.2.raw
  modified_base (384)..(384): a, c, t, g, unknown or other
  modified_base (406)..(406): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggttccagcagaaaccaggacatcgtcctgcactgctcatttactgggcgtctacccgggaatccggggtcctgaccccgattcagtggcagcgggtctgggacagatttcactctcaccntcagcagccctgcaggctgaantgtggctagttttatattgtacagactaaattattaatactttccctacctacgtaacggtaccgtttccgggaccctaaaagggggtaccctaaaagggggttacggaaaaacttccgaaaaaaccggtaacgttgggttacggaccttacggacctaacccgtaac

SEQ ID NO: 379200 - DNA, 542 bp, Homo sapiens
  misc_feature: GZ8MTXP02J1BFU.22.14.B03.1.454.CMB.2.raw
  modified_base (310)..(310): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagaggccaccatcaactgcaagtccagccagagtatttttacagctccaccaataagagttacttagcttggttccagcaagaaaccaggacatcgtcctgcactgctcatttacgngggcgtctacccgggaatccggggtccctgaccccgattcgagtggcagcgggtctgggacagtattcactctcaccatcagcagccctgcaggctgagatgtggctagtttattattgtcagctaaatatttatatttcctcctcacgtacgttcggaccgaaagggacccaaaggtacgaaaacttaccgaaaacgtaccgtaggtacggtactacggaccacgttaacg

SEQ ID NO: 379201 - DNA, 538 bp, Homo sapiens
  misc_feature: GZ8MTXP02HUW3S.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacgggacattgtgatgaccccagtctccagactccctggctgtgtctctgggcgagagggcaaccatcaactgcaagtccagccagagtatttttacagctccaccaataagagttactagcttggtccagcagaaaccaggacatcgtcctgcactgctctatttactgggctcgtacccgggaatccggggtcctgaccccgattcagtggcacggcgggtcgtggggacagtactttcgactctacaccatccagcagcctgcgagctgaagatgtgctagttttatattgacagcaattattattattcctactctagtacggttcgacctaaagggtaaccaagggtacgaaaactacgaaaacgtactaggttacgactacgacctacctaag

SEQ ID NO: 379202 - DNA, 522 bp, Homo sapiens
  misc_feature: GZ8MTXP02FKRCU.22.14.B03.1.454.CMB.2.raw
  modified_base (308)..(308): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggttccagcagaaaccaggacatcgtcctgcactgctcatttacngggctcgtacccgggaatccggggtccctgaccccgattcagtggcagcgggtctggggacagatttcactctcaccatccagcagccctgccaggctgaagatggtggctagtttattattgacagcaaattattatatttcctctcacgtacgttcggacctaaagggaccaaggtcgaaactacgaaaacgaactgtacggctcgcaccta

SEQ ID NO: 379203 - DNA, 523 bp, Homo sapiens
  misc_feature: GZ8MTXP02FUB9P.22.14.B03.1.454.CMB.2.raw
  modified_base (308)..(308): a, c, t, g, unknown or other
  modified_base (371)..(371): a, c, t, g, unknown or other
  modified_base (380)..(380): a, c, t, g, unknown or other
  modified_base (409)..(409): a, c, t, g, unknown or other
  modified_base (442)..(442): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggttccagcagaaaccaggacatcgtcctgcactgctcatttacngggctcgtacccgggaatccggggtccctgaccccgattcagtggcagcgggtctgggacagntttcactcncaccatcagcagcctgcaggctagaaagntggtggctagtttattattgtcagcaatattanattcctctcacgtacgttcggaccaaagggaccaaaggtacggaaacttacgaaaacgaacgtgtacggctgaccacttac

SEQ ID NO: 379204 - DNA, 510 bp, Homo sapiens
  misc_feature: GZ8MTXP02GOEF2.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggttccagcagaaaccaggacatcgtcctgcactgctctatttactgggcgtctacccggaatccggggtcctgacccgatcagtgcagcgggtctgggacagattcactctcaccatcagcagcctgcaggctagaagatgtggctagtttatattgtcagcaattatatacttcctctcagtacgttcgaccaaagggaccaagggtacgaaatacgaaaacgtaactgtaggctagaccactag

SEQ ID NO: 379205 - DNA, 596 bp, Homo sapiens
  misc_feature: GZ8MTXP02HPB6K.22.14.B03.1.454.CMB.2.raw
  modified_base (312)..(312): a, c, t, g, unknown or other
  modified_base (432)..(432): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaaccaataagagttactagcttgttccagcagaaaccaggacatcgtcctgcactgctctactttacgngggtccgtcgtaccccgggaacgtccccggggtccctacggacccccgattcgagtcggcacggcgggtcgtggggacagtattcactctcaccatccagcagccctgccaggctagaanagtggtggctaagttttattattggtacagactaaattattacttactttcccgtactcgtaacgtacgttccggaccgtaaaacgggggtacccaaaaggggttacgaaaacgttaccgaaaaacggtacgtggttacggaccgttacggaccctaacctacg

SEQ ID NO: 379206 - DNA, 539 bp, Homo sapiens
  misc_feature: GZ8MTXP02GZBK8.22.14.B03.1.454.CMB.2.raw
  modified_base (309)..(309): a, c, t, g, unknown or other
  modified_base (406)..(406): a, c, t, g, unknown or other
  modified_base (413)..(413): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggtccagcagaaaccaggacatcgtcctgcactgctctatttacgngggtcgtcgtaccccgggaatcccggggtcctggaccccgtattcagtggcaggcgggtctgggacagactttcactctcaccatcagcagcctgcngctgagntagtgactagtttatattgtacagactaattattacttattcctctctacgtacgttcggaccgaaagggaacctaagggtacgaaacgttacaaaacgtactaggtacgacgtcgacctacgtac

SEQ ID NO: 379207 - DNA, 547 bp, Homo sapiens
  misc_feature: GZ8MTXP02JR5L4.22.14.B03.1.454.CMB.2.raw
  modified_base (305)..(305): a, c, t, g, unknown or other
tcagacatacgcgtcacgaccggtgctcgatttagtgtgagtagttccgcggggagctacaacaggcaggcagggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttattttacagctccaccaatagagttactagcttggtccagcagaaaccaggacatcgtcctgcactgctctatttacngggcgtcgtacccgggaattcccggggtccctggacccccgtattccaggtcggccaggcgggtcgtggggacagtactttcaactctcaccatcagcagccctagcaggctagagataggtgtctagtttattattgtacagtactaattattactattccctactctacgtacgttcggaccaaagggaccaagggtacgaaatacgaaaacgactacgtacggactggaccacgtaacg

SEQ ID NO: 379208 - DNA, 529 bp, Homo sapiens
  misc_feature: GZ8MTXP02HF0PO.22.14.B03.1.454.CMB.2.raw
  modified_base (406)..(406): a, c, t, g, unknown or other
  modified_base (410)..(410): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggtccagcagaaaccaggacatcgtcctgcactgctctatttactgggctcgtacccgggaatccggggtcctgaccccgatcagtgcaggcgggtctgggacagtattcactctcaccatcagcagcctgcaggctagaagntagnggctagttttatacttggtactagctaaattattatacttcctctactagacgttcggaccgaaaggggaccaaagggtcgaaaactacgaaaacgactacggtagactcgacacctag

SEQ ID NO: 379209 - DNA, 584 bp, Homo sapiens
  misc_feature: GZ8MTXP02HBQQU.22.14.B03.1.454.CMB.2.raw
  modified_base (310)..(310): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagacctccctggctgtgtctctgggcgagagggccaccatcaactgcaagtccagccagagttatttttacagctccaccaataagagttactagcttggtccagcagaaaccaggacatcgtcctgcactgctcatttacgngggctcgtaccccgggaatcccggggtcctgaccccgattccagtggcaggcgggtctgggacagtatttcactctcaccatcagcagccctgcaggctagaaagatggtggataggttttatattggtacagtactaaattattactaatttccctcctacgtacggtaccggtttcggaaccctaaaggggaaaccctaaaggggttacggaaaaacttaccgaaaaaaccgtaaacgttgggttacggacttacggaccaaacccgtaacg

SEQ ID NO: 379210 - DNA, 572 bp, Homo sapiens
  misc_feature: GZ8MTXP02IVMS4.22.14.B03.1.454.CMB.2.raw
  modified_base (422)..(422): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctctatttactgggcgttctaccccgggaatcccggggtcctggaccccgattcagtggcagcgggtcgtgggacaggtatttcgactctcaccgatcagcagtccctgccaggctagaagnttggtggctaggtttttattagtttgactagactaattattaattatttccctcttacgtaaggtaccggtttccggaccgtaaacggggaacctaagggtacggaaacttacgaaaacgtactagggtacgactcggacctaaccgtag

SEQ ID NO: 379211 - DNA, 531 bp, Homo sapiens
  misc_feature: GZ8MTXP02GORM9.22.14.B03.1.454.CMB.2.raw
  modified_base (306)..(306): a, c, t, g, unknown or other
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggttccagcagaaaccaggacatcgtctgcactgctcatttacngggctctacccgggaatccggggtcctgaccccgattcagtgcagcgggtctgggacagatttcactctcaccatcagcagcctgcaggctagaagatggtggctagttttatattggtcagcaaattattaatatttcctcctacacgtaccggtttcggacctaaaggggaaccaaggggtagaaaactacgaaaaccgtatacggtggactacggacaccta

SEQ ID NO: 379212 - DNA, 591 bp, Homo sapiens
  misc_feature: GZ8MTXP02I5FKI.22.14.B03.1.454.CMB.2.raw
  modified_base (425)..(425): a, c, t, g, unknown or other
  modified_base (482)..(482): a, c, t, g, unknown or other
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggttccagcaagaaaccaggacatcgtcctgcactgctctatttacgtgggcgtccgtacccgggaagtcccggggtccctggaccccgattccagtcggcaggcggtcgtggggactagactttcacgtctcaccatcagcagccctagccaggctagaagntaggtgtacgtagttttattaagttggtacagactaaattatttaattactttaccnccttacgaagtacccggtttaccgggaccgtaaaaggggtacccgaaagggttaacgggaaaactaccgtaaaaacgacgttaggtacggactcggaccaaccttaacg

SEQ ID NO: 379213 - DNA, 534 bp, Homo sapiens
  misc_feature: GZ8MTXP02FQPXF.22.14.B03.1.454.CMB.2.raw
  modified_base (409)..(409): a, c, t, g, unknown or other
  modified_base (455)..(455): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggttccagcagaaaccaggacatcgtcctgcactgctcatttactgggccgtcgtacccgggaatccggggtccctgaccccgattcagtgcagcgggtctgggacagatttcactctcaccatcagcagcctgcaggctagaagntgtgctagtttattattgtcagactaattattactattcctcctanacgtacgttcggaccctaagggacccaaaggggtacgaaacttacgaaaacgtaactggtacggctacgacgtacccta

SEQ ID NO: 379214 - DNA, 518 bp, Homo sapiens
  misc_feature: GZ8MTXP02ICXTB.22.14.B03.1.454.CMB.2.raw
  modified_base (406)..(406): a, c, t, g, unknown or other
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggtccagcagaaaccaggacatcgtcctgcactgctcatttactgggcgtctacccgggaatcccggggtcctgaccccgattcagtggcagcgggtctgggacagatttcactctcaccatcagcagccctgcaggctgaagntgtggctagttttatattgtcagctaatattatattcctctcagtacgtttcggacctaaaggggaccaagggtacgaaaatacaaaacgtactggtacgctacgcaaccta

SEQ ID NO: 379215 - DNA, 562 bp, Homo sapiens
  misc_feature: GZ8MTXP02JX6T3.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggcgtctacccgggaatccggggtccctgaccccgattcagtggcagcgggtctgggacagatttcactctcaccatcagcagccctgcaggctagaagatggtgctagtttatagttgtcagcaaattattatacttccctctctagtaccgtttcggacccgtaaaggggaccctaaaaggggttcggaaaaacgttccgaaaaacggtaaaccgttggtacggggtacccttaggaccaacccttaacg

SEQ ID NO: 379216 - DNA, 505 bp, Homo sapiens
  misc_feature: GZ8MTXP02GYHO1.22.14.B03.1.454.CMB.2.raw
  modified_base (308)..(308): a, c, t, g, unknown or other
  modified_base (408)..(408): a, c, t, g, unknown or other
  modified_base (411)..(411): a, c, t, g, unknown or other
  modified_base (427)..(427): a, c, t, g, unknown or other
  modified_base (429)..(429): a, c, t, g, unknown or other
  modified_base (431)..(431): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaaataagagttactagcttggtccagcaagaaaccaggacatcgcctgcactgctcatttacngggctctacccgggaatccggggtccctgaccccgattcagtggcagcgggtctgggacagatttcactctcaccatcagcagccctgcaggctgaaagntgngattagtttatatganananaatatatatctctcacgacgtacgacgaacggaacgaacgaagaagaacaaacgaacgtagtagcgacacacac

SEQ ID NO: 379217 - DNA, 572 bp, Homo sapiens
  misc_feature: GZ8MTXP02G6PKZ.22.14.B03.1.454.CMB.2.raw
  modified_base (401)..(401): a, c, t, g, unknown or other
  modified_base (426)..(426): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggtccagcagaaaccaggacatcgtcctgcactgctctatttacgtgggtcgtcgtacccggggaattcccggggtccctggaccccgattccgagtcggcaggcgggtcgtgggacagtactttcactctccactntccagcagccctgccaggctagagngtagtggactagtttatagttgtacagactaattatacttattccctctacgacgtaccggtttcggaaccgtaaagggaaccgtaagggttacggaaaacttacgaaaaccgtagtacggttacggcttacggacctacgtaacg

SEQ ID NO: 379218 - DNA, 635 bp, Homo sapiens
  misc_feature: GZ8MTXP02GYEBE.22.14.B03.1.454.CMB.2.raw
  modified_base (249)..(249): a, c, t, g, unknown or other
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccacaataanagttactagctggtccagcagaaaccagacatcgtcctgcactgctcatttaactgggcgtctacccgggaaatccggggtcctgaccccgattccagtggcagcggggtctggggacaggatttcaactctcaaccctaatacacgacacgccgtcgcgacggacgtagaaagtaagtaggtaggtacgttaagtttaagtttagtttacgtacgtaacgtaactaaattaaatttaacttaacttacccttaccttacctacgtaaccggttaccgggtaacccggtaaaccgggtaaaccggtaaaacggtaaaacggtaaaacgtaaaaccgaaaaaccgtaaaacgtaacggtacggtacgtacgtaccgtaaccgtaacg

SEQ ID NO: 379219 - DNA, 563 bp, Homo sapiens
  misc_feature: GZ8MTXP02IQN7V.22.14.B03.1.454.CMB.2.raw
  modified_base (425)..(425): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaaccaataagagttactagcttggttccagcaagaaaccaggacatcgtcctgcactgctcatttactgggccgtccgtacccgggaatcccggggtcctcgaccccgtattcagtggcaggcgggtcgtgggactagtactttcactctacaccatcagcagcctgcaggctagagagtgnggactagttttattagttgtacagtactaaatatttactacttcctctactagtaccgtttacggacctaaacggggacctaaaggggtaacgaaaactacgaaaaaccgtacgtgtacgggactacggacacctaag

SEQ ID NO: 379220 - DNA, 587 bp, Homo sapiens
  misc_feature: GZ8MTXP02IERU8.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttattttttacagctaccaccaaataagtagttacttagcttggtccagcaagaaaccaggacatcgtcctgcactgctctatttactgggcgtcgtacccgggaagtcccggggtcctcgaccccgtattcgagtggcaggcgggtcgtgggacagtatttcactctcacctatcagcagccctagccaggtctaggaagagtcgtaggtctaaggtttttattagttgtacagactaaattatttacttacttccctctcgaacgtaccggtttccggaccaaaacggggtaaccgtaagggtaacggtaaattaaccaaaaccggtaacttggtacgacttacggactaaccgtacg

SEQ ID NO: 379221 - DNA, 585 bp, Homo sapiens
  misc_feature: GZ8MTXP02F1MBR.22.14.B03.1.454.CMB.2.raw
  modified_base (321)..(321): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggagggccaccatcaactgacaacgtccagccagtagttatttttacagctaccaacaataagtagttactagtcttggttaccagcaagaaaccaggactatccgtctgcactgctctattacgngggtctccgtacccgggacgtcccggggtcctggaccccgtattcgaggtcggcacgggcgggtcgtaggggactagtactttccacgtctacacctatccgagcacgccctgccgagggtacctagaaagtgttggcgtacttagttttatagttgacacgtataattattactacttccgtactctacggtaccgttcgacgaaagggtacctaaggtaacggaaactacgaaacgtacgttgacggtctacgccacttacg

SEQ ID NO: 379222 - DNA, 537 bp, Homo sapiens
  misc_feature: GZ8MTXP02JISSM.22.14.B03.1.454.CMB.2.raw
  modified_base (307)..(307): a, c, t, g, unknown or other
  modified_base (388)..(388): a, c, t, g, unknown or other
  modified_base (411)..(411): a, c, t, g, unknown or other
  modified_base (415)..(415): a, c, t, g, unknown or other
  modified_base (418)..(418): a, c, t, g, unknown or other
  modified_base (433)..(433): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagtatttttacagctccaccaataagagttactagcttggttccagcagaaaccaggacatcgtcctgcactgctcatttacngggcgtctacccgggaatccggggtccctgaccccgtattcgagtggcaggcgggtctgggacagtatttcactctcaccntcagcagcctgccaggctgaagngtgngtnttagtttatgttganagtataattattactacttcctactcgtacgtacgtacgacgaacggtacgtaacggtaacgtaaactacgaaacgtacgtacgtacgactacgacctactacg

SEQ ID NO: 379223 - DNA, 599 bp, Homo sapiens
  misc_feature: GZ8MTXP02IVWP8.22.14.B03.1.454.CMB.2.raw
  modified_base (421)..(421): a, c, t, g, unknown or other
  modified_base (491)..(491): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctaccaccaaataagtagttactagcttggttaccagcaagaaaccaggacatcgtcctgccactcgctactatttaccgtcgggtccgtaccgtaccccgggaacgtccccggggtaccctcggaccccgtattcgaggtcggcaggcgggtcgtgggactagtacttcactcgtcaccgntccgacgacacgtcctagccgaggtctaggaaagtggtgtacgggtattaaggtttttattagttcgtanaacgtataaattatttaactcttacctctacgtacgtccgttacggacgtaaacgggacaagggtaacgtaactaacgaaacgtagtacggtcgctacgactacctag

SEQ ID NO: 379224 - DNA, 592 bp, Homo sapiens
  misc_feature: GZ8MTXP02JL4GF.22.14.B03.1.454.CMB.2.raw
  modified_base (345)..(345): a, c, t, g, unknown or other
  modified_base (388)..(388): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataacgagttacttagcttggttccagcagaaaccaggacatcgtcctgcactgctcatttactgggctctacccgggaatccggggtcctgaccccgnttcagtggcagcgggtctgggacaggactttcactctcaaccntcagcagccctgccaggctagagtagtggtaggctagtttacttagttggtacagtacctaaatttactttaattactttccctcccgttacgtaacggttacccggtttacgggacccgtaaaagggaccccggtaaagggttaacggtaaaactacgaaaaaccggtaacgtacggttacgggcttacgaccgaaccctaag

SEQ ID NO: 379225 - DNA, 569 bp, Homo sapiens
  misc_feature: GZ8MTXP02JMJV9.22.14.B03.1.454.CMB.2.raw
  modified_base (423)..(423): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttactagcttggtccagcagaaaccagacatcgtctgcactgctctatttacgtgggccgtaccgtacccgggaatcccggggtccctgaccccgtattcgagtggcgaggcgggtcgtgggactagtacgtttcactctcacccatcagcagccctgcgagctagaangtgtgacttagttattatgtacagtacaattattattacttcctacctacgtagtaccgtttccgggacctaaaagggggtaccctaaaggggtacgtaaaacttaccgaaaacgacgttaggtacggacttacggaccaactacg

SEQ ID NO: 379226 - DNA, 567 bp, Homo sapiens
  misc_feature: GZ8MTXP02JASX3.22.14.B03.1.454.CMB.2.raw
  modified_base (415)..(415): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggtccagcagaaaccaggacatcgtcctgcactgctcatttactgggctctacccgggatccggggtcctgaccccgatcgagtggcaggcgggtcgtgggacaggtatttcactctcaccatcagcagcctagcaggctagaagtatcggngtactaggtttttattattggttaccagtctaaattatttaattacttcctccttactacggtaaccgtttccggaccgtaaaggggaccctaaagggtacggtaaaactacgaaaaccgtacgtaggttacggcttacggaccaacgtacg

SEQ ID NO: 379227 - DNA, 527 bp, Homo sapiens
  misc_feature: GZ8MTXP02J2LGS.22.14.B03.1.454.CMB.2.raw
  modified_base (227)..(227): a, c, t, g, unknown or other
  modified_base (254)..(254): a, c, t, g, unknown or other
  modified_base (283)..(283): a, c, t, g, unknown or other
  modified_base (353)..(353): a, c, t, g, unknown or other
  modified_base (376)..(376): a, c, t, g, unknown or other
  modified_base (447)..(447): a, c, t, g, unknown or other
tcagacatacgcgtcacgaccggtgctcgatttagtgtgagtagttccgcgggggagctacaacaggcaggcagggcagcaagatggtgttgcagacccaggtcttcatttctctgttgctctggatctctggtgcctacggggacattgtgatgaccccagtctccagactcccctggctgtgtctctgggcgagagggccaccatcaactgcaagtccagccagngtattttttacagctccaccaataagngttacttagcttggttccagcagaaaccnggacatcgtcctgcactgctcatttactggggcgtctaccccggggaatccgggggtccctgacccccgnttcatggcagcgggtctgggacngatttcactctcaccatccagcagccctgccagctgaaagatgtggacagttttatttatgttcagcaatnttatatttccctctacagacgtttcggccaaaggggacccaaagggttcgaaatcaaaacgactgtacggctgcacccta

SEQ ID NO: 379228 - DNA, 559 bp, Homo sapiens
  misc_feature: GZ8MTXP02FN9U9.22.14.B03.1.454.CMB.2.raw
  modified_base (427)..(427): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagacctccctggctgtgtctcgtgggcgagagggccaccatcaactgcaagtccagccagagttatttttacagctccacaataagagttactagcttggttccagcaagaaaccaggacatccgtcctgcactgctctatttacgtgggcgtccgtacccgggaacgtcccggggtccctggaccccgtattcagtggcaggcgggtcgtgggacagtactttcactctcacccatcagcagcctgcaggctagaaagntggtcggacttagtttattagttgtacagtactaattatttaatacttcctctacgacgtaccgttcgaccgtaacgggaccaagggtacgaaactacgaaaacgtacgtggtacggactacggaccactac

SEQ ID NO: 379229 - DNA, 517 bp, Homo sapiens
  misc_feature: GZ8MTXP02G8XKH.22.14.B03.1.454.CMB.2.raw
  modified_base (310)..(310): a, c, t, g, unknown or other
  modified_base (367)..(367): a, c, t, g, unknown or other
  modified_base (410)..(410): a, c, t, g, unknown or other
  modified_base (413)..(413): a, c, t, g, unknown or other
  modified_base (415)..(415): a, c, t, g, unknown or other
  modified_base (423)..(423): a, c, t, g, unknown or other
  modified_base (430)..(430): a, c, t, g, unknown or other
  modified_base (432)..(432): a, c, t, g, unknown or other
  modified_base (434)..(434): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacgggacattgtgatgacccagtctccagactccctggctgtgtctctgggcgagagggccaccatcaactgcaagtccagccagagttatttttacagctccacaaataagagttactagcttggtccagcaagaaaccaggacatcgtcctgcactgctctatttacgngggtcgtacgtacccgggaatcccggggtccctgaccccgattcagtgcagcgggtntgggacagtattcactctcacatcagcagcctgcaggcagaantgngntagtttanacttganananatatatatctctacacgtacgtacgacgaacggaacgaacgtaacgaagaacgaaacgaacgtacgtacgacgacgacactac

SEQ ID NO: 379230 - DNA, 557 bp, Homo sapiens
  misc_feature: GZ8MTXP02F6XFX.22.14.B03.1.454.CMB.2.raw
  modified_base (363)..(363): a, c, t, g, unknown or other
  modified_base (390)..(390): a, c, t, g, unknown or other
  modified_base (407)..(407): a, c, t, g, unknown or other
  modified_base (412)..(412): a, c, t, g, unknown or other
  modified_base (422)..(422): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccacaataagagttactagcttgttccagcaagaaaccaggacatcgtcctgcactgctctatttactgggcgtcgtacccggaagtccggggtcctgaccccgtatcagtcgcagcgggtntgggacagtattcactctcaccatcancagctgcagctagaagntgtgntagtttattnttagacagataattattatacttccctactcgtaacgtacgttacggacccgtaaagggtaacctaaaggttaacggaaaacttaaccggaaaaccgtaacgtaggttacggaccttacggaccctaaactacgg

SEQ ID NO: 379231 - DNA, 643 bp, Homo sapiens
  misc_feature: GZ8MTXP02JN67L.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagacctccctggctgtgtctcgtgggcgagacgggccaccatcaactgacaagtccagccagtagttatttttacagcctaccaccaataagtacgttactagcttggtccagacaagaaaccaggacatcgtctgcactgctactattacgtgggtccgtaccgtacccgggtaacgtcccggggtcctacggaccccgtattcgagtcggcgaggcgggtcgtgggactagtacttccactctaccaaccatacacgcacgtccctagaccgagggtctaagggaagtcgttagggtagtactttaaggttttattagttaggactaaagtacttaaattactttaattcctttaccctaccgtacgtaacggttaccggttaccggaaaccggaaacggggtaaccgtaaaggggtaaacgaaacttaaaccggaaacggtactcgggttacggacttacggacctaacttcg

SEQ ID NO: 379232 - DNA, 586 bp, Homo sapiens
  misc_feature: GZ8MTXP02IBHZN.22.14.B03.1.454.CMB.2.raw
  modified_base (307)..(307): a, c, t, g, unknown or other
  modified_base (316)..(316): a, c, t, g, unknown or other
  modified_base (375)..(375): a, c, t, g, unknown or other
  modified_base (381)..(381): a, c, t, g, unknown or other
  modified_base (402)..(403): a, c, t, g, unknown or other
  modified_base (405)..(405): a, c, t, g, unknown or other
  modified_base (407)..(407): a, c, t, g, unknown or other
tcagacatacgcgtcacgaccggtgctcgatttagtgtgagtagttccggcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggagggccaccatcaacgtgcaagtccagccagagttatttttacagctccaccaataagagttactagccttggtccagacagaaaccaggtacatcgcctgcactgctntagtttacngggctacgtacccgggaatcccggggtcctgaccccgattcgagtggctaggccgggtngggganaggtatttcactctcacccannancncgctcgcgagacgagagtagtagtgtagttagtttattattagtatagtataattaattattacttacctactacgtacgtacggttaccggtaaccgtaaacggtaaacggtaaacggtaacgtaaacgtaaacgtaaaacgtaaacgtacgtacggtacgtacgtaccgtaactacg

SEQ ID NO: 379233 - DNA, 566 bp, Homo sapiens
  misc_feature: GZ8MTXP02H05VY.22.14.B03.1.454.CMB.2.raw
  modified_base (290)..(290): a, c, t, g, unknown or other
  modified_base (308)..(308): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttactagcttggtccagcagaaaccagacatcgtcngcactgctctatttacgngggtctaccgtacccgggaagtcccggggtcctgacccgattcgagtggcaggcgggtcgtgggacagtctttcactctacaccatcagcacgcctgccaggctagagatggtggacttagtttattacgttgtacagactaaattattaattactttcctactctaacgtacggtttaccggaccgtaaaggggaacctaaggggtaacgaaactacgaaaaacgtacgttaggacggactacggacctaacgtacg

SEQ ID NO: 379234 - DNA, 602 bp, Homo sapiens
  misc_feature: GZ8MTXP02IGUHJ.22.14.B03.1.454.CMB.2.raw
  modified_base (430)..(430): a, c, t, g, unknown or other
  modified_base (453)..(453): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgaggagggccaccatcaactgcaagtccagccagagttatttttacagtctaccaccaataagagttacttagcttggtccagcaagaaaccaggacatcgtcctgcactgctctatttacgtgggtccgttaccgtacccgggaaacgttccccggggtcccctaggtacccccgtattccgaggtcgggcgtacggcgggtcgtggggaacacggtactttccactctaccactancagcagccctgcaggctagaagntggtgtcttaagtttttattattgtacagtactaaattatttactacttccctacctacgacgtaccggttccggaacctaaaggggaaccctaagggtaacgaaacgttacgaaaacgtacgtacggtcggacgttacgactactacg

SEQ ID NO: 379235 - DNA, 514 bp, Homo sapiens
  misc_feature: GZ8MTXP02FFCWB.22.14.B03.1.454.CMB.2.raw
  modified_base (310)..(310): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttacngggcgtcttacccgggaatccggggtccctgaccccgattcagtggcagcgggtctggggacagatttcactctcaccatcagcagcctgcaggctgaagatgtggcagtttatattgtcagcaatattatattcctcctcagacgttcggaccaaagggaccaaaggtggaaaatcaaaacgaaactgtaggctgacacctaa

SEQ ID NO: 379236 - DNA, 547 bp, Homo sapiens
  misc_feature: GZ8MTXP02G3EVH.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttactagcttggtccagcagaaaccaggacatcgtcctgcactgctctatttacgtgggcgtcgtacccgggaagtcccggggtcctgaccccgattcagtggcaggcgggtcgtgggacagtatttccactctacaccatcagcagccctgccaggctagagatgtggctagttttatattgtacagtactaaattattattacttcctactactacggtaccgttcggacccaaaggggtaccaaagggtacgaaaatacgaaaacgtacgtgtacggctacgaccaacta

SEQ ID NO: 379237 - DNA, 574 bp, Homo sapiens
  misc_feature: GZ8MTXP02GBANE.22.14.B03.1.454.CMB.2.raw
  modified_base (412)..(412): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagtatttttacagctccaccaataagagttacttagcttggttccagcagaaaccaggacatcgtcctgcactgctcatttactgggccgtctacccgggaatccggggtccctgaccccgattcagtggcagcgggtctgggacagatttcactctcaccatcagcagccctgccgaggctgaaagntcggtgactaagttttattagttggtacagtctaaattactttaatacttcctcctaccagtaaccgtttcggaacccgtaaaaggggacccgaaaagggttacggaaaacttaccggaaaaacgtaacgttgttacggggacttcggaccaacccgttacg

SEQ ID NO: 379238 - DNA, 583 bp, Homo sapiens
  misc_feature: GZ8MTXP02IWAHI.22.14.B03.1.454.CMB.2.raw
  modified_base (309)..(309): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggttccagcagaaaccaggacatcgtcctgcactgctcatttacgngggcgtctacccgggaatcccggggtcctgaccccgattcagtcggcaggcgggtcgtggggactaggtatttcgactctcaaccatcaagcagccctgccaaggctagaaagtagtgtgactaagtttatagttgtacagtactaattattatacttcctactctaacgtacgttccggaaccgtaaacggggtaaccctaaagggtacggaaaacttaaccgaaaaacggtaaccgttaggtaacgggacctacggtaccaaaccgttaacg

SEQ ID NO: 379239 - DNA, 527 bp, Homo sapiens
  misc_feature: GZ8MTXP02G6ABQ.22.14.B03.1.454.CMB.2.raw
  modified_base (307)..(307): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctcaccaataagagttactagcttggttccagcagaaaccaggacatcgtcctgcactgctcatttacngggctctaccccgggaatccggggtcctgaccccgattcagtggcaggcgggtctggggacagtatttcactctcaccatcagcagccctagccaggctagagatgtggctagtttatattgtacagcaattattatattcctctcagtacgttcggacctaaagggaccaaaggttacggaaattacgaaaacgtactaggtcggactcggaccaccta

SEQ ID NO: 379240 - DNA, 520 bp, Homo sapiens
  misc_feature: GZ8MTXP02JW6CI.22.14.B03.1.454.CMB.2.raw
  modified_base (306)..(306): a, c, t, g, unknown or other
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggtccagcagaaaccaggacatcgtcctgcactgctcatttacngggctctacccgggaatcccggggtccctgaccccgattcagtggcaggcgggtcgtggggacagatttcactctcaccatcagcagccctgcaggctgaagatgtggctagtttatattgtcagctaatattatattcctctcacgtacgttcggacctaaagggaccaaggtacgaaatacgaaaacgtaactgtacggcacgtacacctag

SEQ ID NO: 379241 - DNA, 534 bp, Homo sapiens
  misc_feature: GZ8MTXP02ISFV4.22.14.B03.1.454.CMB.2.raw
  modified_base (306)..(306): a, c, t, g, unknown or other
  modified_base (432)..(432): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttgtccagcagaaaccaggacatcgtcctgcactgctcatttacngggcgtcgtacccgggaatccggggtccctgaccccgattcagtggcaggcgggtcgtgggacagtatttcactctcaccatcagcagccctgccgaggctaggaagatggtaggctagttttatnttgcagctaatattatattcctctcacgacgtttcgaccgtaaagggacctaagggtacgaaaatacgaaaacgtacgtaggtcggctacggacctaccgta

SEQ ID NO: 379242 - DNA, 608 bp, Homo sapiens
  misc_feature: GZ8MTXP02G8GQE.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttacttagcttggttccagcagaaaccaggacatcgtcctgcactgctctatttacgtgggtcgtccgtacccgggaactcccggggtccctgaccccgtattcagtcggcaggcgggtcgtgggacagtatttcactctccacctatcagcagccctgccaggctagaagtagtgtcggtctagtttattagttgtacagtactaaattacttaacttaacttcccttaccgtacgttaacggtaccggtttaccggacccgttaaaacggggacccgtaaaaggggttacgtaaaagttaacccgaaaacggtaaccgttaggttacggacgttacggaacctaccttaacg

SEQ ID NO: 379243 - DNA, 608 bp, Homo sapiens
  misc_feature: GZ8MTXP02HE9F9.22.14.B03.1.454.CMB.2.raw
  modified_base (414)..(414): a, c, t, g, unknown or other
  modified_base (437)..(437): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagacctccctggctgtgtctcgtgggcgagagggccaccatcaactgcaagtccagccagtagttatttttacagctccaacctaaataagattactagcttggtccagcaagaaaccaggacatcgtcctgcactgctctatttacgtgggcgtaccgtacccgggaagtcccggggtccctcgaccccgattcaggtggacgaggcgggtcgtgggacagtactttccactctaccaccatccanccagccctgccaggctagaaagngtggtaggtacttaagtttttatattgacagtactaaatttatttactactttccctactacgtaacgtaccggttcggaaccctaaaagggggtaaaccctaaaggggtaacgtaaaacttaacccgaaaaacggtacgtgggttaacggcctacggaccctaacggtac

SEQ ID NO: 379244 - DNA, 530 bp, Homo sapiens
  misc_feature: GZ8MTXP02FO47E.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccacaataagagttactagcttggttccagcagaaaccaggacatcgtcctgcactgctcatttactgggcgtctacccgggaatccggggtccctgaccccgattcagtggcagcgggtctgggacagatttcactctcaccatccagcagccctgcaggctgaagatgtgctagtttattattgtcagctaatattatattacctcctctacgacgttcggaccaaaggggaccaaagggttacggaaaatacgaaaaacgtaacgtgtacggacctagccaacctag

SEQ ID NO: 379245 - DNA, 541 bp, Homo sapiens
  misc_feature: GZ8MTXP02G8JLO.22.14.B03.1.454.CMB.2.raw
  modified_base (269)..(269): a, c, t, g, unknown or other
  modified_base (421)..(421): a, c, t, g, unknown or other
  modified_base (438)..(438): a, c, t, g, unknown or other
  modified_base (468)..(468): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagtactagtctgttcancagaaccagacatcgtcctgcactgctctattacgtcgggtcgtccgtacccgggaacgtccggggtcccgtcgacccgtactcgacgtggcgaggcgggtcgtggacgagtattcactctcgacctatcagcagcctgcgagtctagaagntgtcggattagtttatnttgtacagactaattattatacttcctccntaacgtaccgttcggaccgaaagggaccaagggtaacgaaataccgaaaacgtactggtcgactcacgaccta

SEQ ID NO: 379246 - DNA, 543 bp, Homo sapiens
  misc_feature: GZ8MTXP02GHTGS.22.14.B03.1.454.CMB.2.raw
  modified_base (423)..(423): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagtagtatttttacagctccacaataagagttactagctggttccagcaagaaaccagacatcgtcctgcactgcctctatttacgtcgggctccgtaaccccgggaagtcccggggtccctcgaccccgtattccagtcggcaggcgggtcgtgggacagtactttcactctcacatcagcagcctgccaggctagaanagtgtgacttagtttatattgacagataatattaatattcctctctaagtacgttacgaccgtaaaggacctaaggtaacgaaataacaaaacgtaacgtgtacggactacgacacctaa

SEQ ID NO: 379247 - DNA, 536 bp, Homo sapiens
  misc_feature: GZ8MTXP02F4Q49.22.14.B03.1.454.CMB.2.raw
  modified_base (357)..(357): a, c, t, g, unknown or other
  modified_base (440)..(440): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccacaataagagttactagcttggttccagcagaaaccaggacatcgtcctgcactgctcatttactgggcgtctacccgggatccggggtcctgacccgattcagtgcagcgggtntgggacagattcactctcaccatcagcagccctgccaggctagaagatgtggactagttttatattgtacagcaaattattanacttcctctacacgtaccgtttcggacctaaaggggacctaaagggtacgaaaacttacgaaaaccgtaactggtacggactacggaccacctaag

SEQ ID NO: 379248 - DNA, 523 bp, Homo sapiens
  misc_feature: GZ8MTXP02GK19C.22.14.B03.1.454.CMB.2.raw
  modified_base (307)..(307): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttactagcttggtccagcagaaaccaggacatcgtctgcactgctcatttacngggctctacccgggaatcccggggtcctgaccccgtattcagtggcaggcgggtctgggacagtatttcactctcaccatcagcagctgcaggctagaagatggtggactagtttatattgtcaagtctaattattatattccctactcagtacgttcggacgaagggaccaaggtacgaaactacgaaacgaactggtacggactacgacactac

SEQ ID NO: 379249 - DNA, 539 bp, Homo sapiens
  misc_feature: GZ8MTXP02G3C60.22.14.B03.1.454.CMB.2.raw
  modified_base (421)..(421): a, c, t, g, unknown or other
  modified_base (465)..(465): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctctatttactgggtcgtcgtaccccggggaaattcccggggtcccctgaccccgtattcagtggcaggcgggtcgtgggacagatttcactctcaccatcagcagcctgccagctgaaagntgtggactagttttatattgtacagtcaatattatattcctctntacgtacgttcggacctaaagggaccaaaggtacgaaatacgaaaacgtactggtacggactacgaccaccgta

SEQ ID NO: 379250 - DNA, 517 bp, Homo sapiens
  misc_feature: GZ8MTXP02H410Q.22.14.B03.1.454.CMB.2.raw
  modified_base (307)..(307): a, c, t, g, unknown or other
  modified_base (383)..(383): a, c, t, g, unknown or other
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacgggacattgtgatgacccagtctccagactccctggctgtgtctctgggcgagagggccaccatcaactgcaagtccagccagagttatttttacagctccaccaataagagttactagcttggttccagcagaaaccaggacatcgtcctgcactgctcatttacngggcgtctacccgggaatccggggtcctgaccccgattcagtgcagcgggtctgggacagatttcactctcaccancagcagccctgcaggctgaagatgtggctagttttatattgtcagcaatattatattcctctcagacgtttcggaccaaagggaccaagggtacggaaaatcgaaaaacgaacgttagtcggactcgacaccaa

SEQ ID NO: 379251 - DNA, 563 bp, Homo sapiens
  misc_feature: GZ8MTXP02GTZT4.22.14.B03.1.454.CMB.2.raw
  modified_base (420)..(420): a, c, t, g, unknown or other
  modified_base (457)..(457): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttacttagcttggttccagcagaaaccaggacatcgtcctgcactgctcatttactgggtctccgtacccgggaactccggggtccctgaccccgattcagtggcaggcgggtctggggacagtatttcactctcaccatcagcagccctagccaggctgaaacgntggtggctaggtttttatagttgtacagtacaaattntaaacttcttacctcctactacgtaccgtttcggacctaaaggggccctaaaaggggtcgaaaacttaccgaaaacggtactggacggtctacggaccaccctaag

SEQ ID NO: 379252 - DNA, 586 bp, Homo sapiens
  misc_feature: GZ8MTXP02IKJZY.22.14.B03.1.454.CMB.2.raw
  modified_base (310)..(310): a, c, t, g, unknown or other
  modified_base (423)..(423): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagattactagcttgttccagacagaaaccaggacatcgtcctgcactgctctatttacgngggtccgtacgtacccgggaatcccggggtcctcgacccgattcagtcggcaggcgggtcgtggacagtactttccacttctacacctatcagcacgctgacagctagaagtntaggtaggtactaggtttttatagttgtacagtactaaatttacttaaattactttaccctaccttcgtaaacggttaccggtttaccggaccgttaaaacgggaccctaaagggtaacggaaattacgaaaacgtacgtggtacggactacggaccactaac

SEQ ID NO: 379253 - DNA, 506 bp, Homo sapiens
  misc_feature: GZ8MTXP02IDXEA.22.14.B03.1.454.CMB.2.raw
  modified_base (303)..(303): a, c, t, g, unknown or other
  modified_base (309)..(309): a, c, t, g, unknown or other
  modified_base (409)..(409): a, c, t, g, unknown or other
  modified_base (412)..(412): a, c, t, g, unknown or other
  modified_base (421)..(421): a, c, t, g, unknown or other
  modified_base (423)..(423): a, c, t, g, unknown or other
  modified_base (425)..(425): a, c, t, g, unknown or other
  modified_base (427)..(427): a, c, t, g, unknown or other
  modified_base (429)..(429): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggttccagcaagaaacccaggacatcgtcctgcactgctnattacnggggctctacccgggaatccggggtcctgaccccgtatcagtgcagcgggtctgggacagtactttcactctcaccatcagcagcctgcagctagaaagntgngatattatntnanananatatatactactctcacgacgtacgacgaacggacgaacgtacgaacaacaaacgaacgtagtacgacgcgacacac

SEQ ID NO: 379254 - DNA, 523 bp, Homo sapiens
  misc_feature: GZ8MTXP02GD64L.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttgttccagcagaaaccaggacatcgtcctgcactgctcatttactgggcgtcgtaccccggggaatcccggggtccctgaccccgtattccagtggcaggcgggtctgggacagatttcactctcaccatcagcagcctgcaggctagagatgtggctagtttattattgtcagctaatattatacttctctcagtacgttcggacctaaaggggaccaaaggtagaataacgaaaacgtactagtcgactacgacaccta

SEQ ID NO: 379255 - DNA, 540 bp, Homo sapiens
  misc_feature: GZ8MTXP02H8V6T.22.14.B03.1.454.CMB.2.raw
  modified_base (308)..(308): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagaggccaccatcaactgcaagtccagccagagttatttttacagctccaccaataagagttactagcttggttccagcagaaaccaggacatcgtcctgcactgctcatttacngggcgtctaccccgggaatcccggggtcctgaccccgattcgagtcggcaggcgggtcgtggggacaggtatttcactctcaccatcagcagccctgccaggctagaagatggtaggtactaggtttttattagtgtacagactaaattattattacttcctctcacgtacgttccggacgaagggaccaaggtacgtaaacacgaaaacgctaggtacgctcgactactac

SEQ ID NO: 379256 - DNA, 530 bp, Homo sapiens
  misc_feature: GZ8MTXP02GGWEH.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccacaataagagttactagcttggttccagcagaaaccaggacatcgtctgcactgctctatttactgggccgtccgtacccgggaacgtccggggtccctgaccccgtattcgagtggcaggcgggtctgggacagtatttcactctcaccatcagcagccctgcaggctagagagtgtggactagttttatattggtcagactaattattatacttccgctcacgtacgttcgacgtaacggacaaggtacgaaataccgaaaagtacgtgtacggctacgacaccta

SEQ ID NO: 379257 - DNA, 548 bp, Homo sapiens
  misc_feature: GZ8MTXP02F6S8E.22.14.B03.1.454.CMB.2.raw
  modified_base (465)..(465): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagattactagcttggttccagcagaaaccaggacatcgtcctgcactgctcattactgggcgtcgtacccgggaatccggggtcctgaccccgattcagtcggcaggcgggtcgtgggacagtattcactctcaccatcagcagccctgacgaggctagaagagtggtcggataggtttattattaggtcagactaaatatttatacttcctcctnaacgtacgttcgaccgtaaagggacctaaagggtacggaaaactcgaaaacgtaacgtcgtacggacttacggaccactaacg

SEQ ID NO: 379258 - DNA, 580 bp, Homo sapiens
  misc_feature: GZ8MTXP02JOHOB.22.14.B03.1.454.CMB.2.raw
  modified_base (426)..(426): a, c, t, g, unknown or other
  modified_base (432)..(432): a, c, t, g, unknown or other
tcagacatacgcgtcacgaccggtgctcgatttagtgtgagtagttccgcgggggagctacaacaggcaggcaggggcagcaagatggtgttgcagaccccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttactagcttgtcagcagaaccaggacatcgtcctgcactgctctatttacgtgggtccgtcgtacccgggaacgtcccggggtccctcgaccccgtattcgagtggcgaggcgggtcgtgggacagtagttcactctcacccatcagcagccctgccgaggctaggaagngtgggngactaggtttaattgttcggtacatactaaattacttatactttcccctacctacgtacggtacccggtttcggacccgtaaaggggaaccctaacgggtaggaaaacctcgaaaacgtacgtaggtacggactacggaccaacctag

SEQ ID NO: 379259 - DNA, 553 bp, Homo sapiens
  misc_feature: GZ8MTXP02F0L68.22.14.B03.1.454.CMB.2.raw
  modified_base (395)..(395): a, c, t, g, unknown or other
  modified_base (415)..(415): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggctcgtacccgggatccggggtccctgaccccgattcagtgcagcgggtctggggacagtactttcaactctcaccatcagcanccctgcaggctagaagatgnggctaaggtttattagttgtacagtactaaattatttatattaccctcctactaacggtaccgtttacggaccgtaaaaggggaccctaaagggtacggaaaatacgaaaacgaaactggtaacggctcggacaccta

SEQ ID NO: 379260 - DNA, 573 bp, Homo sapiens
  misc_feature: GZ8MTXP02G9PHG.22.14.B03.1.454.CMB.2.raw
  modified_base (418)..(418): a, c, t, g, unknown or other
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggcgtcgtacccgggaactccggggtcccctggaccccgtattccagtggcaggcgggtcgtgggacagatttcactctcaccatcagcagcctgcaggctagagatgngctagtttatattgtcagctaatatttatacttcctctactacgtccggtttaccggacctaaaaggggacccaaagggttaacggaaaacgttaaccgaaaaacggtaaacccgttagggtacgggtaccttacgggaccctaacccgttaaac

SEQ ID NO: 379261 - DNA, 531 bp, Homo sapiens
  misc_feature: GZ8MTXP02IC97E.22.14.B03.1.454.CMB.2.raw
  modified_base (397)..(397): a, c, t, g, unknown or other
  modified_base (448)..(448): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctaccaccaataagagttactagcttggtccagcaagaaaccaagacatcgtcctgcactgctctatttactgggctcgtacccgggaagtcccggggtccctgaccccgattccgagtcggcaggcgggtcgtgggacagtatttcactctcaccancagcagcctgcagctagagatgtggctagttttatattgtcagactaattnttattattcctctactacgtacgttcggactaaacgggacctaaggacgtaaatacgaaacgacttgacgctacgacacctag

SEQ ID NO: 379262 - DNA, 566 bp, Homo sapiens
  misc_feature: GZ8MTXP02GXH61.22.14.B03.1.454.CMB.2.raw
  modified_base (408)..(408): a, c, t, g, unknown or other
  modified_base (414)..(414): a, c, t, g, unknown or other
  modified_base (442)..(442): a, c, t, g, unknown or other
  modified_base (566)..(566): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagtagttatttttacagctccaccaataagagttactagcttggttccagcaagaaaccaggacatcgtcctgcactgctctatttacgtcgggtccgtaccgtaccccggggaagttccccggggtccctcggaccccgtattcgaggtcgggcaggcgggtcgtggggacagtattccactcncaaccntccagcagccctgccgaggctaggaacngtgtggtactagttttatattgcaagtactaaattattaatcttacctctacgacgtacgttcgaccgtaaagggacctaaggtacgaaatacgaaaacggtactaggtcgactacgaccactn

SEQ ID NO: 379263 - DNA, 627 bp, Homo sapiens
  misc_feature: GZ8MTXP02H7DUI.22.14.B03.1.454.CMB.2.raw
  modified_base (323)..(323): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagactccctggctgtgtctcgtgggcaggacgggccaccatcaactgacaagtccagccagtagttatttttacagtcctaccaacctaataagtagttactagcttggtaccagacaagaaaccaggacactcgtctgcactgctctattacgngggtcctccgtaccggacgtcccgggtcctgaccccgtattcgagtcggcgacggtcgggtctagggactagtactttccacgtcctacaccctatcgaacgcgacgcccgtagccgaaggtctaggaacgtgtggtacgtattaagtttttatagttccgagtataccttaatttacttactaccttccgttacctacgtacgtaccggtttaccggaccgtaaaacggggtaccgtaaaaggacggtaaaacctaacgtaaaacgtcgtaacgggtcgttaccacggtacctaaccgttacc

SEQ ID NO: 379264 - DNA, 566 bp, Homo sapiens
  misc_feature: GZ8MTXP02IXTBL.22.14.B03.1.454.CMB.2.raw
  modified_base (363)..(363): a, c, t, g, unknown or other
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttactagcttggttccagcaagaaaccaggacatcgtcctgcactgctctatttactgggctcgtacccgggaatcccggggtcctgacccgatcgagtgcaggcgggtntgggacagtattcactctcacatcagcagcctgcagtctagagtatgtgactagttttatattgtacagtctaaattattaatctttccgtactacgtaacggtaccgtttcgggaccgaaaacggggtaaccctaaaggggtacgaaaacttaaccgaaaacggtaaaccttgggtaacggcctacggacctaaaccgttac

SEQ ID NO: 379265 - DNA, 516 bp, Homo sapiens
  misc_feature: GZ8MTXP02HGTIM.22.14.B03.1.454.CMB.2.raw
  modified_base (306)..(306): a, c, t, g, unknown or other
  modified_base (404)..(404): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggttccagcagaaccaggacatcgtcctgcactgctcattacngggctctacccgggaatccggggtccctgaccccgatcagtggcagcgggtctgggacagtatttcactctcaccatcagcagcctgcaggctgaagntgtgctagtttatattgtacagacaattattatacttcctctctagacgttcgcaaagggaccaaggtacggaaatacgaaaacgtaacgtgtacggacttcggacaccgta

SEQ ID NO: 379266 - DNA, 587 bp, Homo sapiens
  misc_feature: GZ8MTXP02G9ENM.22.14.B03.1.454.CMB.2.raw
  modified_base (311)..(311): a, c, t, g, unknown or other
  modified_base (413)..(413): a, c, t, g, unknown or other
  modified_base (416)..(416): a, c, t, g, unknown or other
  modified_base (430)..(430): a, c, t, g, unknown or other
  modified_base (434)..(434): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagattactagcttggttccagcaagaaaccaggacatcgtcctgcactgctctatttacgngggtccgttccgtacccgggtaacgtcccggggtccctcggacccccgtattcgaggtcggcgaggcgggtcgtggggacagtacttcactctcaccatcancancctgcagctagagngtgngtctagtttatagttcgacagtactaattattaacttactttcctacctactaacggttaccggttacggaaccggtaaacgggtaacccgtaaagggtaacgtaaaacgttaaccgaaaacgtacgtaggtcggactacggaccaacttacg

SEQ ID NO: 379267 - DNA, 575 bp, Homo sapiens
  misc_feature: GZ8MTXP02I2VY8.22.14.B03.1.454.CMB.2.raw
  modified_base (425)..(425): a, c, t, g, unknown or other
  modified_base (446)..(446): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgacaagtccagccagagttatttttacagctaccaaccaataagagttacttagcttggttccagcaagaaaccaggacatccgtctgcactgctctattacgtgggtctccgtacccgggtaagtcccggggtcctcgacccgtattcaggtcgacaggcgggtcgtgggactagtacttcgactctacaccatcagcagcctgcagctagantgtgtactagtttatatgtanagtactaattattactacttaccgtacctacgtaacggttaccgttaccggaaccgtaaacgggtaaccgtaagggtaacgtaaactaacgaaaacgtacgtaggtacgtacgtacgacctaacccgta

SEQ ID NO: 379268 - DNA, 621 bp, Homo sapiens
  misc_feature: GZ8MTXP02HJQ7J.22.14.B03.1.454.CMB.2.raw
  modified_base (362)..(362): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgaggagggccaccatcaactgacaagtccagccagtagttattttacagctccaaccaataagagttactagtcttggtccagcaacgaaaccaggacatccgtcctgcactgctctatttacgtgggtcgtaccgtacccgggaagtcccggggtcctcggaccccgtnttcgaggtcggcgaggtcgggtcgtgggactagtacgttccactctacacctatacacgcacgccgtgacgaggctaggaaagtgtggtgtacttaaggttttattagttggtacagtacttaaattatttaactactttccctactacgtaacggttaccgttaccgggaaccgtaaacggggaaaccctaaaggggtaacggtaaaactaaccggaaaaacgtacgttaggtacgggctaccggactaacccgtacg

SEQ ID NO: 379269 - DNA, 574 bp, Homo sapiens
  misc_feature: GZ8MTXP02FMDZS.22.14.B03.1.454.CMB.2.raw
  modified_base (410)..(410): a, c, t, g, unknown or other
  modified_base (434)..(434): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttgttccagcagaaaccaggacatcgtcctgcactgctcatttactgggctcgtacccgggaatccggggtccctgaccccgattcagtggcaggcgggtctgggacagattcactctcaccatccagcagccctagcaggctgaaagntggtggctaagtttattattgtanacgtataaattattaattattacccttcctacacggtaccggtttccggggaaccctaaaacggggtaccaaagggttaacgggaaaattaccgaaaaacgaaccttagggtacggtacttacggacccaacgtttaacc

SEQ ID NO: 379270 - DNA, 572 bp, Homo sapiens
  misc_feature: GZ8MTXP02GI6KH.22.14.B03.1.454.CMB.2.raw
  modified_base (419)..(419): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttacttagcttggttccagcagaaaccaggacatcgtcctgcactgctctatttactgggtcgtcgtacccgggaatcccggggtccctgaccccgtatcagtggcaggcgggtcgtgggacagtattcactctcaccatcagcagccctgccaggctagaaagntggtcggactaggttttaattattggtacagtactaaattatttatactttccctctactacggtaccgttacgggaccgaaaagggaccctaaagggtacggaaaacttacgaaaaaccgtacgtaggtcgggactacggaccaaacccttg

SEQ ID NO: 379271 - DNA, 537 bp, Homo sapiens
  misc_feature: GZ8MTXP02GDSNJ.22.14.B03.1.454.CMB.2.raw
  modified_base (414)..(414): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttactagcttggttccagcaagaaaccaggacatcgtcctgcactgctctatttacgtgggcgtccgtacccggaatccggggtccctgaccccgtatcagtggcagcgggtctgggacagtattcactctcacatcagcacgcctgccaggctgaaagntggtgctagtttatagtcgacagactaattattactacttccctctacacgtaccgttcgacctaaacgggaacctaagggtacgaaatcgaaaaacgtactggtacgctcgaccgacctaag

SEQ ID NO: 379272 - DNA, 567 bp, Homo sapiens
  misc_feature: GZ8MTXP02I09VV.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggttccagcagaaaccaggacatcgtcctgcactgctcatttactgggcgtcctacccgggaatcccggggtcctgaccccgtattccagtggcagcgggtcgtgggacagtatttcgactctcacccatcagcagccctgccaggctgaagtatggtggctagtttatagttgacagacaattattatactttccctctactaacggtacgtttcggaccgtaaacggggaaccctaaggggttacggaaaacttaaccgaaaacgaaaccgtttggacggacttacggacctaacccgtaag

SEQ ID NO: 379273 - DNA, 570 bp, Homo sapiens
  misc_feature: GZ8MTXP02JWDU1.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggttccagcagaaaccaggacatcgtcctgcactgctcatttactgggcgtctacccggggaatcccggggtcctgaccccgtattccgagtggcaggcgggtcgtgggactaggactttcactctcaccatcagcagccctgccaggctgaagatgtcggatagtttatagttgtacagactaattattatacttcccttaccgtctaacggtaccgtttacgggacccgtaaaaggggaccctaaaggggttacggaaaacttacgaaaaccgtaacgttggtacgggacttcggacccactacg

SEQ ID NO: 379274 - DNA, 588 bp, Homo sapiens
  misc_feature: GZ8MTXP02HC9HF.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagattactagcttggtccagcagaaaccaggacatcgtcctgcactgctcatttacgcgggtcgtaccgtacccggggaacgttccccggggtaccctggaccccgattcgagtggcaggcgggtcgtgggacagtattcactctccacatccagcagccctgccgaggctaggaaagtgtggtgtacgtagtttttatacgttgtacagtactaaattatttaacttactttcctcctacgtaacggtacgttccggaccgaaaagggtaccctaagggtaacggaaacttaccgaaaacgtaaaccgttgggtacgccgttacgacctacctaacg

SEQ ID NO: 379275 - DNA, 571 bp, Homo sapiens
  misc_feature: GZ8MTXP02GHOAD.22.14.B03.1.454.CMB.2.raw
  modified_base (395)..(395): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggttccagcaagaaaccaggacatcgtcctgcactgctcatttacgtgggccgtccgtaccccgggaagtcccggggtccctgaccccgattcgagtggcaggcgggtcgtgggacagtattcactctcacntcagcagccctgcaggctaggaacagtcggtggactagtttttatagttgtacagtactaattattatacttcctactacgaggtaccgtttcggaccgtaaacggggacctaaaggggtacgaaaacttaccgaaaaacggtacgtaggtacggacctacggacctaaccttacg

SEQ ID NO: 379276 - DNA, 584 bp, Homo sapiens
  misc_feature: GZ8MTXP02IZHG9.22.14.B03.1.454.CMB.2.raw
  modified_base (414)..(414): a, c, t, g, unknown or other
  modified_base (452)..(452): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttactagcttggttccagcagaaaccaggacatcgtcctgcactgctcatttactgggctccgtacccgggaatcccggggtcctgaccccgattcagtcggcaggcgggtcgtgggacagtattcactctcaccatcagcagcctgcaggctagaaagntggtggtctaggtttttatattggtacagtctaaattnttaattactttccaccttacgaacggtacggtttaccggaccgtaaaacgggggtaccctaaaaggggtacggaaaaccttacgaaaaaccggtaccgttaggtacgggacttacggacctaacccggttaa

SEQ ID NO: 379277 - DNA, 621 bp, Homo sapiens
  misc_feature: GZ8MTXP02IVBZJ.22.14.B03.1.454.CMB.2.raw
  modified_base (317)..(317): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgacaagtccagccagtagttatttttacagtctaccaaccaataagtagttactagcttggtccagcaagaaaccaggacatcgtcctgcactgctctattacgnggtccgtacgtacccgggtagtcccgggtcctcgaccccgtatcgagtcggcacggcgggtcgtgggactagtacttccactcgtaccacctatcgagcgacgcccgtagaccaggtctaggaaagtgttggtacggtacttaaggtttttattagttacggtacaagtacttaaatttaactttactaactttccctactacgtacgtaccggttaccggaaccgtaaaaggggacctaaagggtaccgaaaagtaccgtaaaacggtacgtacggtacggtaccttcgaaccgtaccttacg

SEQ ID NO: 379278 - DNA, 553 bp, Homo sapiens
  misc_feature: GZ8MTXP02HU7KR.22.14.B03.1.454.CMB.2.raw
  modified_base (307)..(307): a, c, t, g, unknown or other
  modified_base (395)..(395): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggtccagcagaaaccaggacatcgtcctgcactgctcatttacngggctccgtacccggaatcccggggtcctcgaccccgtattcagtggcacggcgggtctggggacagtatttcacgtctaccacctancagcacgctgacacgctagagtgtggtgtattagtttattagttcgtacagtactaaattattaatacttacctctacgtacgtacgttccgaacgaaacggaaccgtaaggtacgaaacacgtaaaacgtacgtggtacgacgtacgacctacgtac

SEQ ID NO: 379279 - DNA, 600 bp, Homo sapiens
  misc_feature: GZ8MTXP02GGUEN.22.14.B03.1.454.CMB.2.raw
  modified_base (296)..(296): a, c, t, g, unknown or other
  modified_base (429)..(429): a, c, t, g, unknown or other
  modified_base (448)..(448): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgcaagtccagccagagttatttttacagctccaaccaataagattactagctgttccagcaagaaaccagacatcgtctgcacngctctatttacgtgggccgtaccgtacccgggaacgtcccggggtccctcgaccccgattcgagtggcaggcgggtcgtgggacagtacttcactctacaccatcaacggcacgtccctgcaggctagaaagntaggtggacttagttttanagtttgacaagtataaattatttaaatcttacctacctacgtaacggtaccgtttaccgggaaaccgtaaacggggaaacccgtaagggttaaacggaaaacttaaccggaaaaacgtaacgtggtaacggccttacgacctaacccttaag

SEQ ID NO: 379280 - DNA, 604 bp, Homo sapiens
  misc_feature: GZ8MTXP02IGKOD.22.14.B03.1.454.CMB.2.raw
  modified_base (312)..(312): a, c, t, g, unknown or other
  modified_base (455)..(455): a, c, t, g, unknown or other
  modified_base (474)..(474): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttactagcttggttccagcaagaaaccaggacatcgtcctgcactgcactatttacgngggcgtaccgtacccgggaagttcccggggtccctggaacccccgtagttccaggttcggacgacgggtcgggtcgttaggggaactacgtacgtttccacgtccttcaccctatccaagtcagcccgtgacgaggtcagagngtgtggtctaagttttatnttggacagactaaatattatacttcctctacgtacgtaccggttcggaacctaaacgggaccgtaaggtacggaaaacttaccgaaaaacgttacgtacgggtcggtacctacggaacccttaaacgtcg

SEQ ID NO: 379281 - DNA, 548 bp, Homo sapiens
  misc_feature: GZ8MTXP02HKB09.22.14.B03.1.454.CMB.2.raw
  modified_base (308)..(308): a, c, t, g, unknown or other
  modified_base (422)..(422): a, c, t, g, unknown or other
  modified_base (425)..(425): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttactagcttggtccagcagaaaccaggacatcgtcctgcactgctcatttacngggtccgtcgtaccccgggaatcccggggtccctgaccccgtattccgagtggcaggcgggtcgtgggacagtatttcacgtctcaccatcagcagccctgcaggctagaacgntgnggctagttttatattgacagactaaatatttatacttcctctcaacgtccggttcgaaccgaaagggaccaaagggttacgaaaactacgaaaacgtacgtagtacggacctgacctactacg

SEQ ID NO: 379282 - DNA, 558 bp, Homo sapiens
  misc_feature: GZ8MTXP02JY2DG.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggttccagcagaaaccaggacatcgtcctgcactgctcatttacgtgggcgtctacccgggaatcccggggtcctgaccccgattcagtggcaggcgggtctgggcagtattcactctccaccatcagcacgccctgcgagctgaagtatggtggctagtttatattgtcagctaaatattatactttcctacttcacgtaccgttcggacccgtaaaggggaccctaaaggggtacggaaaactacgaaaaaccggaaccttaggtacggtaccgttacgaccgtaacctaacg

SEQ ID NO: 379283 - DNA, 586 bp, Homo sapiens
  misc_feature: GZ8MTXP02F2LML.22.14.B03.1.454.CMB.2.raw
  modified_base (295)..(295): a, c, t, g, unknown or other
  modified_base (404)..(404): a, c, t, g, unknown or other
  modified_base (427)..(427): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagacttcctggctgtgtctctgggcgagagggccaccatcaactgcaagtccagccagagttatttttacagctccaccaataagagttacttagcttggttccagcaagaaaccaggacatcgtccngcactgctctatttacgtgggccgtaccgtacccgggtaacgtcccggggtccctcgaccccgtattcgagtcggcaggcggggtcgtgggacagtattcactctcacntcagcagcctgcaggctaggaanattggcgacttagtttattgttagtcagactaaattattatacttccctactacgaacggttacggttacccgggaacgtaaaacgggggtacctaaaaggggtacgtaaaactaacgaaaaccggtaacgtggtaccggacctacgaccctaacctag

SEQ ID NO: 379284 - DNA, 527 bp, Homo sapiens
  misc_feature: GZ8MTXP02GEP47.22.14.B03.1.454.CMB.2.raw
  modified_base (308)..(308): a, c, t, g, unknown or other
  modified_base (448)..(448): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccacaataagagttactagcttggttccagcagaaaccaggacatcgtcctgcactgctctatttacngggctcgtaccccgggaatccggggtccctgaccccgattcagtgcagcgggtctgggacagatttcactctcaccatccagcagccctgctaggctgaagatgtggctagtttatattgtcagcaatattatatcctcnctagacgttcggcctaaacgggacctaagggtacgaaaattacgaaaacgaacgtggtacggactacggaccacgtaac

SEQ ID NO: 379285 - DNA, 567 bp, Homo sapiens
  misc_feature: GZ8MTXP02JD136.22.14.B03.1.454.CMB.2.raw
  modified_base (313)..(313): a, c, t, g, unknown or other
  modified_base (399)..(399): a, c, t, g, unknown or other
  modified_base (425)..(425): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagtagttatttttacagcctccaaccaataagagttactagcttggtccagcaagaaaccaggacatcgtctgcactgctctatttacgnggggtcgtcgtaccccggggatcccggggtcctggaccccgtatcgagtcggcaggcgggtcgtgggacagtattcactctcaccntcagcagcctagcaggtctagaacgnttggaggtactaaggttttattactgtacaggtactaaatttattatacttcctactacgtacggtaccgttacggacccgaaagggaaccctaagggtacgaaactacgaaacgaacgtggacggactcggacctacgtac

SEQ ID NO: 379286 - DNA, 538 bp, Homo sapiens
  misc_feature: GZ8MTXP02IJNVC.22.14.B03.1.454.CMB.2.raw
  modified_base (411)..(411): a, c, t, g, unknown or other
  modified_base (425)..(425): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttactagcttggttccagcaagaaaccaggacatcgtcctgcactgctcattactgggctctacccgggatccggggtcctgaccccgattccagtcggcagcgggtctgggacagtatttccgactctccacctatcagcagcctgcagctgaagntgtgctagtttatnttgacagacaaattattatattccctactactagtaccgttcggacctaaaaggggaccctaaagggtacgaaatacgaaaacgacgttggtacggctacgacctacgtaacg

SEQ ID NO: 379287 - DNA, 555 bp, Homo sapiens
  misc_feature: GZ8MTXP02GW2G0.22.14.B03.1.454.CMB.2.raw
  modified_base (432)..(432): a, c, t, g, unknown or other
  modified_base (473)..(473): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctctatttactgggcgtccgtacccgggaacgtcccggggtcctcgaccccgtattcgagtcggcgaggcgggtctggggacagtactttcactctcacatcacgcagccctgccgagctgaagatggtcggntagtttatattgcagactaattatttatacttcgtaccctntaagtaccgttcggacctaaaggggaaccaagggttacgaaacttacgaaaacgacgtaggcggtacctaggacctacgtac

SEQ ID NO: 379288 - DNA, 647 bp, Homo sapiens
  misc_feature: GZ8MTXP02IE7X6.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtggggcgaggagggccaccatcaactgcaagtccagccagagttatttttacagctaccaccaaataagagttactagcttggtccagcagaaaccaggacatcgtcctgcactgctctatttacgtgggctccgtacccgggaacgtccccggggtccctggacccccgtattccgaggttcggcgacggtcggggtcgtcggggaacaggttactttccacttcctaccaccctatccagccaacgccctaggaccaagggcctaggaagagtggtagtcgtaagtttttaattagttggttacaacgacttaaattagtttaacttactttcccgttacctactaacggttaccggtttaccgggacctaaaacgggggacctaaaggggtacggtaaaacttacggaaaacccgttaacgttggtacggtacccgttaggaccctaaaccgttcg

SEQ ID NO: 379289 - DNA, 556 bp, Homo sapiens
  misc_feature: GZ8MTXP02FVFYJ.22.14.B03.1.454.CMB.2.raw
  modified_base (468)..(468): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccacatcaactgcaagtccagccagagttatttttacagctccacaataagattactagcttgttccagcaagaaaccaggacatcgtacctgcactgctcatttactgggctctacccgggaatccggggtccctgaccccgattcagtgcagcggggtctggggacaggtacttcgactctcacatcagcagcctgcaggctagaaagatggtagcgtaagttttatactttagtcaagtctaaattatttattacttccctcctanaacgtacgtttccggaccgtaaacggggaaccctaaagggtacgaaaattacgaaaacgtaacgtggacggcctacggaccacctaag

SEQ ID NO: 379290 - DNA, 535 bp, Homo sapiens
  misc_feature: GZ8MTXP02J18TA.22.14.B03.1.454.CMB.2.raw
  modified_base (254)..(254): a, c, t, g, unknown or other
  modified_base (356)..(356): a, c, t, g, unknown or other
  modified_base (373)..(373): a, c, t, g, unknown or other
  modified_base (380)..(380): a, c, t, g, unknown or other
  modified_base (452)..(452): a, c, t, g, unknown or other
tcagacatacgcgtcacgaccggtgctcgatttagtgtgagtagttccgcgggggagctacaacaggcaggcagggcagcaagatggtgttgcagacccaggtcttcatttctctgttgctctggatctctggtgcctacggggacattgtgatgaccccagtctccagactccctggctgtgtctctgggcgagagggccaccatcaactgcaagtccagccagagttattttttacagctccaccaataagngttacttagcttggttccagcagaaaccaggacatcgtcctgcactgctcaattttactggggcgtcgtaccccggggaatcccggggtccctgacccccgnttcagtggcagcgggtntgggacngatttcactctcaccatccagcagccctgcaggctgaaagatgtggactagttttatttatgtcagcaattnttatatttccctctacagtcgtttcggaccaaaggggaccaaagggtcgaaatcgaaaacgacttagtacggctgacacctac

SEQ ID NO: 379291 - DNA, 597 bp, Homo sapiens
  misc_feature: GZ8MTXP02HY1FF.22.14.B03.1.454.CMB.2.raw
  modified_base (312)..(312): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgaccccagtctccagactccctggctgtgtctctgggcgagagggccaccatcaactgcaagtccagccagagttatttttacagctccaaccaaataagagttactagcttggtccagcagaaaccaggacatcgtcctgcactgctcatttacgngggcgtcgtaccccgggaatcccggggtccctgaccccgtattccagtcggcaggcgggtcgtggggacagtactttcactctcaccatcacgcaggccctgcaggctagaagagtggtggtctaaggttttattattaggtacctagactaaattattaattactttccctactactaacgtaccggtttaccggaaccgtaaagggggaaaccctaagggttaacgggaaaacttacgaaaaaccggtaactagggtacggtacctacggacctaaccctacg

SEQ ID NO: 379292 - DNA, 549 bp, Homo sapiens
  misc_feature: GZ8MTXP02JE3GR.22.14.B03.1.454.CMB.2.raw
  modified_base (462)..(462): a, c, t, g, unknown or other
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctcaccaataagagttactagcttggttccagcagaaaccaggacatcgtcctgcactgctcatttactgggcgtctacccgggaatccggggtccctgaccccgattcgagtggcaggcgggtcgtgggacaggtattcactctcacccatccagcagccctgccgaggctagaagatggtgctaggtttattattgcaagctaaattattatacttcctcctnacggtacgttcggacccaaagggacccaaagggttacggaaaacttaccgaaaaacgtaccgtaggtacggactcgaccacgtaacg

SEQ ID NO: 379293 - DNA, 542 bp, Homo sapiens
  misc_feature: GZ8MTXP02H9HRA.22.14.B03.1.454.CMB.2.raw
  modified_base (337)..(337): a, c, t, g, unknown or other
  modified_base (418)..(418): a, c, t, g, unknown or other
  modified_base (521)..(521): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcaggaggccaccatcaactgcaagtccagccagagttatttttacagctccaccaataagattactagcttggttccagcaagaaaccaggacatcgtcctgcactgctctatttactgggctcgacccgggaatcccggggtccngaccccgattcagtggcaggcggggtctggggactagtatttccgactctcacctatcagccagcctgcgaggctggaaanctgtaggctaagttttatagttgcagactaattatttatcttactcctactacgtacgttcggacctaaagggacctaaagggtacgaaatacgaaaagtacnggtacgcctagcctaaccgta

SEQ ID NO: 379294 - DNA, 563 bp, Homo sapiens
  misc_feature: GZ8MTXP02HU9EO.22.14.B03.1.454.CMB.2.raw
  modified_base (309)..(309): a, c, t, g, unknown or other
  modified_base (425)..(425): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaaccaataagagttactagcttgtccagcaagaaacaggacatcgtcctgcactgctcatttacgngggctccgtacccgggaagtcccggggtcctgaccccgtattccgagtcggcaggtcgggtcgtggggacagtatttccactctccaccatcagcagccctgccaggctagaaagntagcggtactagttttatattgacaagtctaaattatttatacttcctctactacgtacgtttccgaccgtaaaggggaaccctaaggggtacgtaaactaacgaaaacggtaatcggtcggactcgacctaccgtag

SEQ ID NO: 379295 - DNA, 498 bp, Homo sapiens
  misc_feature: GZ8MTXP02JZWV7.22.14.B03.1.454.CMB.2.raw
  modified_base (306)..(306): a, c, t, g, unknown or other
  modified_base (396)..(396): a, c, t, g, unknown or other
  modified_base (418)..(418): a, c, t, g, unknown or other
  modified_base (420)..(420): a, c, t, g, unknown or other
  modified_base (468)..(468): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagtactagcttggtccagcagaaaccaggacatcgtcctgcactgctcatttacngggctctaccggaatccggggcctgacccgatcagtgcagcgggtctgggacagattcactctcaccatcagcagcctgcaggctagaanatgtgctagtttattatgtcananatatatatctctcacgtacgtcgacgaacggaacgaacgtaacgaaanaacaaacgaactacgtcgacgacgacacac

SEQ ID NO: 379296 - DNA, 550 bp, Homo sapiens
  misc_feature: GZ8MTXP02H5EL4.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactcccctggctgtgtctctgggcgagagggccaccatcaactgcaagtccagccagagtatttttacagctccaccaataagagttacttagcttggttccagcagaaaccaggacatcgtcctgcactgctcatttactgggcgttctacccgggaatcccggggtccctgccccgattcagtggcaggcgggtctggggacaggatttccactctcaccatcagcagccctgcaggctagaagatgtggctaaggtttattattgtacagcaattattatatttcctcttcagtaccgtttacggacccgtaaagggaccctaaagggtacgaaaacgttacaaaacgtacgtagtacgggctacggaccaacctacg

SEQ ID NO: 379297 - DNA, 594 bp, Homo sapiens
  misc_feature: GZ8MTXP02IR5JT.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagtagttatttttacagctccaacaataagagttactagcttggtccagacagaaaccaggacatcgtacctgcactgctctatttacgtcgggtccgttaccgtaacccgggtaacgtccccggggtccctggaaccccgtacttcgacggtcggcaggtcgggtctgggaacagtacttcactctacacatcagcagcctgcaggctagagtatgtaggtctagtttatattgactagactaattattactacttcctacactaacggccgtttaccggacctaaacggggtaaaccctaaggggtaaacggtaaaactacgaaaaacggtaccgtaggggttacacgtttacggacctaaccctaacg

SEQ ID NO: 379298 - DNA, 607 bp, Homo sapiens
  misc_feature: GZ8MTXP02HRO91.22.14.B03.1.454.CMB.2.raw
  modified_base (314)..(314): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactcccctggctgtgtctctgggcgagagggccaccatcaactgcaagtccagccagagttatttttacagctccaccaataagagttacttagcttggtccagacaagaaaccaggacatccgtcctgcactgctcatttacgngggcgtcgtacccgggaatcccggggtccctgaccccgattccgagtcggcacggcgggtcgtggggacagtactttcactctaccacatcagcacgcctcgcaggctagaagagtggtggtacttaaggtttttatagttgtacagactaaattatttataactttcctacctacgtacgttaaccggtttccggaacccgtaaacggggtaacccaaagggttacggtaaaacttaaccgaaaaaccggtaccgttaggttacgggaccttacggaccctaaccgttaacg

SEQ ID NO: 379299 - DNA, 570 bp, Homo sapiens
  misc_feature: GZ8MTXP02I78AS.22.14.B03.1.454.CMB.2.raw
  modified_base (296)..(296): a, c, t, g, unknown or other
  modified_base (314)..(314): a, c, t, g, unknown or other
  modified_base (400)..(400): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctaccaccaataagagttacttagcttggttccagcaagaaaccaggacatcgtccngcactgctctatttacgngggtcgtccgtacccgggagtcccggggtcctcgaccccgtattcgagtcggcaggcgggtcgtgggacagtattcactctcaccntcagcacgccctgccgagcgtagagtagtggtggtacttaggtttattagttgtacacgtataaatttatattactttcctactacgtacgtccgttacggaccgaaaggtacccgaagggtaacgaaactaacgaaaacgtacgtaggtacgtccgtacaccgactacg

SEQ ID NO: 379300 - DNA, 555 bp, Homo sapiens
  misc_feature: GZ8MTXP02JR2VY.22.14.B03.1.454.CMB.2.raw
  modified_base (413)..(413): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttactagcttggtccagcagaaaccaggacatcgtctgcactgctcattactgggcgtcgtacccgggaatcccggggtcctgaccccgattcgagtcggcaggcgggtctgggacagtacttcgactctcaccatcagcagccctgcaggctagaacntggtggctagtttatagttgtacagtacaattattatacttcctctactaacgtcgttcggaccctaaaggggaccctaaagggtacggaaaacttacgaaaaccgtaacgtttcgggacggacttaccggaccaactaacg

SEQ ID NO: 379301 - DNA, 603 bp, Homo sapiens
  misc_feature: GZ8MTXP02IUNQA.22.14.B03.1.454.CMB.2.raw
  modified_base (452)..(452): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttattttttacagctccaccaaataagagttacttagcttggttccagcaagaaaccaggacatcgtcctgcactgcctctatttacgtgggtccgttccgtaccccggggtaacttcccgggggtcccctcggacccccgtagttccgagttcggcacggtcgggtcgtggggacagtactttccactctcacccatccagcagccctgccaggctaggaaagnttggtagtctaaggtttttattagttggtaccagtctaaatttattaactactttccctctacgtacggtaccgttacggaccgtaaacgggaacctagggtaacgaaacttacgaaaacgtacgtaggtacgactacgacgtaacctacg

SEQ ID NO: 379302 - DNA, 509 bp, Homo sapiens
  misc_feature: GZ8MTXP02IMO5Y.22.14.B03.1.454.CMB.2.raw
  modified_base (307)..(307): a, c, t, g, unknown or other
  modified_base (442)..(442): a, c, t, g, unknown or other
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggttccagcagaaaccaggacatcgtcctgcactgctcatttacngggctctacccgggaatccggggtcctgaccccgattcagtgcagcgggtctgggacagatttcactctcaccatcagcagccctgcaggctgaagatgtggctagtttattattgtcagcaatattatattccnctcagtacgttcggcctaaaggggaccaaaggtaggaaactcgaaaacgaactgtacgctagcacta

SEQ ID NO: 379303 - DNA, 642 bp, Homo sapiens
  misc_feature: GZ8MTXP02JUPR4.22.14.B03.1.454.CMB.2.raw
  modified_base (450)..(450): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatcgacccagtctccagacctccctggctgtgtctcgtgggcgaggacgggccaccatcaactgacaacgtccagccagtagttatttttacagcctaccaactaatagtagttactagtcttgtccagacaacgaaaccgaggactagtccgtcctgcactcgtctactagtttacgtcgggtaccgtaccggtacccggggtaacgttccccggggtcctacggtaccccgtacgttacgacggtcggcgacgggtcgggtcggtacgggactacgtcttccgactcaccaccngtaccagccgacgcccgtaggcgacgtacgtaagaacgtgtggtacgtatttagtttactagttcgtactagtacttaattatttaactccgtttccctacgtacgtaaccggtccgttaccggaacgtaaacgggacgtaaaggtaacgtaaactacgaaacgtcgtacggtacactacgaccaactttcg

SEQ ID NO: 379304 - DNA, 539 bp, Homo sapiens
  misc_feature: GZ8MTXP02HB7D1.22.14.B03.1.454.CMB.2.raw
  modified_base (307)..(307): a, c, t, g, unknown or other
  modified_base (410)..(410): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggtccagcagaaaccaggacatcgtcctgcactgctcatttacngggcgtcgtacccgggaatccggggtcctgacccgatcagtggcaggcgggtctgggacagtatttcactctcaccatcagcagccctgccaggctagaaagntggtggctaagttttatagttgacagctaattattatacttcctctcgaagtccgttcggaccgtaaagggacctaagggtacgaaaactacgaaaacgtacgtaggtacggctacggacctaactacg

SEQ ID NO: 379305 - DNA, 502 bp, Homo sapiens
  misc_feature: GZ8MTXP02GZ16B.22.14.B03.1.454.CMB.2.raw
  modified_base (278)..(278): a, c, t, g, unknown or other
  modified_base (305)..(305): a, c, t, g, unknown or other
  modified_base (389)..(389): a, c, t, g, unknown or other
  modified_base (399)..(399): a, c, t, g, unknown or other
  modified_base (405)..(405): a, c, t, g, unknown or other
  modified_base (419)..(419): a, c, t, g, unknown or other
  modified_base (421)..(421): a, c, t, g, unknown or other
  modified_base (423)..(423): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttgtccagcagaaaccngacatcgtcctgcactgctcatttacngggcgtctacccgggaatccggggtcctgacccgattcagtggcaggcggtcgtgggacagattcatctcacatcagcagcctncaggctgaanatgtgntagtttatatgtanananatatatatctctctacgtacgtcgacgaacggaacgaacgaacgaaacaacaaacgaacgtagtacgacacgacactac

SEQ ID NO: 379306 - DNA, 538 bp, Homo sapiens
  misc_feature: GZ8MTXP02HC2G1.22.14.B03.1.454.CMB.2.raw
  modified_base (371)..(371): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaaccaataagagttactagcttggttccagcagaaaccaggacatcgtcctgcactgctcatttactgggccgtccgtacccgggaagtcccggggtccctgaccccgattccagtggcaggcgggtntgggacagatttcactctcaccatcagcagccctgcaggctagaaagactgtggactagttttatattgtacagctaaattactttatacttcccgtctacagtaccgttcgacccaaaggggaccaagggtacgaaatacgaaaagactagtgactcgacaaccta

SEQ ID NO: 379307 - DNA, 589 bp, Homo sapiens
  misc_feature: GZ8MTXP02GF4LN.22.14.B03.1.454.CMB.2.raw
  modified_base (302)..(302): a, c, t, g, unknown or other
  modified_base (387)..(387): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctcctgactccctggctgtgtctctgggcgagaggccaccatcaactgcaagtccagccagagtatttttacagctccaccaataagagttacttagcttggttccagcaagaaaccaggacatcgtcctgcactgctnatttactgggcgtcgtacccgggaatccggggtcctgacccgatcgagtggcagcgggtctgggacagtatttccactctcaccntcacgcagccctgccgagggcctagaaaagtgtaggtcgtactaaggttttattatttggtacagactaaattactttaaatctttaccctccttacaacggtaccggtttcggacccgtaaaaggggaccctaaaagggtagtaaaacgttaccgaaaaacggtacgtacggttagggaccttacggacctaaccgtaacg

SEQ ID NO: 379308 - DNA, 607 bp, Homo sapiens
  misc_feature: GZ8MTXP02HL59G.22.14.B03.1.454.CMB.2.raw
  modified_base (435)..(435): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgaggagggccaccatcaactgcaagtccagccagagttatttttacagctaccaaccaataagagttacttagcttggtccagacaagaaaccaggacatcgtcctgcactgctactattacgtgggtcctccgtaacccgggacgtcccggggtccctaggacccccgtatacgagtggcgacggcgggtcgtagggacagtattccactctcaccatcagcagccctgacaggctagaagntggaggctaagtttttagtattggtacagtactaaattactttatacctttacctccgtacacggttacccggtttcgggaaaccctaaaagggggtacccctaaagggtaccggaaaaacttccaaaaaacggtcgttaggtccgggacctacgggaccttaaaccccgtg

SEQ ID NO: 379309 - DNA, 574 bp, Homo sapiens
  misc_feature: GZ8MTXP02HIOLF.22.14.B03.1.454.CMB.2.raw
  modified_base (476)..(476): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgaggagggccaccatcaactgacaagtccagccagagttattttacagctccacaataagagttactagcttggtccagacagaaaccagacatcgtctgcactgctctatttacgtgggtccgtccgtacccgggaacgtcccggggtccctggaccccgtattccgaggtcggcgacggcgggtctgggacagtacttcactctccactatcagcagccctgacaggctagaagtatggtgactagttttatattgacagtactaaattattatacttcccnctacgtacgtaccgttcggaacccaaagggggtaccctaaagggtacgaaaactaccgaaaaacgtacgttaggacggacctacggaccctaacctag

SEQ ID NO: 379310 - DNA, 577 bp, Homo sapiens
  misc_feature: GZ8MTXP02G2FZK.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttactagcttggtccagcagaaaccaggacatcgtcctgcactgctctatttacgtgggagtccgtaaccccgggaagtccccggggtccctgaccccgattcagtggcagcgggtcgtgggacagtatttcactctcaccatcagcagccctgccaggctagaagatgtgctagttttatattggacaagtactaaattattaattacttccctacctcgtaaggtacccgttcggaacccgaaagggggaaccctaaaggggtaacgtaaaactaccgaaaaacggtaacctaggtacggtactacggacctaacctaacg

SEQ ID NO: 379311 - DNA, 614 bp, Homo sapiens
  misc_feature: GZ8MTXP02GTP66.22.14.B03.1.454.CMB.2.raw
  modified_base (300)..(300): a, c, t, g, unknown or other
  modified_base (367)..(367): a, c, t, g, unknown or other
  modified_base (415)..(415): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggacggccaccatcaactgacaagtccagccagtagttatttttacagctaccaccaataagtagttactagcttggtccagacaagaaaccaggacatcgtccngcactgctctatttacgtgggtccgtacgtacccgggtacgtcccgggtcctcgacccgtacgttcnggtacggcgaggcgggtcgtagggactagtactttcactctccaactntacagccagccctgacgacgggtctaaggacgtagttggtcggtatttaaggtttattagtgtacaagtacttaaatatttaactcttaccctctacgtaacgtaccggttacgggaaccgtaaaacggggtaccctaaaagggtacgtaaaactaccgaaaaggtaccgtggtacgggaccttacgaccttaccgtaa

SEQ ID NO: 379312 - DNA, 546 bp, Homo sapiens
  misc_feature: GZ8MTXP02HLOY8.22.14.B03.1.454.CMB.2.raw
  modified_base (239)..(239): a, c, t, g, unknown or other
  modified_base (310)..(310): a, c, t, g, unknown or other
  modified_base (468)..(468): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacanctccaaccaataagagttactagcttggttccagcaagaaaccaggacatcgtcctgcactgctcatttcngggctcgaccggacgtccgggtccctgaccccgtatccagtgcgagcgggtcgtgggacagtatttcactctacacatccagcacgccctgccaggctagaagatggtagcttaaggttttatagtttgacagtactaaagttattatacttcgtccnctaacgtcgttacggaccgtaaaggaaccgtaaggtacgaaatacgaaaacgcttaggtacgactcggaacctactac

SEQ ID NO: 379313 - DNA, 659 bp, Homo sapiens
  misc_feature: GZ8MTXP02HR6C9.22.14.B03.1.454.CMB.2.raw
  modified_base (297)..(297): a, c, t, g, unknown or other
  modified_base (309)..(309): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgaggagggccaccatcaactgcaagtccagccagagttatttttacagctccacaataagagttactagcttggtccagcaagaaccagactatcgtcctgcacngctcatttacgngggcgtccgtaccgggaactcccggggtccctgaccccgtattcgaggtcggcacggtcgggtcgtaggggactaggttaccttaccgacctcttacccaactacacgacgacgaccgtcgtacgaccggtacgtacgaagaacgttagttacgggtacgggtactttaagtttttagttagttacgtacgtaacgtaaacttaattaatttaacttaccgttacctactaccggtaacgttacccggtaacccgaacgggtaaaaccggtaaacggtaaacgggtaaacgtaaacgtaaacggaaaaccgttacggtacggtacgacggttaccgaaccttaacttccg

SEQ ID NO: 379314 - DNA, 568 bp, Homo sapiens
  misc_feature: GZ8MTXP02GEVPI.22.14.B03.1.454.CMB.2.raw
  modified_base (435)..(435): a, c, t, g, unknown or other
  modified_base (439)..(439): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctaccaccaataagagttactagcttggttccagcaagaaaccaggacatcgtcctgcactgctctatttacgtgggccgtaccgtaccccgggaacgttcccgggggtcccctacggaccccgtacttcgagtcggcgaggcgggtcgtgggacagtacttcactctcaccatcagcagccctgcagctagaagntggngactagttttatattggtcagactaaattatttatacttacctctacacgtaccggttcgacgaaacggggacctaaagggtacggaaactaacaaaacggtacgtggtacggctacggaccaccctag

SEQ ID NO: 379315 - DNA, 551 bp, Homo sapiens
  misc_feature: GZ8MTXP02F4O60.22.14.B03.1.454.CMB.2.raw
  modified_base (385)..(385): a, c, t, g, unknown or other
  modified_base (399)..(399): a, c, t, g, unknown or other
  modified_base (412)..(412): a, c, t, g, unknown or other
  modified_base (442)..(442): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagtatttttacagctccaccaataagagttactagcttgttccagcagaaaccaggacatcgtcctgcactgctctatttacgtagggtcgtccgtaccccggggaatcccggggtccctcgaccccgtattccagtggcaggcgggtcgtgggactagtntttcactctcaccntcagcacgctgcnggctgagatggtgctagtttattattgtanagactaatattatacttcctacctcacgtacggttccgtaccgaaagggtaccctaaaggtacggaaacttacgaaaaccgtacgaggtacgactacggcctaactacg

SEQ ID NO: 379316 - DNA, 561 bp, Homo sapiens
  misc_feature: GZ8MTXP02I0UGY.22.14.B03.1.454.CMB.2.raw
  modified_base (309)..(309): a, c, t, g, unknown or other
  modified_base (425)..(425): a, c, t, g, unknown or other
  modified_base (431)..(431): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagacctccctggctgtgtctctgggcgagagggccaccatcaactgcaagtccagccagtagttatttttacagctccaccaataagattactagcttggtccagcaagaaacaggacatcgtctgcactgctctattacgngggtcgtcgtacccgggaacgtcccggggtcctcgaccccgtatcgaggtcggcaggcgggtcgtgggactagtacttcactctcaccatcagcagcccgtgccgagctagaagtntacggngtacttagtttattagttgtacagtactaattattactactttccctcgtactacggtacgttacgaccgtaaacggacgtaacggtagtaactaaacgaacgaacgtacgtacggctacgcctacgtac

SEQ ID NO: 379317 - DNA, 553 bp, Homo sapiens
  misc_feature: GZ8MTXP02G1YBP.22.14.B03.1.454.CMB.2.raw
  modified_base (310)..(310): a, c, t, g, unknown or other
  modified_base (400)..(400): a, c, t, g, unknown or other
  modified_base (422)..(422): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttgttccagcagaaaccaggacatcgtcctgcactgctctactttacgngggtcgtccgtacccggggaacgtcccggggtccctggaccccgattcgagtggcaggcgggtcgtgggacagtatttcactctcacctntcagcagcctgcaggctagagngtgtcggctagttttatagttggtacaagtacaaattattatactttcctctacgtagtaccggttcgaccgaaacgggacctaagggtacgaaactacgaaaacgacgtgtacggctacgacctactacg

SEQ ID NO: 379318 - DNA, 548 bp, Homo sapiens
  misc_feature: GZ8MTXP02JUSYY.22.14.B03.1.454.CMB.2.raw
  modified_base (371)..(371): a, c, t, g, unknown or other
  modified_base (414)..(414): a, c, t, g, unknown or other
  modified_base (424)..(424): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaaccaataagagttacttagcttggttccagcaagaaaccaggacatcgtctgcactgctcatttactgggctctacccgggaatcccggggtcctgaccccgattcagtgcaggcggtcgtgggacngtattcactctcaccatcagcagccctgcaggctagagatggngctaggtttnttatggtacagactaatattatacttcctactctagtaccgttcggaccgtaaacggggaccctaagggtacggaaaactacgaaaacggtaaacgtggttacgaccgtacggtaccacgttac

SEQ ID NO: 379319 - DNA, 576 bp, Homo sapiens
  misc_feature: GZ8MTXP02FMAUL.22.14.B03.1.454.CMB.2.raw
  modified_base (412)..(412): a, c, t, g, unknown or other
  modified_base (441)..(441): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagtagttacttagtcttggttccagcaagaaaccaggacatccgtcctgcactgctctattttacgcgggtccgtaccgtaccccgggaaacgtccccggggtcccctacggaccccgtattccgaggtcggcaggcgggtcgtgggacagtacttcactcncaccatcagcagcctgcagcgtagaaagngtagtggacttagtttattagttgtacagtataaattattactattcccgtctacgtacgtacggttaccgaccgaagggtaccaaagggtagaaactaacgaaacgtaacgtgtacggactacgacctactacg

SEQ ID NO: 379320 - DNA, 665 bp, Homo sapiens
  misc_feature: GZ8MTXP02HW4YT.22.14.B03.1.454.CMB.2.raw
  modified_base (472)..(472): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagacctccctggctgtgtctcgtgggcgagacgggccaccatcaactgacaagtccagccagtagttatttttacagctaccaacaataagtagttactagtcttggtaccagacaacgaaaccaggacatcgtcctgcactgctactatttacgtgggtccgttaccgtaacccgggacgtccccggggtccctacggaccccgtacgttcgaggtcggcgacggcgggtcgtggggacctagtactttaccgactactccacctactcgacgcgacgccgtcgaccgtaggctaagggaaagngttggtaggtactttaagttttagtttattcggtactaggtactaaatttattacttaccttccctaccttacgtaacgttacccggtttaccggggaaaccctaaacgggggtaaaccctaagggggttaaacgaaaacgtaaaccgaaaacggttaaccgttggtacggacttaacgaccgtaaccttacg

SEQ ID NO: 379321 - DNA, 531 bp, Homo sapiens
  misc_feature: GZ8MTXP02G6GKO.22.14.B03.1.454.CMB.2.raw
  modified_base (410)..(410): a, c, t, g, unknown or other
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggctcgtacccgggaatccggggtcctgaccccgattcagtgcagcgggtctgggacagatttcactctcaccatccagcagcctgcaggctagaagatgnggctagttttatattgtacagactaattattatacttccgtctcgagtacgttcggaccgaaagggaacctaagggtacgaaaataccgaaaacgtaactggtcggactcgaccacctaag

SEQ ID NO: 379322 - DNA, 603 bp, Homo sapiens
  misc_feature: GZ8MTXP02I8HYG.22.14.B03.1.454.CMB.2.raw
  modified_base (381)..(381): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagtagttatttttacagtcctccaaccaaataagtagttacttagcttggttccagcaagaaaccaggacatcgctgcactgctctatttacgtgggccgtccgtacccgggaacgtcccggggtcctcggacccgtacttcagtggcaggcggtcgngggacagtacttcactcacaccatacacgcacgtccctgccgaggctagaagtatggtacggtcttaggtttattagttcgtacagtataaattattaattactttccctcctactaacgtaccggttaccggaccgtaaacggggaaaccgtaagggtaacgtaaaacgttaccgaaaaacggtacgttaacggtcggtaccgtaccgaccaaccttaacg

SEQ ID NO: 379323 - DNA, 614 bp, Homo sapiens
  misc_feature: GZ8MTXP02JDT9C.22.14.B03.1.454.CMB.2.raw
  modified_base (494)..(494): a, c, t, g, unknown or other
  modified_base (599)..(599): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctcagactccctgctgtgtctctgggcgagagggccaccatcaactgcaagtccagccagagttatttttacagctccacaataagtattactagcttcgtccagcagaaaccaggacacgtcgtcctgctactcgactctagttacgcggtcgtacgtacccgggtaacgtcccggggtcctaggtacccccgtattcgacggttggcgtacggtcgggtcggtacgggaactagttacttcgaccgttctaccgaacctagtccgacgcctaacggtcccgtagaccgtaggtaccgtagaaacgtgttaggcgtacgttagtttagtnttacggtacagacttaattacgttacttaccgtctcgagtacggtaccgtcgacgaaacggtacgtacggtaacggaactaccgtaaagtccgtaggacgtccgngtaccgacttaacgg

SEQ ID NO: 379324 - DNA, 547 bp, Homo sapiens
  misc_feature: GZ8MTXP02IUH9X.22.14.B03.1.454.CMB.2.raw
  modified_base (422)..(422): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgaccccagtctccagactccctggctgtgtctctgggcgagagggccaccatcaactgcaagtccagccagagttatttttacagctccaaccaataagagttacttagcttggttccagcagaaaccaggacatcgtcctgcactgcctctatttacgtggggctccgtaccccggggaatcccggggtccctgaccccgtattcagtggcacggcgggtcgtgggacagattcactctcacatcagcacgcctgccaggctgaanatggtgactagtttattattggtcagactaattattattacttcctctcacgtacgtttcggaccgaaagggaccaagggtaacggaaactacgaaaacgacgtagtacggctacgaccacctag

SEQ ID NO: 379325 - DNA, 541 bp, Homo sapiens
  misc_feature: GZ8MTXP02FJLOY.22.14.B03.1.454.CMB.2.raw
  modified_base (308)..(308): a, c, t, g, unknown or other
  modified_base (411)..(411): a, c, t, g, unknown or other
  modified_base (415)..(415): a, c, t, g, unknown or other
  modified_base (433)..(433): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccacaataagagttacttagcttggttccagcagaaaccaggacatcgtcctgcactgctcatttacngggctcgtacccgggaatccggggtccctgaccccgtattcagtggcaggcgggtctgggacagtattcactctcaccatcagcagcctgcaggctgaaacgntagnggactagtttatattgtnagctaatattatattcctctcagtcgttacgacgaaagggaccaagggttacggaaacttacgaaaacgtaaccgttaggtacgggtacttacggaccacccttaacg

SEQ ID NO: 379326 - DNA, 631 bp, Homo sapiens
  misc_feature: GZ8MTXP02G6015.22.14.B03.1.454.CMB.2.raw
  modified_base (390)..(390): a, c, t, g, unknown or other
  modified_base (431)..(431): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgaggacgggccaccatcaactgcaagtccagccagagttatttttacagtctccaaccaataagagttactagcttgtaccagcaagaaaccaggacatcgtcctgcactgcctctatttacgtcgggcgtaccgtaccccgggaagtcccggggtccctgaccccgtattcgagtggcagcgggtcgtgggacagtnttcactctcacctatcgagcagcctagccgagctagaaagntggaggtacttaaggtttttataagtttcggaactacgacttaaaattatttaacttaacctttccctacttccggtaaacgttacccgggtttacggaaacccgtaaaagggggaacccctaaagggggtttaaacccgaaaacttaccggaaaaaccggtaagtttcggacgggtaccttaacggaccctaaccttag

SEQ ID NO: 379327 - DNA, 636 bp, Homo sapiens
  misc_feature: GZ8MTXP02I5NA0.22.14.B03.1.454.CMB.2.raw
  modified_base (309)..(309): a, c, t, g, unknown or other
  modified_base (438)..(438): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttacttagcttggttccagcagaaaccaggacatcgtctgcactgctcatttacngggctccgtaccccgggatcccggggtcctcggaccccgtattcgagtcggcacggccgggtcgtacggggactaggtactttccgaacttctccacccatccagcacgccctgccaaggcctgaaagngtggtaggtcttaaggttttattacgttggtaccagtactaaattatttaactactttccctaccttacgtaacggtaccggtttaccgggacccgtaaaacgggggtaaccctaaaaggggttacgggtaaaactttacccggaaaaaaccggtaccgttagggtacggtaccttacgggacccaacccggtttaac

SEQ ID NO: 379328 - DNA, 558 bp, Homo sapiens
  misc_feature: GZ8MTXP02FHFLV.22.14.B03.1.454.CMB.2.raw
  modified_base (310)..(310): a, c, t, g, unknown or other
  modified_base (365)..(365): a, c, t, g, unknown or other
  modified_base (420)..(420): a, c, t, g, unknown or other
  modified_base (440)..(440): a, c, t, g, unknown or other
  modified_base (444)..(444): a, c, t, g, unknown or other
  modified_base (456)..(456): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagacctccctggctgtgtctcgtggcgagagggccaccatcaactgcaagtccagccagagtatttttacagctccaccaataagagttactagcttggtccagcagaaaccaggacatccgtcctgcactgctcatttacgngggcctccgtaccccgggaatcccggggtccctgaccccgtattccgagtcggcnggcgggtctgggacagtattcactctcaccatcagcagccctgcaggctgaaagntgtggctagtttatattgtnacgntaaattatttanacttccctaccgtacaacggtaccggttccggacccgaaaggggaccctaaagggtacggaaaactacgaaaaccgtaaacttggcggacctcacaccctaa

SEQ ID NO: 379329 - DNA, 562 bp, Homo sapiens
  misc_feature: GZ8MTXP02I30SU.22.14.B03.1.454.CMB.2.raw
  modified_base (484)..(484): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctaccacaataagattactagcttggtccagcaagaaaccaggacatcgtcctgcactgctctatttactgggcctccgtacccggaagtcccggggtccctgaccccgtatcgagtggcaggcgggtcgtgggacagtacttcactctacaccgatcagtcagccctagcaggctagagatggtaggtacttaaggtttattattggtacctaagtactaaattactttaattacttccctacnctaacggtaccgttcggaccgaaagggacctaagggtaacgaaatacgaaaacgacgtgtacggctacgacctaacta

SEQ ID NO: 379330 - DNA, 583 bp, Homo sapiens
  misc_feature: GZ8MTXP02GFMY3.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttactagcttggtccagcaagaaaccaggacatcgtcctgcactgctctatttacgtgggcctccgtacccgggaacgtcccggggtccctgaccccgtattccgagtcggcaggcgggtcgtgggacagtactttcactctacaccatcagcagccctgccgagctagaagatggtgacttagtttatattgtacagactaattattattacttcccgtactacgtacgtacccggtttccggaaccgtaaaggggtaaccctaaagggtacggtaaaactaacgaaaaccggtaacgttcggtacggactacgacctaaccgttacg

SEQ ID NO: 379331 - DNA, 544 bp, Homo sapiens
  misc_feature: GZ8MTXP02GS1K9.22.14.B03.1.454.CMB.2.raw
  modified_base (313)..(313): a, c, t, g, unknown or other
  modified_base (397)..(397): a, c, t, g, unknown or other
  modified_base (422)..(422): a, c, t, g, unknown or other
  modified_base (425)..(425): a, c, t, g, unknown or other
  modified_base (446)..(446): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccacaaataagagttactagcttggttccagcaagaaaccaggacatcgtacctgcactgctctatttacgngggctcgtacccgggaatccggggtccctgaccccgtattccgagtggcaggcgggtctgggacagtacttcacgtctcaaccntcagcagccctgcaggctagaaagntgnggtactagtttatagttcganatataattatatacttcctctagtacgtacgtacgacgaaacggaaccgtaaggtaacgaaactaacgaaacgtacgtcggacgcgtacgacctactg

SEQ ID NO: 379332 - DNA, 565 bp, Homo sapiens
  misc_feature: GZ8MTXP02IG09Q.22.14.B03.1.454.CMB.2.raw
  modified_base (290)..(290): a, c, t, g, unknown or other
  modified_base (306)..(306): a, c, t, g, unknown or other
  modified_base (421)..(421): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacgggacattgtgatgacccagtctccagactccctggctgtgtctctgggcgagagggccaccatcaactgcaagtccagccagagttatttttacagctccaccaataagagttactagcttggtccagcagaaaccaggacatcgtcngcactgctcatttacngggtcgtctacccgggaatcccggggtcctgaccccgattcagtcggcacggcgggtcgtggggacagtatttccactctacgacatcagcagccctgacgaggctgaaagggtntggtagtacttagtttattagttgtacagtactaattattacttacttcctacgtacgtacggtacgttacggaacgtaaacgggaaccgtaaaggtaacgaaactaacgaaaacgtacgtgtacggtactacgaactacgtag

SEQ ID NO: 379333 - DNA, 536 bp, Homo sapiens
  misc_feature: GZ8MTXP02FTHVA.22.14.B03.1.454.CMB.2.raw
  modified_base (307)..(307): a, c, t, g, unknown or other
  modified_base (386)..(386): a, c, t, g, unknown or other
  modified_base (433)..(433): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccacaataagagttactagcttggttccagcagaaaccaggacatcgtcctgcactgctcatttacngggctcgtacccgggaatccggggtcctgaccccgtattccagtggcaggcgggtcgtgggacagtattcactctcacntcagcagcctgcaggctgaagatgtaggctagtttattattgacagntaattattatacttcctactcaacgtacgttacgacgtaaacgggaccaagggttacggaaaattacgaaaaacgtacgtggtacggctacggactactaacg

SEQ ID NO: 379334 - DNA, 553 bp, Homo sapiens
  misc_feature: GZ8MTXP02HXTWU.22.14.B03.1.454.CMB.2.raw
  modified_base (262)..(262): a, c, t, g, unknown or other
  modified_base (312)..(312): a, c, t, g, unknown or other
  modified_base (365)..(365): a, c, t, g, unknown or other
  modified_base (392)..(392): a, c, t, g, unknown or other
  modified_base (396)..(396): a, c, t, g, unknown or other
  modified_base (398)..(398): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagaggccaccatcaactgcaagtccagccagagttatttttacagctccaccaaataagagttaactancttggttccagcaagaaaccaggacatcgtacctgcactgctcatttacnggtctcgtacccgggaagtccggggcctgaccccgattccagtgcaggcggtntgggacagctttcactctcaccatcancacncncgcagacgagagagtagtagtacttagtttattattagtactagataattaattattacttacctctactacgtacgtaccgacgaaacggaacgtaacgtaacgtaaacgtaaacgaaacgtaacgtacgtacggacgtacgtacgtaactacg

SEQ ID NO: 379335 - DNA, 593 bp, Homo sapiens
  misc_feature: GZ8MTXP02ID3VW.22.14.B03.1.454.CMB.2.raw
  modified_base (313)..(313): a, c, t, g, unknown or other
  modified_base (438)..(438): a, c, t, g, unknown or other
  modified_base (462)..(462): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccattaactgcaagtccagccagagttatttttacagctccaacaataagagttacttagcttggtccagcaacgaaaccaggacatcgtcctgcactgctctatttacgngggtccgtccgtacccgggaagtcccggggtccctacggaccgtacttcgagtggcaggtcgggtcgtggggactagtactttccacttctaccacccatcagcacgcctgcaggctaggaagtntgtcggattaatttattatcgtanagtactaaatattattacttcctactacgtaacgtaccgttccggaaccgaaaacgggaacccgtaaaggtaacgtaaaacgtaaccgaaaacgtaaccgttggtacggacctacggaccaaccctatccg

SEQ ID NO: 379336 - DNA, 572 bp, Homo sapiens
  misc_feature: GZ8MTXP02GPQ4E.22.14.B03.1.454.CMB.2.raw
  modified_base (318)..(318): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgcaagtccagccagtagttatttttacagctaccaccaataagtagttacttagcttggttccagacaagaaaccaggacatcgtcctgcactgctctatttacgngggtctaccgtacccgggacgtcccggggtccctaggaccccgtattcgaggtcggcgtacggcgggtcgtgggacagtactttcgactctacacccataccagcacgccgtcgacaggtcagaaagtcgtggtggacttaggtttattagtcgtcaagtataattattattacttcctctacacgtaccgttacgacgtaaacggacgaaggtacgaaactacgaaaacgtagtacgtcgactcgacacgtac

SEQ ID NO: 379337 - DNA, 567 bp, Homo sapiens
  misc_feature: GZ8MTXP02F20SP.22.14.B03.1.454.CMB.2.raw
  modified_base (386)..(386): a, c, t, g, unknown or other
  modified_base (398)..(398): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagattactagcttgttccagcaagaaccaggacatcgtcctgcactgctctatttacgtgggccgtacgtaccccggaacgtcccggggtcctcggaccccgtattccgaggtcggcaggcgggtcgtgggacagtnttcactctcacntcagcagcctgctaggctagagtatggtgacttagtttattagttagtcagtactaaattatttactacctttcctcgtacctaggtaccgttaccgggactaaacgggaccgtaaagggtacgaaaacttacgaaaaccggtatcggtacggctacggacctactacg

SEQ ID NO: 379338 - DNA, 610 bp, Homo sapiens
  misc_feature: GZ8MTXP02IZ5TQ.22.14.B03.1.454.CMB.2.raw
  modified_base (329)..(329): a, c, t, g, unknown or other
  modified_base (463)..(463): a, c, t, g, unknown or other
  modified_base (473)..(473): a, c, t, g, unknown or other
  modified_base (484)..(484): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagacctccctggctgtgtctctgggcgaggagggccaccatcaactgcaagtccagccagtagttactttttacagtcctaccaacctaaataaagtagtttacttaagcttggttaccagacaagaaaccaggacatcgtcctgcactgactcagtttacngggcgtacgtaccccgggtaagtcccggggtacctgaccccgtattccgaaggtcgcgaacggtcgggtcgtcgggacacgtacgtttcaactcgtaccaacatcagcaagccctggacctaggctagaaacgngttcggagtntaaagtttttntagttacgacagtaactaattatacttactactactacgtacgtacgtaccgaacgtaaacggtaccgtaagggtaaacgtaaacaacgtaaacgtacggtacgtacgacctacgaacctaacgtg

SEQ ID NO: 379339 - DNA, 597 bp, Homo sapiens
  misc_feature: GZ8MTXP02ILM55.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctaccaccaataagagttactagcttggtccagcacgaaaccaggacatcgtcctgcactgctctatttacgtgggcgttccgtaccccggggtaagtccccggggtccctcggaccccgtacgttcgagtcggcacggcgggtcgtggggacaggtactttcacgtctccgaaccataccagcacgcccgtgaccgaggtacctaggaacgatcggtgggacttaaggttttattattggtacagactaattaacttaattacttcctctacgtacgttaccggttcggaccgtaaaggtacctaagggtacgaaaactacgaaaacgtacgtacggtcggactacggaccactacg

SEQ ID NO: 379340 - DNA, 526 bp, Homo sapiens
  misc_feature: GZ8MTXP02FFQGT.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagtatttttacagctccacaataagagttacttagcttggttccagcagaaaccaggacatcgtcctgcactgctctatttactgggcgtcgtaccccgggaatccggggtcccctgaccccgattcagtggcaggcgggtctgggacagtatttcactctcaccatcagcagccctgcaggctgaagatgtgctagtttatattgcagcaattattatacttcctctcagtaccgttcggacctaaagggaccaaaggtaggaaaactacgaaaacgaacttggacggtacacgacaccta

SEQ ID NO: 379341 - DNA, 576 bp, Homo sapiens
  misc_feature: GZ8MTXP02GJNHK.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccacaataagattactagtctgttccagcaagaaaccaggacatcgtactgcactgctactatttacgtgggccgtaccgtaccccggggaacgtccccggggtccctacgaccccgtattccgagtcggcaggccgggtcgtcggggacagtattccactctacaccactcagcacgccctgccaggctagaaagtgtggtcgacttagttttaatgttagtcaagtactaaattattatacttcctctctacgtaccggttaccgacgtaaacgggtaaccaagggttaacgaaactaccgaaaacgtacgtgtacggctacgactacctaag

SEQ ID NO: 379342 - DNA, 538 bp, Homo sapiens
  misc_feature: GZ8MTXP02I846E.22.14.B03.1.454.CMB.2.raw
  modified_base (416)..(416): a, c, t, g, unknown or other
  modified_base (419)..(419): a, c, t, g, unknown or other
  modified_base (446)..(446): a, c, t, g, unknown or other
  modified_base (458)..(458): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagattacttagcttggttccagcaagaaaccaggacatcgtcctgcactgctctattactgggcgtccgtacccgggaatcccggggtcctcgaccccgtattcgagtggcaggcgggtcgtgggacagtatttcactctcaccatcagcagcctgcaggctagaantgnggactagttttatattgacagctaatnttatatcctctnacgtacgttcgacaaagggacctaaggtacgaaactacaaaaccggtcgttaggtacggaccttacggacctaaccttcg

SEQ ID NO: 379343 - DNA, 559 bp, Homo sapiens
  misc_feature: GZ8MTXP02IA197.22.14.B03.1.454.CMB.2.raw
  modified_base (424)..(424): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgaggagggccaccatcaactgcaagtccagccagagttatttttacagctccaccaataagagttactagcttggtccagcagaaccaggacatcgcctgcactgctcatttactgggctcgtacccgggaatcccggggtccctgaccccgattcgagtggcaggcgggtctggggacagtatttcactctcaccctatcagcagtccctgcaggctagagtatgtacggntagttttatagtttgtactagactaattattattacttcctcgtactagtaccgtttcggaccgtaaacgggaacctaagggtaacgaaaactaccgaaaacgtaaccgtaggtcggactacggacctacctaac

SEQ ID NO: 379344 - DNA, 606 bp, Homo sapiens
  misc_feature: GZ8MTXP02I7ADJ.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcattttctctgttgctctggatctctggtgccgtacggggacattgtgatgacccagtctccagactccctggctgtgtctctgggcgaggagggccaccatcaactgacaagtccagccaagtagttatttttacagtctccaaccaaataagagtttactagcttggttccagacaagaaaccaggacaatccgtcctgcactgacctctatttacgtgggtccgtaccgtaccccgggaacgttccccggggtccctggacccccgtagttaccgaggtcggcgaggtccgggtcggtagggactaggtactttccgaccttcgtaccaccctatccgagcacgtcctgcaggctaggagtagtggtcggtattagttttatgttgtacagtactaattatttaactactttccacttacgacgtacggttaccgacggtaaacggaccaagggtaacgaactaacgaaacgtagtggttacgctacgactacgtc

SEQ ID NO: 379345 - DNA, 598 bp, Homo sapiens
  misc_feature: GZ8MTXP02IWVRV.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttacttagcttggttccagcaagaaaccaggaccatccgtcctgcactgctctatttacgtgggtcgtccgtaccccggggaacgtccccggggtccctcgaccccgtattccgaggtcggcacggcgggtcgtgggacctagtactttcactctaccaccatcacgcacgctgcaggctagaacgtgtggtagtactagtttacttattgtacacgtataaattattacttacttcctacctacgtaacggtaccgtttacccggaccgtaaacggggtacctaaaggggttaacgaaacttaccgaaaacggtaacgtggtacggactacgtacaacttacg

SEQ ID NO: 379346 - DNA, 576 bp, Homo sapiens
  misc_feature: GZ8MTXP02IU7W2.22.14.B03.1.454.CMB.2.raw
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttgttccagcagaaaccaggacatcgtacctgcactgctcatttactggggcgtcgtacccgggaatcccggggtcctgacccgattcagtcgcagcgggtctgggacaggattcactctcacatcagcagccctgcaggctagaagatggtggactagtttattacttgtacagtcctaaattattaattattccctacctacgtaacggtaaccggtttccgggaaccctaaacgggggaaccctaaaaggggttacgggaaaaacttacgaaaaacggtaacctacggtggaccttacggacacccgttaacg

SEQ ID NO: 379347 - DNA, 597 bp, Homo sapiens
  misc_feature: GZ8MTXP02IK5F9.22.14.B03.1.454.CMB.2.raw
  modified_base (241)..(241): a, c, t, g, unknown or other
  modified_base (311)..(311): a, c, t, g, unknown or other
  modified_base (416)..(416): a, c, t, g, unknown or other
  modified_base (441)..(441): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacgggacattgtgatgacccagtctccagactccctggctgtgtctcgtgggcgaggacgggccaccatcaactgacaagtccagccagtagttatttttanagctaccaacaataagagttactagcttggtccagacaagaaaccaggacagtccgtcctgcactgcctntattacgtgggccgtaccgtacccgggaacgtccccggggtcctcgaccccgtatccgaggtcgcgtaggcgggtcgtagggactagtctttccactctacactncagcagccctgccaggctagaacgngtgtggtacttagtttattagttcgtacagtactaattacttattacttcctactacgtacggtaccggttaccggaaccgtaaacgggaaaccgtaaagggtacgaaaacgtaccgaaaacgtacgtaggtaccggactacggacctaacgtccg

SEQ ID NO: 379348 - DNA, 578 bp, Homo sapiens
  misc_feature: GZ8MTXP02GNXRG.22.14.B03.1.454.CMB.2.raw
  modified_base (313)..(313): a, c, t, g, unknown or other
  modified_base (400)..(400): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgacaagtccagccagtagtatttttacagctccaccaataagagttacttagcttgttccagcaagaaaccaggacatcgtcctgcactgctctatttacgngggcgtccgtacccgggaacgtccggggtccctcgaccccgtattcgaggtcggcgaggcgggtcgtgggacagtatttcgacttcncacatccagtcagccctgcaggctagaaacgtgtggcgtactaggttttacttagttcggtcaagtactaattattacttattcccgtactacgacgtaccggttacggaccgtaaagggaccctaaggtacggaaactaccgaaaagtacgtagacggtactacggactaaccgtta

SEQ ID NO: 379349 - DNA, 790 bp, Homo sapiens
  misc_feature: GZ8MTXP02GNF3X.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacactccaccaactaagtagtacttagtacgttcgttcgtacagacaaacgaacgacgactcgtcctcgcgactacgtcgtcctactttacgttcggtcgggtccgtacccgggtaacccggtaccggggtcccggtaccgtaccggtacccgtacgtacgtaggtacggacggtacggggttacgggtacggtaaccgaaacgttacgtttaccttacctacccttaccaccctaaacttccgaacggaccgaaccgtccggttaccgacgacgggtacgttaacgaaaaggtaagttcggttacggggtaccttaaagggtttttaattttttaagtcgggttacctaagaaaccgtttaaattaaatttttagttaacctttaccccttcccgtaacgtaacgggttaaccggtttacccgggaccggaaaaccggggtaaaaccgggtaaacggttaaaacgggggttaaaaactaacccgtaaaaaccgtaaaccgggttaacggtttcgggggttacctaacccggactaaaccccgttaagtttcccg

SEQ ID NO: 379350 - DNA, 564 bp, Homo sapiens
  misc_feature: GZ8MTXP02I3MNV.22.14.B03.1.454.CMB.2.raw
  modified_base (294)..(294): a, c, t, g, unknown or other
  modified_base (312)..(312): a, c, t, g, unknown or other
  modified_base (350)..(350): a, c, t, g, unknown or other
  modified_base (425)..(425): a, c, t, g, unknown or other
  modified_base (432)..(432): a, c, t, g, unknown or other
  modified_base (463)..(463): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttactagcttggttccagcaagaaaccaggacatcgtccngcactgctctatttacgngggcctcctacccgggaatcccggggtcctgaccccgnttcagtggcaggccgggtctggggacagtatttccactctaccaccatcagcacgccctagcgaggctagaaagntggtcgntaaggttttattagttgtacaagcaaatttnttaacttacttcctctaccgtaagtaccggttacggccgtaaaaggggaccctaaagggtaaggaaactaacaaaacgaacttggtacggctacgcaccta

SEQ ID NO: 379351 - DNA, 580 bp, Homo sapiens
  misc_feature: GZ8MTXP02G3WLJ.22.14.B03.1.454.CMB.2.raw
  modified_base (449)..(449): a, c, t, g, unknown or other
  modified_base (452)..(452): a, c, t, g, unknown or other
  modified_base (498)..(498): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttactagcttggtccagcaagaaaccaggacatcgtcctgcactgctctatttacgtcggggtccgtaccgtaaccccggggtaaacgtccccggggtaccccttaggaacccccgtagttcgaaggtcggcgtaggcgggtcgtaggggacagtacttcactctcaccatcagcagcctagccaggctagaagntgnggacttagtttatattgacagtataattattactagttccctctanacgtacgttacggaaccgtaaaggggaccctaagggtaacgaaaacttacgaaaacggtactgggtacgctacgcaaacttc

SEQ ID NO: 379352 - DNA, 630 bp, Homo sapiens
  misc_feature: GZ8MTXP02HAURR.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttacttagcttaggttccagcagaaaccaggacatcgtactgcactgctctattactgggtccgtaccgtaccccgggaagtcccggggtcctaggaccccgtatcgagtggcaggcgggtcgtgggacagtacttccactctcaaccatccagtcacgccctagccgaggacctagaaacgtgtggtacgggacttaaggttttattaagtttcgggtacctaagacttaaaattactttaactacctttcccgtactaccgtaaacggtaccggtttacccggaaaccgttaaacggggaaccctaaaacggggttaagaaaaacgttaaaaaccgtaacgtaggtacggtacgtacgacctaccgtatttccg

SEQ ID NO: 379353 - DNA, 560 bp, Homo sapiens
  misc_feature: GZ8MTXP02FKE46.22.14.B03.1.454.CMB.2.raw
  modified_base (426)..(426): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccacatcaactgcaagtccagccagagtatttttacagctccaccaataagattacttagcttggttccagcagaaaccaggacatcgtcctgcactgctctatttactgggccgtccgtaccccggggaactcccggggtcccctggacccccgtattccgagttggcacggcggggtctggggacagtattcactctcaccatcagcagccctgcaggctgaaagntggtggctagtttattattgcagactaaattagtttatattccctactacgacggtaccgttccggaccgtaaaggggaccctaaagggttacgaaacttaccgaaaacgtacgtggtcggactgaccacctag

SEQ ID NO: 379354 - DNA, 563 bp, Homo sapiens
  misc_feature: GZ8MTXP02HS8JQ.22.14.B03.1.454.CMB.2.raw
  modified_base (300)..(300): a, c, t, g, unknown or other
  modified_base (408)..(408): a, c, t, g, unknown or other
  modified_base (412)..(412): a, c, t, g, unknown or other
  modified_base (415)..(415): a, c, t, g, unknown or other
  modified_base (418)..(418): a, c, t, g, unknown or other
  modified_base (425)..(425): a, c, t, g, unknown or other
  modified_base (432)..(432): a, c, t, g, unknown or other
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggttccagcagaaaccaggacatcgtcctgcactgctnatttactgggcgtcgtacccgggaatcccggggtcctgaccccgattccagtgcagcgggtctgggacagtatttccgactctacaccatcagcagccctgcagctanaagntgngtntagtttntattganagactaattattactacttcctacctacgtaacgtaccggttacggaaccgtaaagggtaaccgtaaagggtacgtaaaactaaccgaaaacggtacgttacggtacgtaccgtacggacctaaccgtacg

SEQ ID NO: 379355 - DNA, 585 bp, Homo sapiens
  misc_feature: GZ8MTXP02JT43C.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagaggccaccatcaactgcaagtccagccagtagttatttttacagtcctaccaaccaataagagttactagcttggttccagcaagaaaccaggacatcgtcctgctactgctctacgtttacgcgggtctccgtacccgggaagtccccggggtcctgaccccgtatcgagtcgcgaggcgggtctggggacagtacttcgactctcaccatccagcacgcctgcaggctaggaagagtggtgactagtttatagttgtacagtactaaatttacttactacttcctaccgtactaacggtaccgttacggaccgaaacggggtacctaaacggggttagaaaacctaccggtaaaacgtacgttggtacgacgttacaccgtaacctag

SEQ ID NO: 379356 - DNA, 689 bp, Homo sapiens
  misc_feature: GZ8MTXP02HJR6X.22.14.B03.1.454.CMB.2.raw
  modified_base (487)..(487): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgacaagtccagccagtagttatttttacagtcctaccaaccaataagtagttacttagcttcgtacagacaacgaaaccaggacatcgtcctgcactgctactattacgtgggtccgttaccgtacccgggaacgtcccggggtcctacggaccccgattcgaggtcggcgaggtcgggtcgtcgggaactaggtactttaccgaacttcctaccgaaccctattacccgaacgccgtaacggcccttaggaccggtacgggaccttagggaaaanggttcgggtacgggttacttaaggttttttaattagtttaggacctaagtaacctaaatttactttaattaccttacccgttacctacggtaacgttaccggtttaccggaacccgtaaaacggggtaccgtaaaagggggttactaaaacgtaaccgtaaaaggtaaccgtgggtacgacgttaacggacccttacgtaac

SEQ ID NO: 379357 - DNA, 711 bp, Homo sapiens
  misc_feature: GZ8MTXP02H1RX0.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgaccccagtctccagactccctggctgtgtctctgggcgagaggccaccatcaactgcaagtccagccagtagttatttttacagctccaccaaataagagttactagcttggtaccagcaacgaaaccaggacatcgtctgcactgctctatttacgtgggcgttaccgtacccgggaacgtccccggggtcctacggtaccccgtattccgagtcggacacgggtccggggtcgtaggggaactaggtactttaccgacttcctaccacccataccgacgctaacggcccttagaccgtagggtaccgtaaggaaacgaacggttgggttacggtaccgtttaaaggtttttaacgttaagtttcgtaaccgtaaaggtaacttaaacgtttaattaacttacctttaccctaccgttacgtaaaccggtaccgggttttaccggaacccggttaaaacgggggaaacccgttaaaaggggtaaacgtaaaacgtaaccggtaaaaacgtaccggttaaggtaccggaactaccggtaacccgtaaccgtaccg

SEQ ID NO: 379358 - DNA, 584 bp, Homo sapiens
  misc_feature: GZ8MTXP02IQ04G.22.14.B03.1.454.CMB.2.raw
  modified_base (430)..(430): a, c, t, g, unknown or other
  modified_base (473)..(473): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgcaagtccagccagtagttatttttacagtcctaccaaccaataagattacttagcttggttccagacaagaaaccaggacaactcgtcctgcactgctctatttacgtgggtccgtacgtacccgggtaactcccggggtcctacgaccccgtattacgagtcggcgacggtcgggtcgtgggactagtactttccacgtctcaccctatcagcacnctgcgagctagatgtgtaggcttaagttttatgttcgacgtanaacttaattatactacttcctactacgtacgtaccggttcgaaccgtaaacgggacctaagggtaacgtaaactacgaaaacgtacgtcggacgctacggacctacgtacg

SEQ ID NO: 379359 - DNA, 596 bp, Homo sapiens
  misc_feature: GZ8MTXP02GXGJP.22.14.B03.1.454.CMB.2.raw
  modified_base (411)..(411): a, c, t, g, unknown or other
  modified_base (432)..(432): a, c, t, g, unknown or other
  modified_base (437)..(437): a, c, t, g, unknown or other
  modified_base (451)..(451): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaaccaataagagttactagcttggtccagcagaaaccaggacatcgtctgcactgcctctatttacgtcgggtcgtaccgtacccggggaacgttcccggggtccctcgaccccgtattcgagtggcaggcgggtcgtggggactagtactttcactctcaccatcacncagcctagccaggctaggaangtagnggtctagtttagtnttaggcagtaactaattattacttacttccctctacgtacggtaccgtttaccggaccgtaaacggggaacccgtaaagggtacggtaaaacttacggaaaaacccgtacgtagggttacgccgtaacggtacccaaaccttagg

SEQ ID NO: 379360 - DNA, 576 bp, Homo sapiens
  misc_feature: GZ8MTXP02JWEJ7.22.14.B03.1.454.CMB.2.raw
  modified_base (305)..(305): a, c, t, g, unknown or other
  modified_base (313)..(313): a, c, t, g, unknown or other
  modified_base (342)..(342): a, c, t, g, unknown or other
  modified_base (350)..(350): a, c, t, g, unknown or other
  modified_base (393)..(393): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagacgggccaccatcaactgcaagtccagccagagttatttttacagctaccaaccaataagagttacttagcttggtccagcaagaaaccaggacatcgtcctgcatgctntattacgngggctcgtaccgggaagtcccggggtccngacccgtntcgagtgcaggcgggtctgggacagtattcgactcctacactntacacgcgacgcctgacgacgcgtaagagtagtggtcgtacgttagtttattagtcgtatacgtataattattacttacttcctactacgtaacgtacggttccggaacgaaacgggtaacgtaaacggtaacggaaactaaccgaaaacgtacgtaggttacgacgttacgacctacgtacg

SEQ ID NO: 379361 - DNA, 586 bp, Homo sapiens
  misc_feature: GZ8MTXP02G7Z4W.22.14.B03.1.454.CMB.2.raw
  modified_base (350)..(350): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagtctccacaataagagttactagcttggtccagcagaaaccaggacatcgtctgcactgctctatttactcgggtctcgtacccgggaagtccccggggtcctgaccccgtnttcgagtggcaggcgggtcgtgggacagtattcactctcacatcagcagccctgacctaggctaggaagtagttggtcgggtacttaggttttaattaggtttcgaacctagtactaaatttacttaacttacttcccgtactacgtaacgtaccggttacgaccgtaaacgggactaaacgggttaggaaaacttacgaaaacgtacgtacggtacggacgtcgacctaacctag

SEQ ID NO: 379362 - DNA, 591 bp, Homo sapiens
  misc_feature: GZ8MTXP02G32CT.22.14.B03.1.454.CMB.2.raw
  modified_base (401)..(401): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgaggagggccaccatcaactgcaagtccagccagtagttattttttacagtcctaccaaccaaataaagtagttacttagtcttggttccagcaagaaaccaggacatcgtcctgcactgctctaatttacgtcggggtcctaccgtaccccggggtaacgtccccggggtccctcggaccccgtattcgagtggcgagggcgggtcgnggggacagtacttcactctcaccatcgagcagccctgccgaggctagaagagttggtggtactaggtttattgttcgtacagtactaattatttatactttcctctacacggtacgttccgaccggtaaaggtacccgaaggtaacgtaaactacgaaaaccgtagtacggtacggtctcgaccactacg

SEQ ID NO: 379363 - DNA, 547 bp, Homo sapiens
  misc_feature: GZ8MTXP02I20HE.22.14.B03.1.454.CMB.2.raw
  modified_base (301)..(301): a, c, t, g, unknown or other
  modified_base (425)..(425): a, c, t, g, unknown or other
  modified_base (454)..(454): a, c, t, g, unknown or other
  modified_base (466)..(466): a, c, t, g, unknown or other
  modified_base (473)..(473): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctaccaccaataagattacttagcttggtccagcagaaaccaggacatcgtctgcactgctnattacgtgggctcgtaccccgggtatcccggggtcctcgaccccgtattccgagtcggcacggtcgggtcgtgggacagtatttcgactctcaccatcagcacgccctagcgaggctagaaagntgtaggcttagttttattattgtacagtntaattattaatnttacccnctacagtacgttcgacgtaaaggaccaagggtacgaaactacgaaaacgtactaggtcgactacggacacctag

SEQ ID NO: 379364 - DNA, 581 bp, Homo sapiens
  misc_feature: GZ8MTXP02JR8H2.22.14.B03.1.454.CMB.2.raw
  modified_base (295)..(295): a, c, t, g, unknown or other
  modified_base (312)..(312): a, c, t, g, unknown or other
  modified_base (392)..(392): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagacctccctggctgtgtctctgggcgagagggccaccatcaactgacaagtccagccagtagttatttttacagtctaccacaataagattacttagcttggttccagcagaaaccagacatcgtcngcactgctcatttacgngggtctccgtacccgggaactcccggggtcctgaccccgattcagtcggcaggcgggtcgtgggactagtattccactcnccacatcagcacgtcctgcaggctagagagttggtgtactagtttattatggtacagactaaattacttatacttcctacctacgtacgtaccgttacggaccgtaaaacggggtaccctaaaggggtacgaaaacgttaaccgaaaaccggtacgtacggtacggtacctacggaccctaaccttacg

SEQ ID NO: 379365 - DNA, 645 bp, Homo sapiens
  misc_feature: GZ8MTXP02FSIFI.22.14.B03.1.454.CMB.2.raw
  modified_base (241)..(241): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagacctccctggctgtgtctcgtgggcgagagggccaccatcaactgacaagtccagccagtagttatttttanagcctaccaaccaataagtagttactagcttggtccagcaagaaaccaggacatcgtcctgctactcgctctatttacgtgggccgtaccgtacccgggaacgtcccggggtccctggacccccgtattccgaggtcggcgacggtcggggttcgtcggggaacctaggtactttccgacttctaccaccatccagctacgccctgccgtaggactagaaacgtgtaggtggtacttaaggttttattagttaggtacagtacttaaattactttaactacgtttccctacctacgtaacggtaccggttccggaacccgtaaaacggggacccgtaaaggggttaaacggaaacttaacccgaaaacggtaaccgttggacggtactacgaccaaccgttacg

SEQ ID NO: 379366 - DNA, 654 bp, Homo sapiens
  misc_feature: GZ8MTXP02IK0FA.22.14.B03.1.454.CMB.2.raw
  modified_base (308)..(308): a, c, t, g, unknown or other
  modified_base (463)..(463): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgaggacggccaccatcaactgcaagtccagccagagttattttttacagtcctaccaccaaataagtagtttacttagtcttggttccagacaacgaaaccaggactactccgtcngcactgctctagtttcgtcgggtcgtaccgtacccgggtaacgtccccggggtcctcggacccctacgttccgagtcggcgacggtcgggtcgtgggactacgtacttacctacgtctaccgaccctatcgacgcgacgtccctgaccgacggtntaaacggaagtgttcggttacggtaactttaagttttagtttacttaggaactacgattaaaatttcttaaagttcctttctaccgtacgtaacggttaccggttaccgggaaacgtaaacggggtaaaccctaaggggtaaacgtaaactaacgtaaaacgtaacgttgacgtcgacgtacaaccgttcg

SEQ ID NO: 379367 - DNA, 641 bp, Homo sapiens
  misc_feature: GZ8MTXP02GNAXI.22.14.B03.1.454.CMB.2.raw
  modified_base (421)..(421): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagacgggccaccatcaactgcaagtccagccagtagttatttttacagtcctaccaacctaataagtagttacttagcttggttccagacaagaaaccaggacatcgtcctgcactgctactattacgcgggtcgtcgtacccgggagtcccgggtcctacgcccgtatcgaggtcggacgaggccggggtcgtacggggactaggtacttccgactcctaccaaacntaaccgagcacgtcctagacgtaggactaggaaagtgtaggtggtacttagtttaatcgtgtaccagtactaattacttaactcgttccctacgtacgaacggttacccggtttacggaaccggtaaaagggtaacccgtaaaggggtaaaccgtaaaacgttaaaccgaaaacggttccgttagggtacccgtacggttacaccccgtaactttaccgg

SEQ ID NO: 379368 - DNA, 541 bp, Homo sapiens
  misc_feature: GZ8MTXP02J0NFP.22.14.B03.1.454.CMB.2.raw
  modified_base (374)..(374): a, c, t, g, unknown or other
  modified_base (416)..(416): a, c, t, g, unknown or other
  modified_base (425)..(425): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagtagttacttagcttggttccagcagaaaccaggacatcgtcctgcactgctcatttactgggctctacccgggaatcccggggtcctgaccccgattcagtggcacggcgggtctgggacagngtttcactctcacccatccagtcagcctgcagctagagatgngctagtttntattgtcagctaaatatttatactttccctactcgacgtaccgttcggacccaaaggggacctaagggtacgaaactacgaaaaccgaactaggtacggcctaggacctaactacg

SEQ ID NO: 379369 - DNA, 525 bp, Homo sapiens
  misc_feature: GZ8MTXP02JZX19.22.14.B03.1.454.CMB.2.raw
  modified_base (309)..(309): a, c, t, g, unknown or other
  modified_base (362)..(362): a, c, t, g, unknown or other
  modified_base (430)..(430): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttacttagcttggttccagcagaaaccaggacatcgtcctgcactgctcattacngggctctacccgggaatccggggtcctgaccccgattcagtggcaggcgggtntggggacagtatttcactctcaccatcagcagccctgccaggctagagatgtggcagtttatattgtnagctaatattatattccctactcagaccgttggaccgtaaacgggaccaaggttacggaaactacgaaacgacgtgtcggacctgacctactacg

SEQ ID NO: 379370 - DNA, 778 bp, Homo sapiens
  misc_feature: GZ8MTXP02JIDBW.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgacaagtccagccagtagttatttttacagtctccacaataagagttactagcttgtccagacaacgaaaccaggacacgtcgtacctgccacgtcgtactactatttacgtcggggtccgtaccgtaaccccgggtacgttcccggggtacccctacggaacccccgtacgtttaccgacggttcggaccgtacggggtccggggttcggttacggggaacgtacgggtttaacgttttacccgaaccttttcccgaccctaaaacccccgttacgtacccggaacgtccgtaaccggtcccgtacggaccggtaacggggtaccgttaaagggtaaacggtcggtttacggggttacggttaacgttttaaggtttttaacttacggttacggtaaccgtaacgttaaactttaaaatttaacgtttaactttaccgttcccttacgtaacggtaacgggttaccggttaaccgggaaaccggtaaaacgggtaaccgttaaagggtaaacaaacgtaaaccgaaaacgttacgtcggtacgtaccgtacgtaccgtaactacg

SEQ ID NO: 379371 - DNA, 588 bp, Homo sapiens
  misc_feature: GZ8MTXP02HS38P.22.14.B03.1.454.CMB.2.raw
  modified_base (325)..(325): a, c, t, g, unknown or other
  modified_base (432)..(432): a, c, t, g, unknown or other
  modified_base (437)..(437): a, c, t, g, unknown or other
tcagacatacgcgtcacgaccggtgctcgatttagtgtgagtagttccgcgggggagctacaacaggcaggcaggggcagcaagatggtgttgcagaccccaggtcttcattctctgttgctctggatctctggtgcctacggggacattgtgatgacccagtctccagactccctggctgtgtctcgtgggcgaggacggcccaccatcaactgacaagtccagccaagtagttaatttttacagtcctaccaaccaataagagttactagtcgttggtaccagacaagaaacaggacatcgtcctgcactgctctatttacgngggtcgttaccgtaacccgggaacgtccccggggtccctacgaccccgtattccgagtcggcgacggcgggtcgtagggactagtctttcaccgtctccacatcgancgacnccctgcgacgctagaagtgtggtgtcttagttttatagttagtacagactaattactatacgttcctactacgacggtaccgttccgggaaacctagggaacctaagggtacgtaaactacgaaaacgtacgtggtacgatcgactactag

SEQ ID NO: 379372 - DNA, 555 bp, Homo sapiens
  misc_feature: GZ8MTXP02JE23G.22.14.B03.1.454.CMB.2.raw
  modified_base (399)..(399): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagattactagcttggttccagcagaaaccaggacatcgtcctgcactgcctctatttacgtgggtccgtaccgtaccccggggaaatcccggggtccctgacccccgtattcgagtggcaggcgggtcgtgggacagtacttcacgtcncaccatcagcagcctgcagctagagatgtgcgtagtttactagttgtcagactaattattattattcctctactacgtacgttcggaaccgaaagggtaaccaaggtaacggaaacttacgaaaacgtacgtacggtacggctacgaccgactacg

SEQ ID NO: 379373 - DNA, 595 bp, Homo sapiens
  misc_feature: GZ8MTXP02GJ23V.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagacctccctggctgtgtctcgtgggcgaggagggccaccatcaactgcaagtccagccagtagttatttttacagtctccacaaataagattactagtctggtccagcagaaaccagacatcgtctgcactgctctattacgtgggcgtccgtaccgggacgtccggggtccctgacccgtattcgagtcgcaggcggtcgtgggacagtacttcactctacaccatcgaagcacgcccgtagcgtaacggctagaagtagtgtacggattaaggtttatagttacgtacagtactaaattacttataccttcctactacgtaacggtacgttccggaaccgaaagggtaaaccgtaaaggtaacggtaaaacttaacccgaaaaacgtaccgtagggttacggacttacggaccctaacttaaccg

SEQ ID NO: 379374 - DNA, 756 bp, Homo sapiens
  misc_feature: GZ8MTXP02FJE18.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagacgggccaccatcaactgcaagtccacgacagtagttattttacagtcctaccaacaataagtacttactagtcgttgtaccagacaacgaaacgacggactactccgtctgacactcgctacttacttacggcgggtccgtaccggtaacccgggtacgtccggggtccctagaccccgtattcgaggtcggacgacgggcgggtcggtacgggacgtaagttactttaccgacttcctaccaacccgtattaccgacgtacgtaaccgtcccgttacggaccgtagggtactaaagggaaacgtggtttacggggtaccggtaacgttttaaggtttttaactttaggtttcgttaaacgaccggttaaactttaaaagtttaacttttaacttacccgtttacccctttacccgtaacggtaaaacggggtttaacccgggtttacccgggaaaacccggtaaaaccggggttaaaccggtaaagggggttaaaacgaaaccgttaaaacgaaaaccggtacgttaggggaccgtacgtaaccggacctacttaacg

SEQ ID NO: 379375 - DNA, 580 bp, Homo sapiens
  misc_feature: GZ8MTXP02FPLHS.22.14.B03.1.454.CMB.2.raw
  modified_base (412)..(412): a, c, t, g, unknown or other
  modified_base (434)..(434): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccacaataagagttactagcttggttccagcaagaaaccaggacatcgtcctgcactgctctatttacgtgggccgttccgtaaccccgggtaacgtcccggggtccctggacccccgtattccaggtcggcgaggccgggtcgtgggactagtactttcactcacaaccntacagcagctgcagctagaagntgtgctagtttatgtgtcagctaaattattatacttccctctacgacgtacgttaccgggacgtaaaacggggaaccctaagggttaaacgaaacgtaacgaaaaaccggtaagtcggtacgggcttacggaaccaccgtttaacg

SEQ ID NO: 379376 - DNA, 538 bp, Homo sapiens
  misc_feature: GZ8MTXP02GQECE.22.14.B03.1.454.CMB.2.raw
  modified_base (394)..(394): a, c, t, g, unknown or other
  modified_base (416)..(416): a, c, t, g, unknown or other
  modified_base (504)..(504): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagattactagcttggttccagcaagaaaccaggacatcgtcctgcactgctctatttacgtgggcctcgtacccggaagtcccggggtcctgacccgtattcagtgcgagcgggtgtacggacagtattcactctcaccatccancagccctgcgagctagaaagtntggtgcttagtttattatgtacatactaattattaatactcctactacgacgtacgttcgacgaaacgggacctaaagggacgtaaanacgaaaacgactaggtcggacctacgacaaccta

SEQ ID NO: 379377 - DNA, 609 bp, Homo sapiens
  misc_feature: GZ8MTXP02GY1MY.22.14.B03.1.454.CMB.2.raw
  modified_base (304)..(304): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagacctccctggctgtgtctctgggcgaggagggccaccatcaactgcaagtccagccagtagttatttttacagtcctaccaacctaataagtagttacttagcttggtccagacaagaaaccgagacatcgtccngcactcgctctattacgtgggtccgtacgtacccggtaacgtcccggggtcctcgaccccgtatcgagtcggacgaggcggtcgtcgggactagtacttccactctaccactcgtacacgctacgccctggaccacgggactaggaaagtgtaggtggtacttaagttttatagttgacaagtacaaagtttattaactctttacctacgtacgttaacggtacccggttacggaaccgtaaacgggggacctaaacgggtaagtaaactacgaaaacgagttcggtacgctacgactaacgtcg

SEQ ID NO: 379378 - DNA, 627 bp, Homo sapiens
  misc_feature: GZ8MTXP02I7GY2.22.14.B03.1.454.CMB.2.raw
  modified_base (435)..(435): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagtagttatttttacagtctccaccaataagagttactagcttgtccagcaagaaaccagacatcgtcctgcactgctctattacgtgggctcgtacccgggaagtcccggggtcctagaccccgtacttcgagtcgcgacggcgggtcgtgggacagtacttccacgtctaccacctatccagcacggtcctagcaggtctaggaaacgtnttcggtgtactagttttatagttggtacaaggtactaattagttacgttacttccctaccgttacgtaacgtacccggtttaccggaccgtaaaacgggggtacctaaacgggggttaaacgaaaacgtttacccgaaaaacggttacgtacgggtacggggtaccctttacggacctaaaaccggtttcgg

SEQ ID NO: 379379 - DNA, 600 bp, Homo sapiens
  misc_feature: GZ8MTXP02JJ5ZB.22.14.B03.1.454.CMB.2.raw
  modified_base (320)..(320): a, c, t, g, unknown or other
  modified_base (491)..(491): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggagggccaccatcaactgcaagtccagccagagttatttttacagtctaccaaccaataagtagttacttagcttggttccagcaagaaaccaggacatcgtcctgcactgctactatttacgngggtccgtccgtacccggggaacgttccccgggggtccctggaccccgtattccaggtcggcgaggcggggtcgtgggactagtacttcacgtctacacctatcagcagccctgccgaggctagaaagtgtggtggtacttaagtttattagttggtacagtactaaattnttaacttacttccctctaccgtacgtaccggttcggaaccgaaacggaaccgtaaggtacgaaaacgttacgaaaacgtacgtaggtacggactacggaccaacttacg

SEQ ID NO: 379380 - DNA, 639 bp, Homo sapiens
  misc_feature: GZ8MTXP02JM5B1.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagacctccctggctgtgtctcgtgggcgaggacgggccaccatcaactgacaagtccagccagtagttatttttacagtcctaccaacctaaataagtagttaactagtcttggtccagacaacgaaaccgaggactacgtccgtcctgccactgctactagtttacgtcgggtccgttaccgtacccgggtaacgtccccggggtaccctacgaccccggtacttcggacggtcggacgacggtcgggtcggtacggggactaggtacttccgaccttaccgtacaacccatacgacgacacgcccgtgaccgacggacgtacgaagtcgtggttcgagttaagtttatagttctaagatactaattattacttcttacctcgtactacgtcgtaccggacgtaaacggaccgtaaggtaacgtaaacaaccgaaacgtacgtacggtacggactaccggacctacttacg

SEQ ID NO: 379381 - DNA, 683 bp, Homo sapiens
  misc_feature: GZ8MTXP02HI6RP.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagacctccctggctgtgtctcgtgggcgaggacgggccaccatcaactgacaagtccagccagtagttatttttacagtcctaccaaccaaataagtagttactagtcttggtccagcaacgaaccaggacatcgtcctgcactgactactagttacgtcgggtccgtaccgtacccgggtacgtcccggggtcctcgaccccgtatcgagtcggcgacggtcgggtcgtagggactagtacgttcactccgtcccaactataccacgtccacgtcccgtgaccgaacggtcctaaagggaacgtgttacgggtggttaccgtttaaggttttttaactgttacggttaacacgttaacttaaatttacttttaacttaacctttccccgtacgtaaccggtaacggttacccgggtttaccggaaaccggtaaacgggggaaccttaaaaggggtacgtaaaacgtaacgtaaaaccggtagttcgggtacgtacgtacgtacccaacgtttcg

SEQ ID NO: 379382 - DNA, 583 bp, Homo sapiens
  misc_feature: GZ8MTXP02IZ21P.22.14.B03.1.454.CMB.2.raw
  modified_base (432)..(432): a, c, t, g, unknown or other
  modified_base (458)..(458): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagaggccaccatcaactgcaagtccagccagagttatttttacagctccaccaataatagttactagcttggttccagcaagaaaccaggacatccgtctgcactgctctatttactgggctcgtacccgggaatcccggggtccctagacccccgtattccgaggtcggcgaggcgggtcgtgggacaggtatttccactctcacccgtatcagccacgcctagccgaggctagaaangtgtgtactagtttttaatgttgtanaagtataattattactacttcctacctacgtacggtaccgtacggaaaccgtaaacggggaaactaacgggtaaacgaaacctaacgtaaaaccgtgtacggtacggactaccgacctaacgtac

SEQ ID NO: 379383 - DNA, 607 bp, Homo sapiens
  misc_feature: GZ8MTXP02G9N1J.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggagggccaccatcaactgcaagtccagccagtagttatttttacagtctccaaccaataagagttactagcttggtccagcagaaaccaggacatcgtcctgcactgcttctatttacgtcggggtacgttaccgtaaccccggggtaacgttccccggggtaccctacggaccccgtattaccgaggtcggactagggccgggtgtcggggacagtacttccgactctaccaaccctatcacgcacgcctagcgaaggctagaaagtgtagtcggtactttagtttaatgttacgtacagtactaagttacttattaccgttctctacgtacgtacgttcggaccgtaaaggaccgtaagggtaacgaactaacgaaacgtacgtacggtcggactcgtaccacctttac

SEQ ID NO: 379384 - DNA, 613 bp, Homo sapiens
  misc_feature: GZ8MTXP02I7MGO.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggacgggccaccatcaactgacaagtccagccaagtagttatttttacagtcctaccaaccaaataagtagttacttagtcttgttccagcaagaaaccaggacatcgtctgcactgctctattacgtcgggtccgtccgtaaccccgggtaagtccccggggtccctacggtacccccgtattaccgtaggtacggacgacgggtcgggtcggtaggggaacgtagttaccgtttccaccttcttacccgaacctagttccaagccacgtccctaggacctagggacctaagaaacgtgtagggttcgtactttaaggtttattagtggtacaagtactaattattatctacctcagtacgtcgtacgacgaagacaggtacgaactacgaaacgattcgacgacgtcgaccatacg

SEQ ID NO: 379385 - DNA, 543 bp, Homo sapiens
  misc_feature: GZ8MTXP02GV6Q3.22.14.B03.1.454.CMB.2.raw
  modified_base (415)..(415): a, c, t, g, unknown or other
  modified_base (461)..(461): a, c, t, g, unknown or other
  modified_base (472)..(472): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttgttccagcagaaaccaggacatcgtcctgcactgctcatttacgtgggcgtctacccgggaactccggggtcccctgaccccgtattccgagtgcgagcgggtctgggacagtacttcgactctcaccatcagcagcctgcaggctaggaangtaggtggactaggttttattagttgtacagtacaattattaaatntttacctctanacgtacgttcgaccaaagggtaccaaaggtacgaaaataccgaaaacgtaacaggtggactcgacctacag

SEQ ID NO: 379386 - DNA, 582 bp, Homo sapiens
  misc_feature: GZ8MTXP02I2F6R.22.14.B03.1.454.CMB.2.raw
  modified_base (408)..(408): a, c, t, g, unknown or other
  modified_base (434)..(434): a, c, t, g, unknown or other
  modified_base (566)..(566): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggacgggccaccatcaactgacaagtccagccagtagttatttttacagctaccaaccaataagagttactagcttggtccagcaagaaaccaggacatcgtcctgcactgctctatttacgtcgggtcgtaccgtacccgggtaagtcccggggtccctgaccccgtacttcgagtggcgaggcgggtcgtgggacagtattcactctcacntcagcagcctgaccaggctagaaagntggtagcgttagttttatattggtacaagtactaaagttattaactacttcctactcgtaacgtacggttccggaacgaaacggggtaaccagggttaacgaaactaccgaaaacgtacgtggtacggtacncggtaactaccttacg

SEQ ID NO: 379387 - DNA, 567 bp, Homo sapiens
  misc_feature: GZ8MTXP02GCXKO.22.14.B03.1.454.CMB.2.raw
  modified_base (318)..(318): a, c, t, g, unknown or other
  modified_base (381)..(381): a, c, t, g, unknown or other
  modified_base (403)..(403): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagtcctaccaccaataagtagttacttagtcttggttccagcaagaaaccaggacatcgtcctgcactgctctatttacgngggccgtccgtacccgggagtcccggggtcctcgaccccgtatcgagtcggcaggcgggtcgngggacagtattcactctcaccntcagcagcctgccaggctagaagtgtgtggtacttagtttactagttagtacaagtacttaaattatttaactctttaccctctacgtaacggtaccggttacggaccgaaaggggacctaagggtacgaaactacgaaacgtactgtcgactagaccacgtac

SEQ ID NO: 379388 - DNA, 649 bp, Homo sapiens
  misc_feature: GZ8MTXP02IQG3D.22.14.B03.1.454.CMB.2.raw
  modified_base (314)..(314): a, c, t, g, unknown or other
  modified_base (380)..(380): a, c, t, g, unknown or other
  modified_base (389)..(389): a, c, t, g, unknown or other
  modified_base (432)..(432): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagtagttatttttacagctccaccaataagagttacttagcttggttccagcaagaaaccaggacatcgtcctgcactgctctatttacgngggtcgtccgtaccccgggaagtcccggggtcctcgaccccgtattcgagtggcacggcgggtcgngggacagtnttcactctcacatcagcacgcctgccgaggtcgtagaaacgtntcggtaggacttaagttttactttagtttcgtacgaacgtacgttaaaatttacttttaaacttacttttccctacccgttacgtaaaccggttacggttttaccccggggaaccgtaaaacgggggtacccctaaaagggggttaaaacggaaaacttaaaccgaaaaacggtaacgttagggtaccgtacggttacgaacctaacccgtttaacg

SEQ ID NO: 379389 - DNA, 521 bp, Homo sapiens
  misc_feature: GZ8MTXP02FF883.22.14.B03.1.454.CMB.2.raw
  modified_base (301)..(301): a, c, t, g, unknown or other
  modified_base (403)..(403): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagtatttttacagctccaccaataagagttactagctgtcagcagaaacaggacatcgtctgcactgctcatttacngggctcgtacccgggaatccggggtccctgaccccgattcagtggcagcgggtctgggacagattcactctcaccatcagcagccctgccaggctgaaacgntgtggctagtttattattggacagtcaaattattatacttcctctactaggtaccgttcggaccaaagggaccaaagggtacgaaactacaaaacgaactggtacgctagcctactac

SEQ ID NO: 379390 - DNA, 562 bp, Homo sapiens
  misc_feature: GZ8MTXP02FYKH4.22.14.B03.1.454.CMB.2.raw
  modified_base (313)..(313): a, c, t, g, unknown or other
  modified_base (370)..(370): a, c, t, g, unknown or other
  modified_base (396)..(396): a, c, t, g, unknown or other
  modified_base (405)..(405): a, c, t, g, unknown or other
  modified_base (425)..(425): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagtagttatttttacagtctaccacaaataagagttactagcttggttccagcaagaaaccaggacatcgtcctgcactgctcattacgnggcgtccgtacccgggaatcccggggtcctgacccgtattcagtgacgaggtcgggntgggacagtattcacgtctacaaccntacagcacncccgtgcgaggctagaaagntggtggaatggttttaatattggacagataaattattagtactccctctactaaggccgtttacggaccgtaaagggaccaaagggttaagaaacttaacgaaaacgtaaacgtggtaccggtatacgacacgttac

SEQ ID NO: 379391 - DNA, 590 bp, Homo sapiens
  misc_feature: GZ8MTXP02I9YAQ.22.14.B03.1.454.CMB.2.raw
  modified_base (420)..(420): a, c, t, g, unknown or other
  modified_base (459)..(459): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccacaataagattactagcttggtccagcaagaaaccaggacatcgtcctgcactgctctatttacgtgggtcgtcctacccggggaatcccggggtccctggaccccgtattcagtggcaggcgggtcgtgggacagtacttcactctcaccatccagcagcctgcaggctagaaagnttggaggtctaagttttatagttgtacaagtctaaattnttaacttctttcctaccgtactacggtacggtttaccggaccggtaaaaggggtaaccctaaggggttaaacggaaaacttaaccggaaaaaccgtacggttaggttcgggactttacggactaaccctag

SEQ ID NO: 379392 - DNA, 692 bp, Homo sapiens
  misc_feature: GZ8MTXP02G9UZD.22.14.B03.1.454.CMB.2.raw
  modified_base (487)..(487): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagacctccctggctgtgtctcgtgggcgaggacgggccaccatcaactgacaacgtccagccagtagtttatttttacagtcctaccacaaataagtattactagtcttggttccagacaagaaaccaggacatccgtctgacactcgctctattacgcgggtacgtccgacccgggaacgtccccggggtcctacggaccccgtagttccgaggtcggacgtacggtcgggtccgtagggacgtacgtactttccgtactctacccgtaccctagtccgacgcgaacgtcccgtagacgacggggtctaagggaaacgngttacggttacgagttaagttttatcgtttagtaccgaatacttaatttaactttcgtttaaccttcccttacgtacgtaacgggttacccggtttacggaaaccggtaaacggggtaaaccctaaaggggttaaacggtaaacctaaaccggtaaaacgttacggttcggaacggtttcccgtacggaaccctacggtttaacg

SEQ ID NO: 379393 - DNA, 586 bp, Homo sapiens
  misc_feature: GZ8MTXP02IO1Q5.22.14.B03.1.454.CMB.2.raw
  modified_base (297)..(297): a, c, t, g, unknown or other
  modified_base (490)..(490): a, c, t, g, unknown or other
  modified_base (586)..(586): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgcaagtccagccagagttatttttacagtctccaccaataagagttactagtcttggttccagcaagaaaccaggacatcgtccngcactgctctatttacgtgggccgtccgtaccccgggaagtccccggggtcctcgaccccgtattcgagtcggcgaggcgggtcgtgggacagtactttccactctcacctatccagcacggtcctaggccgaaggcctaaggaatagtcggttgtacttaaggtttttattagttcgtacagtactaaattnttaatctttccactctaacggtaccgttacggaccgtaaagggacctaaggggtactaaataccgaaagtacgtggtacgactcggacctaacgtn

SEQ ID NO: 379394 - DNA, 572 bp, Homo sapiens
  misc_feature: GZ8MTXP02G6DWG.22.14.B03.1.454.CMB.2.raw
  modified_base (310)..(310): a, c, t, g, unknown or other
  modified_base (396)..(396): a, c, t, g, unknown or other
tcagacatacgcgtcacgaccggtgctcgatttagtgtgagtagttccggcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggtccagcagaaaccaggacatcgtcctgcactgctctatttacgngggcgtccgtacccgggaagtcccggggtccctagaccccgattccagtggcaggcgggtctggggacagtattcactctcaaccntacagcagccctgccaggctagaaagatgtggctaaggttttatatttgacagtactaaaattatttaatacttcccctctacaacggtaccgtttaccggaccaaaacgggggaacctaaaggggtacgaaaaactaccaaaaacggtactaggtacggactcgacctaacctag

SEQ ID NO: 379395 - DNA, 600 bp, Homo sapiens
  misc_feature: GZ8MTXP02F0P70.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagtagttactagcttggtccagcaagaaaccaggacatcgtcctgcactgctctatttacgtgggtccgtcgtaccccgggaagtcccggggtccctggaccccgtattccgagtcggcaggtcgggtcgtgggactaggtactttccaacttctccaacctataccagcagtcccgtgccgtaggtctagaaagtgtcggtgacttaaggtttattagttcgtacaagtactaaattattacttacttcctactacgtaacgtaccgttacggaccgaaaaggggtacccaaagggttaacgaaacttaacgaaaacgtaacgtcggtacggactacggacctacctaa

SEQ ID NO: 379396 - DNA, 676 bp, Homo sapiens
  misc_feature: GZ8MTXP02J1TZP.22.14.B03.1.454.CMB.2.raw
  modified_base (562)..(562): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagactccctggctgtgtctcgtgggcgaggacgggccaccatcaactgcaacgtccacgccaagtagttatttttacagtcctaccaacctaaagtaagtacgttacttagtcttcggttccagacaacgaaaccaggacatccgtcctgctactcgctacgtactttacgcgggtcgtaccggtacccgggtaacgtccccggggtcctacgacccccgtattccgaggtcggacagggtcgggtcggtcggggactagtattaccgacttacctaccgaacctactccacgaccgacggtcccgtggaccgacggggtactaagggaacgtgttgggtacgtattagttttaatattcgggtacatacttaattaactttataccgtttccncccgttaataccggggttaccgtaccgggaaccgtaaaacggggacctaaaggggttaacgaaaacctttaacggaaaacgtacgtcggtacggtacctcggaacctaaccttc

SEQ ID NO: 379397 - DNA, 550 bp, Homo sapiens
  misc_feature: GZ8MTXP02FYS8L.22.14.B03.1.454.CMB.2.raw
  modified_base (395)..(395): a, c, t, g, unknown or other
  modified_base (425)..(425): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagtctaccaccaataagagttacttagcttggttccagcaagaaaccaggacatccgtctgcactgctctatttacgtgggcgtccgtacccgggaacgtccggggtcctcgaccccgtattcagtggcaggcgggtcgtgggacagatttcgactcncaccatcagcagccctagcagctagaaagntaggtgctaggtttattagttgactagactaattattaatacttcctctcgaacgtcggttccgacgaaggacctaaggtacggaaacttaacgaaaagtacgtgtacggactcggactacctag

SEQ ID NO: 379398 - DNA, 600 bp, Homo sapiens
  misc_feature: GZ8MTXP02JON4D.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacgggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttacgtgggcctcgtacccggatccggggtcctgaccccgattcagtggcagcgggtctgggactagatttcactctcacccatcgagcacgcctgcgaggctagagatggtggtactagtttattagttggtacctaagtacctaaagtttatttacttactttacccgttacctcgtaacggtaccggtttccgggaacccgaaaggggtacccgaaaggggtttaccgaaaacgttacccgaaaaaccggtaacgttaccggtagggtaaccgttcggaacccgtaccctaacg

SEQ ID NO: 379399 - DNA, 553 bp, Homo sapiens
  misc_feature: GZ8MTXP02GLOB6.22.14.B03.1.454.CMB.2.raw
  modified_base (299)..(299): a, c, t, g, unknown or other
  modified_base (310)..(310): a, c, t, g, unknown or other
  modified_base (372)..(372): a, c, t, g, unknown or other
  modified_base (423)..(423): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttactagcttggttccagcagaaaccaggacatcgtcctgcactnctctatttacngggctccgtaccccgggaatcccggggtccctgaccccgtattcagtcggcaggcgggtcgnggggacaggtacttcactctcacccatacagcagccctgccaggctagaanatggtggctagttttatattggtacaagactaatattatacttaccctcctagacgtacgttacggaccgaaacgggacctaaggtacgaaacttaacgaaaacgaactggacggctacgacctacgtac

SEQ ID NO: 379400 - DNA, 730 bp, Homo sapiens
  misc_feature: GZ8MTXP02F2FJA.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagacctccctggctgtgtctcgtgggcgaggacgggccaccatacaactgacaagtccacgccaagtagtttatttttacagcctaccaaccaaataagtagttaacttagtcttgtccagacaacgaaccgagactatccgtcctgcactgctactattacggcgggtccgtccggtaaccccgggtaacgtcccgggtcccgtacgaccccgtacttacgaggtcggacgtacggtcgggtcgtacgggactagttacctttcacgttctaccaaccctataccgaacgacctacggtcccgtaggaccgacggtacggttaaggaaaagttcgtacgggttagggtaccttttaagggtttttaattagggtttacgtactaaaccggtatttaaatttaaattttaacttaaccgtttacccgttacctaaccggttaacggtaccgggtttacccggggaaaccggttaaaacgggaaccgtaaagggtaaaccgtaaaaccgttaagaaaaacccggtaacgttggtacgggacctacggaacccgtaacctttacg

SEQ ID NO: 379401 - DNA, 586 bp, Homo sapiens
  misc_feature: GZ8MTXP02IRGNS.22.14.B03.1.454.CMB.2.raw
  modified_base (505)..(505): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagacctccctggctgtgtctcgtgggcgaggagggccaccatcaactgacaagtccagccaagtagttatttttacagtcctaccaaccaaataagtagttactagcttgttccagcaacgaaaccaggacatcgtcctgcactgcctctatttacgtcgggtaccgtaccgtaacccgggtacgtcccggggtcctacggaccccgtatcgaggtcgagacggcgggtcgtgggactagtacttcactctccacatcagcacgcctgaccgtaggctagaaagtgtggtacgtacttagtttttatacgttgtacagtactaattattatcttccnctacgtacgtaccgttacaacgaaacgggtacaagggtaacgaaactaccgaaaagacgtggtacgactacgactacctag

SEQ ID NO: 379402 - DNA, 524 bp, Homo sapiens
  misc_feature: GZ8MTXP02J0X3A.22.14.B03.1.454.CMB.2.raw
  modified_base (248)..(248): a, c, t, g, unknown or other
  modified_base (288)..(288): a, c, t, g, unknown or other
  modified_base (296)..(297): a, c, t, g, unknown or other
  modified_base (299)..(299): a, c, t, g, unknown or other
  modified_base (302)..(302): a, c, t, g, unknown or other
  modified_base (312)..(312): a, c, t, g, unknown or other
  modified_base (337)..(337): a, c, t, g, unknown or other
  modified_base (347)..(347): a, c, t, g, unknown or other
  modified_base (349)..(349): a, c, t, g, unknown or other
  modified_base (351)..(351): a, c, t, g, unknown or other
  modified_base (353)..(353): a, c, t, g, unknown or other
  modified_base (359)..(359): a, c, t, g, unknown or other
  modified_base (361)..(361): a, c, t, g, unknown or other
  modified_base (364)..(364): a, c, t, g, unknown or other
  modified_base (367)..(367): a, c, t, g, unknown or other
  modified_base (369)..(369): a, c, t, g, unknown or other
  modified_base (371)..(371): a, c, t, g, unknown or other
  modified_base (375)..(375): a, c, t, g, unknown or other
  modified_base (377)..(378): a, c, t, g, unknown or other
  modified_base (380)..(380): a, c, t, g, unknown or other
  modified_base (382)..(382): a, c, t, g, unknown or other
  modified_base (386)..(386): a, c, t, g, unknown or other
  modified_base (389)..(389): a, c, t, g, unknown or other
  modified_base (417)..(417): a, c, t, g, unknown or other
  modified_base (420)..(420): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgacggacggccgaccaagtccgaacctgacgaagtccagccagagttattttacanctccacaatagagttactagctgtccagcagaaccagganatcgtccnncnctnctctattcgnggcgtccgaccggacgtccggtccncgacctctgngngngngcgcgngnatntcncncncacncnncncncgcncgngacgcgagagagtgtgtgtattattatntanagatatattacttacttactactacgtacgtacgtaccggacgacggtaacggtacgtaacgaacgtaacgaacgtaacgtacgtacgtacgtacgtacactac

SEQ ID NO: 379403 - DNA, 586 bp, Homo sapiens
  misc_feature: GZ8MTXP02GO0V3.22.14.B03.1.454.CMB.2.raw
  modified_base (285)..(285): a, c, t, g, unknown or other
  modified_base (405)..(405): a, c, t, g, unknown or other
  modified_base (572)..(572): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgacaagtccagccagtagttatttttacagcctccaccaataagagttactagcttggtccagcaagaaaccnggaacatcgtcctgcactgctctatttacgtgggcgtccgtacccgggaagtcccggggtccctgaccccgtatcgagtcgcgaggtcgggtcgtgggactagactttcgactctcaccntcagcacgcctgcaggctagaactgtggtgcttagtttattattcggacagtataaagttattaacttacttccctcgtactacggttaccggttccggaaacccgtaaaggggaaacctaagggttaaacgaaactaaccgaaaacggtaaccgtggtacggtacncggtaccacttacg

SEQ ID NO: 379404 - DNA, 681 bp, Homo sapiens
  misc_feature: GZ8MTXP02J25QK.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatcgacccagtctccagacctccctggctgtgtctgtgggcgaggacggccaccatcaactgacaacgtccagcctaagtacgtttattttacagtcctaccaaccaaataagtagttactagtcttggtaccagacaacgaaccaggactactccgtcctgcacgtcgctactacgttacgtcgggtccgtaccggtaacccggggtaaccgtccccggggtcctacggaccccgtagttccgaggtcggtcgacggggttcgggtgtacggggactacggttattccacctttccaccaaaccttacaccgtacggacccgacgtcgacggacgtacggtacgtaggacgtggtaggttacgtatttagtttagtctacgtacattaacttaaattacgtttactacctttacctaccgtacgtaaccgggtaccgtaccgggaaacccggaaacggtaacggaaaacggtaacgtaaacctaaaccggaacgtaggtacgtcgtaaccgtactacccgtactcg

SEQ ID NO: 379405 - DNA, 898 bp, Homo sapiens
  misc_feature: GZ8MTXP02JUAP4.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagacctccctggctgtgtctcgtgggcgaggagggccaccatcaactgacaagtccacgccagtagttactttttacgagtcctaccaacctaagtaagtagttaacttagtcttggttaccagacaacgaaaccaggacactccgtacctgacctacgtcgtctacgtactttacggtcgggtccggttaccggtaaccccggggtaaacgttccccggggtacccctacggacccccgtacgttacgagggttcgggccgtacggggtccggggttcggtacgggggtacgtaacggttaccgtttaccgtacccttaccttacccaaacctaacgttacccgaaccggacccgtacgggtaccccttcgggtaccccgtaaaggggacccgtttaacgggaaaaggttacgttcgggggttacggttaaaccgtttaaggggttttttaaactttaagtttccgggttaaccgtaaacgttaaaacgtttaaaacgtttttaacgttttaaacgtttaaaccccgtttttccccctaaacccggttaccgtttaaaaccggggtttaaacccccggggttttacccgggaaaaccccggggtttaaaacggggaaaacccggtttaaaagggggtaaaaccgggttaaaaaccttaaacccgggtaaaaaacggtaccggtttaacggttacggggaaccctacggtaaccccctaaggtttaacccg

SEQ ID NO: 379406 - DNA, 691 bp, Homo sapiens
  misc_feature: GZ8MTXP02HVJYN.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactcccctggctgtgtctcgtgggcgaggacgggccaccatcaactgacaagtccagccagtagttatttttacagtcctaccaacaataagtagttactagtcttggtccagacaagaaaccaggactactccgtcctgacctactgtacctactaacgttttacggtgggtcccgttaccggtaaccccggggtaacgttcccccgggggtccctacggtaccccgtacgtttccgaggtcgggcgtacggggtcggggtccggtaggggtaacctaggttacctttaccgaccttcctacccaaaccctatcccgaagccgtacgcccgttgaccggtagtaccgaaggtaacgtagttcggtagggttctttaagttttatacgttgaccagtactaaatttacttattacttccctactacgtacgttaccggttccggaaacccgaaaggggtaacctaaggggtaaacaaacgtaacgtaaaacggtacgtcggtacggctacgtactacgttac

SEQ ID NO: 379407 - DNA, 600 bp, Homo sapiens
  misc_feature: GZ8MTXP02GYP0X.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagacttccctggctgtgtctcgtgggcgagaggccaccatcaactgacaacgtccagccagtagttatttttacagtcctaccaaccaaataagtacgttacttagcttcggtaccagacaacgaaaccaggacactccgtctgacactgtactctatttacgtgggtccgtaccgtacccgggaacgtcccggggtcctagaccccgtattcgagtcggcgacggcgggtcgtggacagtacttccactctaccactcacgagcacgcctggcgacgcgtagaagtgtagtgtacgttaagtttattattaggtacagtataaattattacttacttcctcacgtacgtacgttacggaccgtaaaggaaccgtaaggtaacgtaaactaacggaaaaccgtagtacggtaggtacctacggaccaactcg

SEQ ID NO: 379408 - DNA, 789 bp, Homo sapiens
  misc_feature: GZ8MTXP02J2I2Z.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgcaagtccagccagtagttatttttacagtctccaccaaatagtattacttagcttggttccagcaagaaccaggacatcgtctgcactgctctatttacgcgggtctaccgtacccgggtaatcccggggtcctcgaccccgtattcgaggttcggacgacggtcgggtcgtagggactacggtactttaccgactttctacccaacctactaccgaacgtaccaacgggtccccttagggccgtaaacgggttccgaacgggtaaaacggtacggtttcgggtaagggttaccctttaaaggggtttttaactttaaggtttaccccggggttaaacgtaagttaaacccgtttaaaaatttaaccgtttttaacgttttaaaccccttttccccttaaaccccgttaacggtttaaacccggggttaacccggttttacccgggggaaacccggttaaaacgggttaaaccccggggtaaaaggttaaaccggggtaaaaacctttaacccggaaaaccggttaacggttcgggtaccggtaacccgtttacggaaccctaacggtttaacccg

SEQ ID NO: 379409 - DNA, 632 bp, Homo sapiens
  misc_feature: GZ8MTXP02HKJUY.22.14.B03.1.454.CMB.2.raw
  modified_base (308)..(308): a, c, t, g, unknown or other
  modified_base (326)..(326): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggagggccaccatcaactgcaagtccagccagtagttatttttacagtcctaccaacctaaataagagttaacttagtctttggttccagcaagaaaccgaggacatccgtcngcactgctctatttacgngggtcgtccggtacccggtaacgtcccggggtccctgaccccgtattcgaggtggcgacggcgggtcgtagggactagtactttacgctctaccaccgatcgaagcagtcccctggaccacggtctaaggaagtagtagggttcggttaagttaagtttttaattagtttagaccgtagtattaaagttaattactttacttcctaccgtcgtacgttaccgggttacgaccggtaaagggtaaccgtaaacgggtaacggtaaactaacggaaaacgtctaggttacgacgtacgacctacgtac

SEQ ID NO: 379410 - DNA, 627 bp, Homo sapiens
  misc_feature: GZ8MTXP02HGD1R.22.14.B03.1.454.CMB.2.raw
  modified_base (320)..(320): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagacgggccaccatcaactgcaagtccagccagtagttatttttacagtctaccaccaataagagttactagtcttggttaccagacaacgaaaccaggacatcgtcctgcactgctctattacgnggtcgtcgacccggtaacgtcccgggtcctcgaccctgttcacgtgcgaggtcgggtcgtagggacagtacttccgtactctacacctataccgagccgacgcccgtagcgaggtcgtagaagtgtaggtacgtattaggttttattagttacgtacacgtactaatttattaattaccttccctacgtaaccgtacggtaccggtttaccggaaccgtaaacgggggaaacctaaaggggtaacgtaaaccgttaaacgaaaacccggtagttacgggtaccgtacgttacgtaccaaacccgttg

SEQ ID NO: 379411 - DNA, 563 bp, Homo sapiens
  misc_feature: GZ8MTXP02G4ZCX.22.14.B03.1.454.CMB.2.raw
  modified_base (316)..(316): a, c, t, g, unknown or other
  modified_base (468)..(468): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagacctccctggctgtgtctctgggcgagacgggccaccatcaactgcaagtccagccagtagttatttttacagctaccaccaataagagttactagtcttggtccagcaagaaaccaggacatcgtcctgcactgctctatttacgngggtccgtaccgtaacccgggaacgtcccggggtccctagacccccgtattccgagtggcgaggcgggtcgtgggacagtattcactctacaccatcagcacgccctgccaggctagaagtagtggtggtacttaagttttatattcggaanagtataattaattacttacttcctctactacgtacgtacgacgaacgaacgaacgtaacgaacgaacgaacgaacgtacgtacgcgacacactac

SEQ ID NO: 379412 - DNA, 635 bp, Homo sapiens
  misc_feature: GZ8MTXP02I84FJ.22.14.B03.1.454.CMB.2.raw
  modified_base (432)..(432): a, c, t, g, unknown or other
  modified_base (465)..(465): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggacgggccaccatcaactgacaagtccagccagtagttatttttacagctaccaccaataagtagttacttagcttggttaccagacaacgaaaccgaggactatccgtctgcactgctctatttacgtcgggtcgtaccggtaccccgggacgttccccggggtcctacggtaccccgtattccgagtcggcacgggcgggtcgtagggactaggtacttccgactctacacctntacgacgccacgccgtgccgagacgtagaacgngttggtacgtactagttttatatcggtacagtctaagttacttactaccttcctacctagtaacgtaccgggttacgaacccggtaaaggggaacctaagggtaaacggtaaaactaaaccggtaaaaccgttaggtacggtaccggaactccggtaacctaccctttag

SEQ ID NO: 379413 - DNA, 557 bp, Homo sapiens
  misc_feature: GZ8MTXP02F0NXW.22.14.B03.1.454.CMB.2.raw
  modified_base (433)..(433): a, c, t, g, unknown or other
  modified_base (460)..(460): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaaccaataagattactagtcttggttccagcagaaaccaggacatccgtctgcactgctctatttacgtgggtccgtcgtaccccgggaacgtccggggtccctcgaccccgtattccgaggtcggcacggcgggtcgtgggacagtattcgactctacaccatcagctacgcctgcctaggctagacgngtgtggcttagtttattagtgcacgtnaacttattatacttccacttgacgtacggttcgaccgaaaggggaccctaagggtacgaaaattacccgaaaagtaacgtgtacggctgaccactta

SEQ ID NO: 379414 - DNA, 727 bp, Homo sapiens
  misc_feature: GZ8MTXP02I45XN.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagactccctggctgtgtctcgtgggcgagaggccaccatcaactgacaagtccagccagtagttatttttacagctaccaaccaataagtagttactagcttggttaccagacaagaaaccaggactacgtcgtcctgactacgtcgtactactatttacgtcgggtcgtaccgtaaccccgggtacgtccccggggtacctacgaccccgtagttccgaggtcggacgacggtccgggtcgtacggggtactaggtactttccgacctacctacccaacccgtattacccgacgtcccgaacgtccccgttagacccgtaagggtcctaagggaaaacgtgttacggtacggtaacgtttaaagtttttagttaagttcggtaaccaagttaaccttaaatttaagtttaaacttccggtttaccccttacaaccgttaacgggtacccggtttacgggaaaccccggtaaaacggggtaccgttaaacggggtaaaacgtaacctaaaaccggaaaacgttaccgtagggtcggttacaccgtacgtaactttaccg

SEQ ID NO: 379415 - DNA, 672 bp, Homo sapiens
  misc_feature: GZ8MTXP02HTQVE.22.14.B03.1.454.CMB.2.raw
  modified_base (450)..(450): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggacggccaccatacaactgacaagtccagccagtagtttattttacagtcctaccaacctaataagtacgttacttagtcttcggtccagacaacgaaacgaggactactcgtcctgcactcgctctattcgtgggtccgttaccggtaacccgggtacgtcccggggtcctacggaccccgtattcgaggtcggcgacgggtcgggtcgtacggggtactacgttactttaccgacctactacccaaaccgtntaccgaacgtccgaacgcccgttacggaccgtagggacctaaggaaacgttgttaggtcgtagtttaaggtttttataagttcggtaacagtaactaatttactttaacttaccttcctactacgtacgtcggttacgaaaccgtaaggggaacctaagggtaacggaaaactacccgtaaaaacggtcgtacggtcggtaacctcggaaccctacggttac

SEQ ID NO: 379416 - DNA, 670 bp, Homo sapiens
  misc_feature: GZ8MTXP02IQ8U3.22.14.B03.1.454.CMB.2.raw
  modified_base (456)..(456): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagtagtttactttttacagtctaccaacctaaataacgtagtttaactagtcttacggttccagcaacgaaaccgaggacactccgtcctgcctatcgtacctctaagtttccgcggggtccttaccggtaaccccgggtaacgttccccggggtccacggtacccgtattcgaggttcgcgacggtccgggtggtacgggacagttactttccgaacttcctacgacctacncgacgacgacgtccgtagaccgtacggtcgaggtaagtcgttacggtacggttaactttaagtttttaacgtttagttacggtaaccgtaagtacttaaatttactttaacttaccttacctacgttacgtacgtaccgttaccggaacgtaacgggaacgtaacggtaaacgtaacgtaacgaaacgtcgtcggtacacttacgactacgtac

SEQ ID NO: 379417 - DNA, 776 bp, Homo sapiens
  misc_feature: GZ8MTXP02HE3LA.22.14.B03.1.454.CMB.2.raw
  modified_base (241)..(241): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggactattgtgatgacccagtctccagacctccctggctgtgtctcgtgggcgagcgggccaccatcaactgcaagtccagccagtattattttacngtcctaccaccaataagagttactagtcttggtccagcaagaaccaggacacgtccgtacctgaccacgtcgtctacttaagtttacgtcgggtccgttacccgtaaccccggggtaacgttccccggggtacccctaggacccccgtattaccgaggtacggcgtacggggccggggtcgtcggggaaacgtaggttaccttttaccgacccttccttacccaaaccgttacgtacccgaacgtccccgaaggtcccccgttagacccgggtaacgggtacgtaaggaaaagtaggttccggtccgggttaacgtttaaggttttttacttaaggttcgaccgtaaagtaaccttaaatttaacttttagttaccctttacccgtacccttaccgttaaacgggttcccggttaccgggaaacccggtaaaacggggtaaccccggtaaaaggggttaaccgtaaaaaccgttaaccgaaaaaccggttaggtcggttaccggggtactacccggaactaaacccgtttcccgg

SEQ ID NO: 379418 - DNA, 534 bp, Homo sapiens
  misc_feature: GZ8MTXP02I4YG7.22.14.B03.1.454.CMB.2.raw
  modified_base (331)..(331): a, c, t, g, unknown or other
  modified_base (337)..(337): a, c, t, g, unknown or other
  modified_base (403)..(403): a, c, t, g, unknown or other
tcagacatacgcgtcacgaccggtgctcgatttagtgtgagtagttccgcgggggagctacaacaggcaggcaggggcagcaagatggtgctgcagacccaggtcttcatttctctgttgctctggatctctggtgcctacggggacattgtgatgacccagtctccagactccctggctgtgtctctggcgagaggccacatcaactgcaagtccagccagtagttattttttacagctccaaccaataagagttactagcttgtcagcagaaacagacatcgtcctgcactgctcatttactggcgtcgtaccgggaatccggggtccngaccgnttcagtgcagcgggtctgggacagatttcactctacaccatcagcagcctgcaggctagaagatgnggactagtttaattatgtacagtactaatattatacttcctccttacgagtacgttacggaccgaaagggttaccaaaagggtagaaaacttcgaaaaaccgttacgtagttaggaccttaggacctaacc

SEQ ID NO: 379419 - DNA, 585 bp, Homo sapiens
  misc_feature: GZ8MTXP02FQH8A.22.14.B03.1.454.CMB.2.raw
  modified_base (312)..(312): a, c, t, g, unknown or other
  modified_base (399)..(399): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggttccagcaagaaaccaggacatcgtacctgcactgctctatttacgngggccgtaccgtaccccgggaatcccggggtccctgaccccgattcagtgcgagcgggtctgggacagtattcactctcaccatcancagccctagcagctagaacgatgtggctaaggttttattagttgtcaacgtataaattatttaacttacttccctactactaacggtacccgtttcggaaccgtaaaacggggtaaccaaaagggttaacggaaaacttaccgaaaaacggtacgttaggtacgggacttacggaccaacgttaac

SEQ ID NO: 379420 - DNA, 620 bp, Homo sapiens
  misc_feature: GZ8MTXP02IF7XT.22.14.B03.1.454.CMB.2.raw
  modified_base (299)..(299): a, c, t, g, unknown or other
  modified_base (305)..(306): a, c, t, g, unknown or other
  modified_base (317)..(317): a, c, t, g, unknown or other
  modified_base (354)..(354): a, c, t, g, unknown or other
  modified_base (403)..(403): a, c, t, g, unknown or other
  modified_base (448)..(448): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagacgggccaccatcaaactgacaagtccagccagagttatttttacagtctaccaccaaataagagttactagcttggtccagcaagaaaccaggactatctcngctacnnctctattacgnggtcgtacgaccggtacgtccgggtcctcgacccgtnttacgagtcggacgtacggtcgggtcgacgggacgtattaccgttaccnctaccttaccaaccttacacgaacgcgaactccgtcgacgaacgntaaggagtaagtggtacgtatttaaggtttttaatagtttacggacctagtaattaaattaattacttacttacctccctaagtacgtacggttaccgacgttaaacggaaaccgtaaggtaacgtaaaactacgaaaacgtacgtacggtcgacgttacacctaaccttcg

SEQ ID NO: 379421 - DNA, 581 bp, Homo sapiens
  misc_feature: GZ8MTXP02IWH4E.22.14.B03.1.454.CMB.2.raw
  modified_base (376)..(376): a, c, t, g, unknown or other
  modified_base (419)..(419): a, c, t, g, unknown or other
  modified_base (427)..(427): a, c, t, g, unknown or other
  modified_base (449)..(449): a, c, t, g, unknown or other
  modified_base (491)..(491): a, c, t, g, unknown or other
  modified_base (556)..(556): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagacgggccaccatcaactgcaagtccagccagtagttatttttacagctaccaaccaataagagtttactagcttgttaccagcaagaaaccaggacactccgtcctgacactcgctctatttacgcgggtcctccgtacccgggaacgttccccgggtacctcggaccccgtacttacgngtcggcgacggtcgggtcgtgggactagtacttcactctcacntcagcacncgtgaccagggtactagaaagngttaggtggtacttaggttttatagtggtacagtactaattntaacttacttctctacaggtcgttacggccgaaagggtactaggtaacgtaactacgaaaacgtntcggtacggctacggcctaacgttg

SEQ ID NO: 379422 - DNA, 642 bp, Homo sapiens
  misc_feature: GZ8MTXP02HGEQ8.22.14.B03.1.454.CMB.2.raw
  modified_base (440)..(440): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagacctccctggctgtgtctcgtgggcgaggacgggccaccatcaactgacaagtccagccagtagttatttttacagcctaccaacctaaataagtagttacttagtcttcgtccagacaacgaaaccagacatccgtcctgacactcgcctctactttacgtcgggtccgtaccgtaacccgggtaacgtccccggggtccctacgaccccgtacttcgaggtcgcgacgggtcgggtcgtgggactagtactttccacgtcctacacctntacacgcacgcctgaccgaggtactagaagtgtggtgtacgttagttttatagtttcgtacgacgtattaaatttactttacttaccttacccgtcctacgtacgtacccggtttcgaaccgtaaacgggtaaaccgaaggttaacggaaaacttaaccgaaaacgtaaccgttaggtacgaccgtacgaccttacgtaccg

SEQ ID NO: 379423 - DNA, 597 bp, Homo sapiens
  misc_feature: GZ8MTXP02F2T8I.22.14.B03.1.454.CMB.2.raw
  modified_base (302)..(302): a, c, t, g, unknown or other
  modified_base (311)..(311): a, c, t, g, unknown or other
  modified_base (347)..(347): a, c, t, g, unknown or other
  modified_base (360)..(360): a, c, t, g, unknown or other
  modified_base (398)..(398): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgaccagtctccagactccctggctgtgtctcgtgggcgaggacgggccaccatacaactgacaacgtccagccagtagttatttttacagtctaccaacaataagtattactagtcttagtccagcaacgaaaccaggacatcgtcngcactgctntattacgcgggcgtaccgtaccggacgtccggtccngaccctatcgagngcgaggcggtgacgactagtacttccactccacacctnacagcacgccgtgaccgtaggacgaggtaaagtagtgggtacgtacgtttaagtttaattagttacgtactaacgtataaatttacttaactacttccctactacgacgttaccggttacggaaacgtaacgggaaccgtaaggtaaacgaacttaacgaaaacgttcgtaggtacgtaccgtagaaccccagttaccg

SEQ ID NO: 379424 - DNA, 598 bp, Homo sapiens
  misc_feature: GZ8MTXP02JUWCH.22.14.B03.1.454.CMB.2.raw
  modified_base (269)..(269): a, c, t, g, unknown or other
  modified_base (301)..(301): a, c, t, g, unknown or other
  modified_base (360)..(360): a, c, t, g, unknown or other
  modified_base (383)..(383): a, c, t, g, unknown or other
  modified_base (401)..(401): a, c, t, g, unknown or other
  modified_base (413)..(413): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagacctccctggctgtgtctcgtgggcgaggacgggccaccatcaactgacaagtccagccagtagttatttttacagtctaccacaataagtattactancttcgtcagacaagaaccaggactactcgtcngcactgctactattcgcgggtccgtacgtacccggtacgtcccgggtcctgaccccgtnttcgagtcggcgaggcgggtcgngggactaggtacttaccnctacgtacacgntaccgagcgacgtcccgtgaccgacggtactaggaagtgtaggtggtacttagtttattagttgtactagtaccttaattactttaacttcttcctaccgtagtaccggtaccgttaccggaccgtaaacgggtaccgtaagggaagtaactaacgaaacgtagtacggacgtcacgccaactcg

SEQ ID NO: 379425 - DNA, 606 bp, Homo sapiens
  misc_feature: GZ8MTXP02JLDDW.22.14.B03.1.454.CMB.2.raw
  modified_base (312)..(312): a, c, t, g, unknown or other
  modified_base (441)..(441): a, c, t, g, unknown or other
  modified_base (447)..(447): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccacatcaactgcaagtccagccagtagttatttttacagctccaaccaataagattacttagcttggttccagcaagaaaccaggacatccgtcctgcactgctcatttacgngggtccgtacgtaccccgggtaagtccccggggtcctcggaccccgtacttcgaggtcggcaggtcgggtcgtgggacagtacttcgactctcacatacacgcacgtccctgacgacggactagaaagngttggngggtaccttagttttacgtaagttttcggactaagtactaaattatttaactacttaccgtcctacgtaggttaccgttacggtaaccgaaacggggtactaaaacgggtacgaaaactacgaaaaccgacgttaggccggtatacgaccaccttaacg

SEQ ID NO: 379426 - DNA, 824 bp, Homo sapiens
  misc_feature: GZ8MTXP02HDLLI.22.14.B03.1.454.CMB.2.raw
  modified_base (253)..(253): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatcgacccagtctccagacctcccgtggctgtgtctcgtgggcggaggacgggcccaccatacaactgacaacgtccagaccagtaagtttattttacncgtcctaccaccaataagtagttacttagcttgtccagacaacgaaaccgaggactactacgtcctgctactcgtctcgtactttacggtgggtacccgttaccggtaaccccggggtaaccggtttccccggggtaccccttacggacccccgtagttccgaggtcgggaccgacggtccggggttggcgggtaactacggttaacttcccgtaccttccgtacccgaactacgtacccgaacgccgaaccttcccggacggaccgtaacggggtaccctaaagggaaaccggttggttacgggttacgggttaaccgttttaaagggtttttattaggttaccgtacgaaaacgttaatttaaaacggtttatttaacgtttcctttacccccgttaccgttaccgggaaaaccgggtttaccccgggttacggggaaaaccccggtaaaacgggggttacccccgtaaaaagggggtaaacgttaaaaaccgtaaaacccggaaacggttttaacccgggacgggttacggtaaccccgtaaccggtaccctaaaaccccggtttacg

SEQ ID NO: 379427 - DNA, 614 bp, Homo sapiens
  misc_feature: GZ8MTXP02FVQDK.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactcctggctgtgtctgtgggcgagagggccaccatcaactgcaacgtccagccagtagttatttttacagtctaccacaaataagtagttactagtcttggttacagacaagaaaccaggactatcgtctgcactgctctattcgtggcgtcgtaccggagtccgggtcctacgacccgtatcagtcggcaggtcggtcgtggactagtacttcgactctcacctatccaagcagcctagcgtacggacttaggaaagtgttaggtacggtacttaggtttaatttaattgggtaccaaggtactaaagttacttaaattaccttacctacgtacgaacggttacggttaccggacgtaaacgggtaaccctaagggttaaccgaaagttaacgaaaaaccggttctaacggggttacggacttaacggaccgtacccttaacg

SEQ ID NO: 379428 - DNA, 515 bp, Homo sapiens
  misc_feature: GZ8MTXP02FJIJY.22.14.B03.1.454.CMB.2.raw
  modified_base (355)..(355): a, c, t, g, unknown or other
  modified_base (404)..(404): a, c, t, g, unknown or other
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagtatttttacagctccaccaataagagttactagcttggttccagcagaaaccaggacatcgtcctgcactgcctcatttactgggctctacccgggaatccggggtccctgaccccgattcagtggcagngggtctgggacagatttcactctcacatcagcagccctgcaggctgaanatgtgctaggtttatattgtacagcaatattatattcctctctagtaccgttcggaccaaagggacccaaaggtagaaatacgaaaacgactagtcgacctagaccactcg

SEQ ID NO: 379429 - DNA, 740 bp, Homo sapiens
  misc_feature: GZ8MTXP02J07YS.22.14.B03.1.454.CMB.2.raw
  modified_base (463)..(463): a, c, t, g, unknown or other
  modified_base (508)..(508): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagacctccctggctgtgtctcgtgggcgagacgggcccaccatacaactgacaacgtccagcctagtagttatttttacagcctacccaacctaaagtaagtacgttacttagtacttcggttacccagaccaacgaaaccgaggactatccgtcctagcctacgtcgcctacttacgtttccggtcggggtaccgttacccggtacccggggtaacggttcccccggggtaccctcggaccccgtagttccgaggtcggcgtacggggtcggggtcggtcgggaacgtacgttntttaccgacttcctacccgaactactccgacgtccgaccgtccgngaccgacggtactaaaggagtaggttggtaccgggtatttaagtttagttacgttacggtacgtacgtattaaaacctttatttaacttaccctttacccgtacccgtaaccgttaaccggggttacccgttaccgggggaaacccggtaaagggtaaacccgtaaagggggtaacctaaaaccgtaacggtaaaacgtacgtggtacgtaccgtcgtaacccgacgttacg

SEQ ID NO: 379430 - DNA, 762 bp, Homo sapiens
  misc_feature: GZ8MTXP02IRCDX.22.14.B03.1.454.CMB.2.raw
  modified_base (326)..(326): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatcgacccagtctccagactcccgtggctgtcgtctcgtgggcgaggacgggccaccactcaactgacaacgtccagccgtaagtagtttatttttacacgtcctacccaacctaaataaagtacgtttactagtcttacggttcagacaagaaaccgaggactagtccgtcngctactcgtctactagtttacgtcgggtccttaccggtaacccggggtacgttcccggggtacctacggaccccgtagttacgaggtcggtacgtacgggtcgggtcgtacggggactaggtactttcacgtctaccactatcgacgcacgtcgtagcgacggtctagaagtcgttaggtacggtactttaagggtttttcttacggttacgtaaccgtaacgttacttaaaacttttacgtttaaaacttcccgttttacccgtaaccgttacggtttaaaccggggtaccgtttaacccgggggaaacgttaaaaacccgggggtaacgttaaacgggggttaaaaccgtaaaaccgtttaaaccggaaaaaccgggtttacgtttacggggtaacggtttacccgaaccgggtacccttaaaaccgtttacgg

SEQ ID NO: 379431 - DNA, 738 bp, Homo sapiens
  misc_feature: GZ8MTXP02HH3UC.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagacgggccaccatcaactgcaagtccagccagtagttatttttacagtctccaacaataagtagttactagcttcggttccagacaagaaaccaggaacactccgtctgactactgactactacgtttacgtcgggtaccgtccgtaacccgggtaacgttcccggggtcctcggaccccgtatccgaaggtcggacgtaggtccggggtcgttacgggactacggtactttccaaccgtccttacccaaccctattacccgagcccgtacgtccccgttaggacccgtaacggttaccaagggtaaaccgtaaggtttcggggtacggtaacctttaagggtttttacttaagtttccgtagtaacgtaattaaacgtttatttaacttacctttaccgtcccgttacttaacggtaccggtttaccggaaaccggtaaaaccgggtaacgtaaaacggggtaacgggttaaaactaaaccggtaaaacggtaacccggtttaaggaccgggttaaccgtaccggtaccctaaaactttccgg

SEQ ID NO: 379432 - DNA, 658 bp, Homo sapiens
  misc_feature: GZ8MTXP02H06X1.22.14.B03.1.454.CMB.2.raw
  modified_base (469)..(469): a, c, t, g, unknown or other
  modified_base (473)..(473): a, c, t, g, unknown or other
  modified_base (476)..(476): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagacctccctggctgtgtctcgtgggcgaggacggccaccatcgaactgacaagtccacgccagtagtttacttttacacgcctaccaaccgtaataagtagttacttagtcgtttacggtccagacaagaaaccctaggacacgttccgtcctgcctacgtcgtcctacttaacgtttccgtcggggtccgttccggaaaccccggggtacgttccccggggtcccttacgaccccgtagttccgaggtcggacgcgggtcgggtcgtgggaactagttcttaccgactctacccactanacgngcncgcgcgcgagcgagagtagtgtgttattagtttatacgttgtagtaacgtacttaattactttaacttccttccgtactacggtaacggttacggtaccggaaacggtaaacgggtaacgaacgggtaaacgtaaacctaaacgtaaacgtcgtacggtacgtacgtacgtacctaacgtcg

SEQ ID NO: 379433 - DNA, 550 bp, Homo sapiens
  misc_feature: GZ8MTXP02IOF2C.22.14.B03.1.454.CMB.2.raw
  modified_base (312)..(312): a, c, t, g, unknown or other
  modified_base (438)..(438): a, c, t, g, unknown or other
  modified_base (446)..(446): a, c, t, g, unknown or other
  modified_base (452)..(452): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacgggacattgtgatgacccagtctccagactccctggctgtgtctctgggcgagaggccaccatcaactgcaagtccagccagagttatttttacagctccacaaataagagttactagcttggttccagtcaagaaaccaggacatccgtcctgcactgctctatttacgngggccgttactaccccggggaatccccggggtcctagacccccgtattcgagtggcacggcgggtcgtcggactagtacttcactctcacatcagcagcctgcagctagagatggtgatacgtttnttatgtanacgtanattattatacttctactactagtacgttcgaccgtaaacggaccgtaaggtacgaaactacgaaaacgtacgtacgtagtacggacacgaacctaacg

SEQ ID NO: 379434 - DNA, 585 bp, Homo sapiens
  misc_feature: GZ8MTXP02F3FCK.22.14.B03.1.454.CMB.2.raw
  modified_base (326)..(326): a, c, t, g, unknown or other
  modified_base (435)..(435): a, c, t, g, unknown or other
  modified_base (455)..(455): a, c, t, g, unknown or other
  modified_base (462)..(462): a, c, t, g, unknown or other
  modified_base (489)..(489): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagacctccctggctgtgtctcgtgggcgaggacgggccaccatcaactgacaacgtccagccagtagttatttttacagtctaccacaaataagtagttactagtcttggttaccagacagaaaccaggacatcgtactgctactgctactatttacgngggtcgtaccgtaacccgggaacgttcccggggtacctcggaccccgtattccgaagtcggcgacggtcgggtcgtacggggactaggtacttcgactcctaccacctntacacgcacgtcagccgagntagaagngtggtacgattagtttatagttcgtanatatattattactctctacgtacgtacgtacgtacgacgtaaacggacgtaagtaacgaactaacgaaacgtacgtacgacgctacgacctactcg

SEQ ID NO: 379435 - DNA, 783 bp, Homo sapiens
  misc_feature: GZ8MTXP02FH4V5.22.14.B03.1.454.CMB.2.raw
  modified_base (239)..(239): a, c, t, g, unknown or other
  modified_base (307)..(307): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtggcgagacgggccaccatcaactgcaagtccagccagtagttattttacngctaccacaatagatactagcttggtccagcagaaccaggacatccgtcctgcactgctctattacgngggccttaccgtacccgggtaacgtcccggggtccctacggacccccgtatttacgacgtggacgacggtcggggttcgtacgggggactacggttatttaccaacgttcctacccaaccctaattcccgaaaggtaccccgaacggtcccccgttaggacccggtaacggggtacccgtttaacgggaaaacgttaacggttaggggttccggggttaacctttaagggttttttaaatttaaacggttttcggggtaaccctaaagggttaaccttaaaacgttttaattttaaaccggttaacctttaccccctttccgaccggtaaaacggttaccccgggtttacccggggaaacccgaaaacgggggtaaaccccgtaaaagggggtttaacggaaaaaccttaaacccggaaaaaccggttaaaccgttggggtaccgggttctaccggaaccctacccgtttaaaccg

SEQ ID NO: 379436 - DNA, 650 bp, Homo sapiens
  misc_feature: GZ8MTXP02HTT5W.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagacgggccaccatcaactgacaagtccagccagagttatttttacagcctaccaccaaataagagttactagcttcggtccagacaagaaaccaggacagtcctcctgcactgctctatttacgtcgggccgttaccgtaacccgggaacgtcccggggtaccctaggaccccgtattaccgaggtcggactacgggcggggtcgtaggggaacagttactttccaacctcctaccaacctataccgacgtccgacgccctgacgacggtcgtaagaagtagtggtgtacttagtttttactagttgtacagtactaattattatacttcctactacgtaacggtaccggtttaccggaaaccgtaaaggggtaacccgtaaaagggtaccgtaaaacgttaccggaaaaacgtacggtacggtacgggtactaccggtaacctaacccgttacg

SEQ ID NO: 379437 - DNA, 564 bp, Homo sapiens
  misc_feature: GZ8MTXP02G9TOQ.22.14.B03.1.454.CMB.2.raw
  modified_base (208)..(208): a, c, t, g, unknown or other
  modified_base (241)..(241): a, c, t, g, unknown or other
  modified_base (257)..(257): a, c, t, g, unknown or other
  modified_base (293)..(293): a, c, t, g, unknown or other
  modified_base (301)..(301): a, c, t, g, unknown or other
  modified_base (309)..(309): a, c, t, g, unknown or other
  modified_base (391)..(391): a, c, t, g, unknown or other
tcagacatacgcgtcacgaccggtgctcgatttagtgtgagtagttccgcgggggagctacaacaggcaggcaggggcagcaagatggtgttgcagaccccaggtcttcatttctctgttgctctggatctctggtgcctacggggacattgtgatgacccagtctccagacctccctggctgtgtctcgtgggcgagagggccaccntcaactgcaagtccagccagagttatttttacngtctccactaataagnttactagcttgtaccagacagaaccagacatcgctncactgctntattacgngggtctccgtaccggactcccggggtctaggacccctcgttcagtcgcgaggccggtgtgggacagtattcactctacactntacagcaggcctgaccaggctagagtatggtgattagtttatactgtacagtattataattacttacgttccactaccgtaagtaacggttccgggaactaaacgggaacctaacggggtaaaacaaacgtaaccgaacgtacgtcggtactacgtaaccgtacctaacgtcg

SEQ ID NO: 379438 - DNA, 602 bp, Homo sapiens
  misc_feature: GZ8MTXP02IRZTK.22.14.B03.1.454.CMB.2.raw
  modified_base (460)..(460): a, c, t, g, unknown or other
  modified_base (467)..(467): a, c, t, g, unknown or other
  modified_base (586)..(586): a, c, t, g, unknown or other
tcagacatacgcgtcacgaccggtgctcgatttagtgtgagtagttccgcgggggagctacaacaggcaggcaggggcagcaagatggtgtttcagacccaggtcttcatttctctgttgctctggatctctggtgcctacggggacattgtgatgacccagtctccagacctccctggctgtgtctcgtgggcgaggacggccaccatcaactgacaagtccagccagtagttatttttacagtcctaccaacctaataagtagttacttagcttggttccagcaagaaaccaggacatccgtcctgcactgctctatttagcggtcgtccgtacccggacgtcccggggtccctacgaccgtacttacgagtcggacgtaggtccggggttcgtggggactaggtactttccgacctctaccaccagtcacgcacgccctagacgacggctagggaangttacgnggttacttagtttacttatgtacatactaaattattactcttccctacgtacgacggttacgtaccggacggtaaacggaccgtaaaggtacgtaaactaacaaaggtcgttgaccgtntacgacaacgtcttcg

SEQ ID NO: 379439 - DNA, 704 bp, Homo sapiens
  misc_feature: GZ8MTXP02JBWUZ.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagacctccctggctgtgtctcgtgggcgagacgggccaccatcaactgacgaagtccagccagtagttatttttacagtcctaccaacctaataagtagttacttagtcttcggttccagtacaacgaaaccaggtacactccgtcctgactactcgcctactacgtttacgtcgggtaccgtaccggtaccccggggtaacgttccccggggtaccctacggaccccgtacgttaccgaacggtcggggaccgtaacggggtccgggtacgggtacggggtaacgtaacggttacctttaccaccgttacctacccaaaccgtactaccgagccgaacgtcccgtagacccgagggtctaaggagtaggttggtacggttaatttaggtttatttacgtggtaaccagtaacttaagttacttattacccgttcctacgtaaccgtaggttacccggtacggaaccggtaaacggtaacggtaagtaaacgtaacgtaaccgaaaagtcgtaggtacggctacgtaccacttacg

SEQ ID NO: 379440 - DNA, 641 bp, Homo sapiens
  misc_feature: GZ8MTXP02H04D2.22.14.B03.1.454.CMB.2.raw
  modified_base (348)..(348): a, c, t, g, unknown or other
  modified_base (528)..(528): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagacctccctggctgtgtctcgtgggcgaggacggcccaccatcaactgacaagtccagccagtagttatttttacagtcctaccaacctaagtaagtaacgttactagtccgtttcggtaccagaccaagaaacccaggaacacgtccgtcctacgcacgtcgtctacgtactttacggngggtaccgtccggtaccgggaacgttccccggggtacctcgaccccgtacttcgaggtcggacgacgggtcgggtcgtaggggactacggactttccgacttctaccgacctactcgacgcacggtcctagacgagcgtagagtcgtaggtagtacgttagttttattgttacggataanactaattacttacttacttcctctagtacgttaccggttcgaaacgacggtacgaaaggtacgtaaaacgtaccgtaaaacgacgtagtacccggtactaccgactaacgtcg

SEQ ID NO: 379441 - DNA, 638 bp, Homo sapiens
  misc_feature: GZ8MTXP02GYQLI.22.14.B03.1.454.CMB.2.raw
  modified_base (317)..(317): a, c, t, g, unknown or other
  modified_base (461)..(461): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagacctccctggctgtgtctctgggcgagagggccaccatcaactgacaagtccagccagagttatttttacagctccaaccaataagagttactagcttggtccagcaagaaaccaggacatccgtcctgcactgctactagtttacgngggtcgtcgtaaccccgggtaagtccccggggtccctggaccccgtattcgagtcggcaggtcgggtcgtaggggctagtctttacactctacgaccctatccgaagcaacgtcccgtagaccgaggggtaccaaggtaaacgngttacgggtaggtactttaaggttttattagttcgacgtaagacttaaattacttattaccttcctctaacgacggttaccgttccggaaccgaaacggggtaaccgtaaggtaacggaaaacttacccggaaaaagtaccgttaggtacggacctacggtacctaacccgttaacg

SEQ ID NO: 379442 - DNA, 655 bp, Homo sapiens
  misc_feature: GZ8MTXP02HZSTJ.22.14.B03.1.454.CMB.2.raw
  modified_base (318)..(318): a, c, t, g, unknown or other
  modified_base (463)..(463): a, c, t, g, unknown or other
  modified_base (466)..(466): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagacctccctggctgtgtctcgtgggcgaggacggccaccatcaactgacaagtccagccagtagtttactttttacacgcctaccaaaccgaataagtacgtttactagcgtttcgtaccagacaagaaaccaggactacgtcgtcccngcctatcgactctaatttacggcgggtccgtaccggtaccgggtaacgtccccggggtcctacggaccgtcgtttaccgaggttcggacgacggggtcgggtcggtacggggaacttaggttactttccacttccaccaccctanacncgcgaccgccgtcgacgtcggacgtaggacgtagtggtaggttacttagttttattagtcgttagataactatttactacttaccttcctacctaggtaccgttacgtccggacggtaaaacggtacgtaaacgggtacgaaacgttaccgaaaacgtcgtaggttcgacggtactaccgacgtttacg

SEQ ID NO: 379443 - DNA, 653 bp, Homo sapiens
  misc_feature: GZ8MTXP02I90M7.22.14.B03.1.454.CMB.2.raw
  modified_base (308)..(308): a, c, t, g, unknown or other
  modified_base (317)..(317): a, c, t, g, unknown or other
  modified_base (388)..(388): a, c, t, g, unknown or other
  modified_base (421)..(421): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggacgggccaccatcaactgacaagtccagccagtagttatttttacagtctaccacaataagagttactagcttggttccagcaagaaccaggacatcgtcctgcactgctntatttacgngggtccgtacgtacccgggaacgtcccggggtccctagaccgtcgtattcgagtcggcgaggtccggggtntagggactagtacttcacgtctaccacgtaccncgacgcgacgtcgacgacgagtacgaggaagttgtacggtaggtacttttaagtttacgttacgttacgtacgtaagttaacttaatttaactttacttaaccttcccgtaacgtacggtaaccggttaccggtacccgggtaaacggtaaaccgggtaacgtaaacgggttaacgtaaaaccgtaaccggtaaaacgtacgttacgggtacgtccgtacgaaccgtaaccg

SEQ ID NO: 379444 - DNA, 608 bp, Homo sapiens
  misc_feature: GZ8MTXP02GC3H4.22.14.B03.1.454.CMB.2.raw
  modified_base (321)..(321): a, c, t, g, unknown or other
  modified_base (433)..(433): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggacgggccaccatcaactgacaagtccagccagtagttatttttacagtctccaaccaaataagtattactagtcttggttccagacaagaaaccaggacatccgtctgcactgctctattacgngggccgtccgtaccgggaacgtcccggggtccctaggaccccgtatccgaggtcggcgacggtcgggtcgtgggacgtaagttactttacaccttcgtaccaacctataccncgactaggacccctggccgtaaggccgttaaggaaagtagtgggtaggaccttaaagggttttatttagttacgactaacgataaatttacttaataccttcctctagacgtacgtcggaccgtaaacgggacgaaggtaacgaatacgaaagtactcggacgctacgcaactcg

SEQ ID NO: 379445 - DNA, 682 bp, Homo sapiens
  misc_feature: GZ8MTXP02FZ34K.22.14.B03.1.454.CMB.2.raw
  modified_base (318)..(318): a, c, t, g, unknown or other
  modified_base (372)..(372): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagtagttatttttacagctaccacctaataagtagttacttagtcttcggttccagacaagaaaccaggacatcgtctgcactgctctattacgngggtccgtccgtaacccgggacgtcccggggtcctcggaccctatcgagtggcnggcgggtcgtgggactagtacttccactctcacccgatccagtcagtccctagccgaggctagaaacgtgttagtcggtacttaagttttaagttagttaggtacaacggtataaaatttactttaacttaaccgtttcccctaccgttaccgtaaacgggtttcccgggtttaaccggggaaacccggtaaaacgggggtaaacccggtaaaaggggttaaaacggtaaacggtttaaacccggaaaaacggttaaccgggttaggggtaaccggggtaccctttacggacccctaaccggtttaaccg

SEQ ID NO: 379446 - DNA, 602 bp, Homo sapiens
  misc_feature: GZ8MTXP02I40QP.22.14.B03.1.454.CMB.2.raw
  modified_base (312)..(312): a, c, t, g, unknown or other
  modified_base (447)..(447): a, c, t, g, unknown or other
  modified_base (452)..(452): a, c, t, g, unknown or other
  modified_base (495)..(495): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagacctccctggctgtgtctcgtgggcgagacgggccaccatcaactgacaacgtccagccagtagttatttttacagtcctaccaactaaataagtagttatagtcttcgtaccagacaacgaaaccgaggactatccgtccngccactgactctactttacgcggggtccttacccgtaccccggggtaacgttccccggggtaccctggaaccccgtacgttcgagtcggcagggtccgggtgtcggactgtacgttccactcgtcactatcgacncgacncgtacgccgagtcgtagaagtgtagtcgttatgtttttaagtntaggtacagtataattacttaatcccttcactcgtacgtacggtacgaccggaaaggaccgtaaggacgtaactacgaaaacgtgtacggcgactcgaccgtacttg

SEQ ID NO: 379447 - DNA, 685 bp, Homo sapiens
  misc_feature: GZ8MTXP02HDGDW.22.14.B03.1.454.CMB.2.raw
  modified_base (676)..(676): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggactattgtgatgacccagtctccagacctccctggctgtgtctcgtgggcgaggagggcccaccatcaactgacaagtccagacctagtagttatttttacagtactacccaaccaataagtagttactagtcgttgtccagacaacgaaaccgacggactactcgtaccgtcgactacgtcgctactacgtttacgtcggggtccgttacccggtaaccccggggtaaccggttccccggggtacccgtacggtaacccccgtacgttacgacggtacggcgtacggtccggggttacggtacggggtaacgtacggttacctttaccaaccgtcctaaccacccgtagtaccaacggcacgtcccgtaggaccgtaggcaaggaagtcgtagggtacggttatagtttttaatcgttacgtacgagtataattaccttattcttaccgtacgtacgtacggaccggttacgacgaaacgggtaaactcgggtaaaactaacgaccgtaaagtacgtcgtacggctacncgtaactcg

SEQ ID NO: 379448 - DNA, 702 bp, Homo sapiens
  misc_feature: GZ8MTXP02HURQD.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacgggacattgtgatgacccagtctccagactccctggctgtgtctctgggcgagacgggccaccatcaactgcaagtccaagccagtagttattttttacagctaccaacaataagagttacttagcttggtccagcaagaaccaggacatcgtcctgcactgtactctaacttttacgtcggggtaccgtaccggtaaccccgggaacgttccccggggtccctcggaccccgtagttccgaggtggcgacgggtcgggtccgtaggggtacacggtactttaccgactcctacccgaacccacttaccgagaccacgggtccctagggccgaggcctaaggaatacgtggttacgggactttaagtttttaagtcgtttaggaccctagacttaaatttactttaacttacgtttcccctacttacgacggttaaccgggtttccgggaaaccgtaaaaccgggggttaaacccgaaagggggttaaaacgaaaaaccgttacggaaaaaacccggttagtacggttacggggactttccggaaccttaacccgtttaag

SEQ ID NO: 379449 - DNA, 685 bp, Homo sapiens
  misc_feature: GZ8MTXP02HKFPF.22.14.B03.1.454.CMB.2.raw
  modified_base (248)..(248): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggactattgtgatgacccagtctccagacctccctggctgtgtctcgtgggcgagacgggcccaccatacaactgacaacgtccagccagtagttatttttacngtcctaccaacaaataagtagttactagtcttgtaccagacaagaacagacatcgctgccactcaccctattacgtcgggtaccgtaccgtacccggggtaacgtccccggggtccctacggaaccgtcttaccgaggtcggcgacgggtccggggttcgtcgggggaactacgtactttccaaccttcaccacccatccgaacgccaacgtcccgtgaccgaggaccgtagaaacgtagtggttacggtactttaggttttaatttagttcgttacgaagtaacttaaatttaatttacttactttaccctacccttacggtaacggttaccggttacccggaaacccggaaaacgggaaacccggttaaaacgggtaaggaaaaccttaaacggaaaaccgtaagttcggacggtactacgaccgtacctactcg

SEQ ID NO: 379450 - DNA, 625 bp, Homo sapiens
  misc_feature: GZ8MTXP02JN5FE.22.14.B03.1.454.CMB.2.raw
  modified_base (280)..(280): a, c, t, g, unknown or other
  modified_base (343)..(343): a, c, t, g, unknown or other
  modified_base (364)..(364): a, c, t, g, unknown or other
  modified_base (376)..(376): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagaggccacatcaactgcaagtccagccagagttatttttacagcctccaccaataagagttactagcttggtccagtcagaaaccnggacatcgtctgcactgctctattactgggcgtcctaccggaacgtccgggtcctgacccgtntcgagtggcaggcgtcgtganagtctacgctcncacctgtcacgcacgtccgacgaccgagtacgagaagtggttggaccgtagtttaacggttttaactttagttacgggtaacctaaggtaacctttaaactttatttaaaccgtttcccttacctttacccgaacgtttaacggttaaccgggttaccggaaccggtaaacgggtaaccgtaaagggtaacgtaaaacgttacgaaaacccgtgtaacggggttcaacgtttacggaccgacgtttacc

SEQ ID NO: 379451 - DNA, 590 bp, Homo sapiens
  misc_feature: GZ8MTXP02JR5BD.22.14.B03.1.454.CMB.2.raw
  modified_base (302)..(302): a, c, t, g, unknown or other
  modified_base (320)..(320): a, c, t, g, unknown or other
  modified_base (420)..(420): a, c, t, g, unknown or other
  modified_base (449)..(449): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggagggccaccatcaactgcaagtccagccagtagttatttttacagtctaccaaccaataagtagttactagtcttggttccagcaagaaaccagactatcgtctncactgctactatttacgngggtcgtccgtaccggacgtcccggggtcctcgaccccgtatcgagtcggcacggtcgggtcgtgggacctagtagttccactctaccactatcagcacnccgtgccgaaggctagaacgtgtgacgtntagttttatagttgtacatattaattattatactttccctactacgtacgttaccggttaccgaaccgggtaaacggtaacgttaagggaaacggtaaactaaccgaaacggtacgtaggtacggctacggacctaccgta

SEQ ID NO: 379452 - DNA, 787 bp, Homo sapiens
  misc_feature: GZ8MTXP02FMLCS.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagacgggccaccatacaactgacagtccagccagtagttatttttacagcctaccaacctaataagtagttacttagtcgttcggttcctacgacaacgtaaaccgacggaactacgtaccgtcctacgctactcgtctctacgtttacgtcgggtccgtaccggtaccccgggtaaccggttcccggggtaccccgtacgtacccccgtacgttacgtacggtcggacgacggtcgggtcggtacggggtaactacgtacgttacctactacctaccacccgtaaagttccgaaacgtccgaaacgttccggacgaccggacgtaccgtaagtaaagtcgggtttaacgggtccggttaacgtttaaacggttttaattttcggtacgtttaaccggaaataccgtttaaaatttaacccttttataaccctttccccttaccgtaacgtaccggggttaccgggtaacccggtaaaccggaaaccggggttaaaccgtaaagggggtttaaaacaacccttaaaacgggtaaaacccgttaaacgggttgggttaccgtaccgttaccggaaaccccttctttaaacccgg

SEQ ID NO: 379453 - DNA, 707 bp, Homo sapiens
  misc_feature: GZ8MTXP02F52QA.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgcaagtccagccagtagttatttttacagtctccaccaataagtattacttagtcttggttccagacaacgaaaccaggaactatcgtcctgcacgtgctctatttacgtcgggtctaccggtaacccgggtaacgtcccggggtccctacggaccccgtattccgagtcggcgtacggtcgggtcgtgggaactacggtacttccgaacttctaccgaaccctatacccgagtaccgacgtcccgtaggaccgtaggtaccgtaagggaaaagtgtttacgggtaccggtaacgtttaagggtttttataacgttttcgggaacctaagtaaccttaaagtttaactttaacgttaacttcccccttaacgtacgtaacggttacccggtttacggggaaccccgtaaaagggggtaacccctaaaaggggttaacgaaaattaaccggaaaacggtaaccgttggtacgacgtttacgaacctacgtttaccg

SEQ ID NO: 379454 - DNA, 641 bp, Homo sapiens
  misc_feature: GZ8MTXP02GB6B7.22.14.B03.1.454.CMB.2.raw
  modified_base (306)..(306): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgtcgctctggatctctggtgcctacggggacattgtgatgacccagtctccagactccctggctgtgtctctgggcgagagggccaccatcaactgcaagtccagccagtagttatttttacagctaccacaataagattactagcttggtcagcagaaccagacatcgtcctgcactgctctattacgngggtcctccgtacccgggtaacgtcccggggtccctcgacccccgtattccgaggtcggcgtacggtcggggtctcggggactaggtactttccactctacaccatccgagctagccctgaccgaggtactaggaaagtgttagggtccggtaagttaggttttaattagttacgggttaccaaggtacctaaaattactttaaacgttaactttccctaccctttaacgaacggttaccgggttaccggaccgtaaacgggggaacctaaaggggttaacggaaaacttaccgaaaacggtaacgtcgggtacggtacctacggacctaactcg

SEQ ID NO: 379455 - DNA, 817 bp, Homo sapiens
  misc_feature: GZ8MTXP02GF8PP.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatcgaccagtctccagacctccctggctgtgtctcgtgggcgaggacggccaccatcaactgacaacgtccagccaagtagttactttttacagtcctaccaacctaataagtagttactacgtcgttcggtaccagacaacgaaaccaggacactccgtcctgctactgtacctactagtttacggtcgggtaccgtccggtaaccccgggtacgtccccggggtaccctacggaccccgtagttccgtagggtcggacgacgggtcggggtccggtacgggaacgtacgttacttccaaccgttcgtaacccacgtaacttcgaacgtacccgacgtcccgttaggaccgtacggtaccgtaggaacgtaagttcgggtaaccgtaacttttaaagtttagttaacgttacgggttaaccaaagtttaaacccttaaatttaacgtttaaacgtacccgttttacccctacccgttaacgttaaaccggggtacccggttttaaacccgggggaaaacccggttaaaacgggggtaaccccggttaaaacgggggttaaaacccggtaaaaaactttaacccggggaaaaaaaccggttaaccggtttacgggaacggggttaccctttaaccggggaaacccttaaccccgggtttaaacg

SEQ ID NO: 379456 - DNA, 728 bp, Homo sapiens
  misc_feature: GZ8MTXP02GWVUD.22.14.B03.1.454.CMB.2.raw
  modified_base (331)..(331): a, c, t, g, unknown or other
  modified_base (386)..(386): a, c, t, g, unknown or other
  modified_base (441)..(441): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggacgggccaccatcaactgcaacgtccagccaagtagttatttttacagtcctccaaccaaataaagagtttaacttacgtcttggttccagacaagaaaccgaggacatcgtcctgcactgctactatttacgngggtccgtaccgtacccgggaacgttcccggggtcctcgaccccgtattaccggnggtcggcgcggcgggtcggtacgggactacgttacttccactcctaccaaccgtntaccgacgccgacgtcccgtacgaccggtacggtacgtaaaggacgttggttaccgggttacggttaacgtttaaggtttttaagttggtttacgtaaccgtaagttaacttaaagtttactttaacttaccctttacccgtcgttaaccggttaaccggttacccgggttaaccggaaacccgggtaaaacggggttaaaccggtaaacggggtaaaaccgtaaaaccgtaacgtaaaaccggtacgttacgggtaccgtaccgtaccgtacccgttaacgttacg

SEQ ID NO: 379457 - DNA, 622 bp, Homo sapiens
  misc_feature: GZ8MTXP02JN04A.22.14.B03.1.454.CMB.2.raw
  modified_base (325)..(325): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggagggccaccatcaactgacaagtccagccaagtagttatttttacagtcctaccaacctaataagtagttactagtcttggtccagacaacgaaaccaggacatcgtcctgcactgctactattacgngggtccgtaccgtaacccgggaacgtcccggggtccctggtaccccgtagttcgaggtcggcgaggtcgggtcgtagggactaggtattcgaactcctacaccatccgagcacggccctaggaccacggtacgtagaaagtgtggtacggtacttaggtttaacttagttcgtaccgtaagtaactaattattacttacttcctactacgtacgtaccggttacgaccggaaaacgggaccgtaagggtaacggtaaactacgaaaacgtacgtagtacggctacgacctaccctag

SEQ ID NO: 379458 - DNA, 599 bp, Homo sapiens
  misc_feature: GZ8MTXP02FKN67.22.14.B03.1.454.CMB.2.raw
  modified_base (322)..(322): a, c, t, g, unknown or other
  modified_base (449)..(449): a, c, t, g, unknown or other
  modified_base (459)..(459): a, c, t, g, unknown or other
  modified_base (486)..(486): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggacggccaccatcaaactgacaagtccagcctaagtagttaatttttacagtctaccaacaaataagtagttactagtcttgtcagcaagaaacaggactatccgtctgcactgctactattacgngggtcgtaccgtacccgggtaacgtcccggggtcctacgacccgtatcagttcggacacggtcgggtggtagggactaagtactttacacttctaccaactatccagaccacgcccgtgccacgggntaggaaagtntcggtagattaagtttatagttgtaanaacgtattaaattattactaccttctactagtaacggtacgtacgaaccgtaaaggacgtaaaggtaacgtaaaactaacgaaacgtaagtcgtacgtacacgacctactacg

SEQ ID NO: 379459 - DNA, 650 bp, Homo sapiens
  misc_feature: GZ8MTXP02H7HIL.22.14.B03.1.454.CMB.2.raw
  modified_base (445)..(445): a, c, t, g, unknown or other
  modified_base (497)..(497): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgacaagtccagccagagttatttttacagctaccaaccaataagattacttagcttggtccagcacgaaaccaggacactcgtcctgacacctgcctactattttacgtcggggtccgttcgtaaccccggggaagttccccggggtccctagaccccgtattcgaggtcggacgcggcgggtcgtggggactaggtacttcacgtctcaccatcacgcagccctagccgagnacgagatggtggtacttaggttttattattacgtcgtaagtactaaagtttnttaacttacttcccctacgttaccgtaaacggttccgggtttaaccggccggtaaaaacggggtaccccgttaaaaggggtaacccggtaaaacttaaacccggaaaaacggttccgtagggttaacgccgttaacggacctaaccgttaacg

SEQ ID NO: 379460 - DNA, 686 bp, Homo sapiens
  misc_feature: GZ8MTXP02G70VW.22.14.B03.1.454.CMB.2.raw
  modified_base (411)..(411): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagacctcccgtggctgtgtctcgtgggcgaggcgggccaccataccaactcgacaacgtccacgccagtagtttatttttacgacgcctaccaacctaataagtacgtttaacttagtcttggttaccagacaaacgtaaaccgaggacctactccgtcctagcctactcgtacttcctagtttacgccggggtccgtacccggtacccgggtacgttcccggggtcccctaggtaccccgtntacgaggtcggacgacgggtcgggtcgtagggtacacggttacttcctacgtcctaccgtaaccctacgtaccgcgtaccacgccgtagccgaagtcgtaaagagtgtcggtaggttacttagttttactagtttcggaactaacgtattaaattcgtttaaattccttaccctactacgtacgttaccgggtaccgaacggttaaacgggaaccgtaaaggggtaactaacgttaaacccgaaaggtcgtaggtaccggctactacgtaactcg

SEQ ID NO: 379461 - DNA, 738 bp, Homo sapiens
  misc_feature: GZ8MTXP02FKNFF.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatcgacccagtctccagacctccctgtctgtgtctcgtgggcgagagggccaccatcaactgcaagtccagccagtagttatttttacagtctaccacaaataagtattactagtcttggtccagacaacgaaaccaggactaactccgtcctagactactgtacctacttaactttaacggtcggggtccgttacccggtaaaccccggggtaaaccgttccccggggtacccctaggacccccgttacttacgacggtcgggccgaacgggtcggggttcggtggggaactaggttaccttactaacttcctaccaaccctagtacccgagtcccgaacggtcccgtacgacggaacccggtacgtaggaaaacggttagttcgggtagtaacgtttaggttttaatttaggtttacggttacaaacgtaattaaatttactttaactaaccgtttccccctcgttaacggtaacgttaccgggtttcgggaaacccgtaaacgggaaacctaaggggtaaacgaaacttaaaccgaaaacgttaccggtagtcgggtacttacggacccgtaacttaaccgg

SEQ ID NO: 379462 - DNA, 617 bp, Homo sapiens
  misc_feature: GZ8MTXP02IARW4.22.14.B03.1.454.CMB.2.raw
  modified_base (298)..(298): a, c, t, g, unknown or other
  modified_base (360)..(360): a, c, t, g, unknown or other
  modified_base (397)..(397): a, c, t, g, unknown or other
  modified_base (415)..(415): a, c, t, g, unknown or other
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctgggcgagaggccaccatcaactgcaagtcagccagatatttttacacgtctaccaactaaataagtacgttatatcgttcgtacacgacaacgaacacgacacgtcaccgngtcactgtctactattacgtggccgtacgaccgtacgtccggctcgaccgtacgtacaggtnacgacggcggtcgacgtacgagttactacctacttcnccaacctagaacacgacncgacgtgacgagacgaagtagacgtgtacgtagttagttaagtttagtacgtatagtaacgtaaacttaacttaacttacttaccgttaccgtaacgtacggtaccggttaccggtaaaccggtaaacggtaaacgtaaacggtaaacgtaaacgtaaacgtaaacgtaacgtaacgtacgtacgtacgtacgtaacgtacg

SEQ ID NO: 379463 - DNA, 715 bp, Homo sapiens
  misc_feature: GZ8MTXP02IX1BA.22.14.B03.1.454.CMB.2.raw
  modified_base (295)..(295): a, c, t, g, unknown or other
  modified_base (312)..(312): a, c, t, g, unknown or other
  modified_base (351)..(351): a, c, t, g, unknown or other
  modified_base (356)..(356): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgcaagtccagccagagttatttttacagctaccaccaataagagttactagcgttggtccagacagaaaccaggacatcgtcngcactgctctattacgnggtctacgtaccggaacgtcccgggtcctacgacccgtntacgngtcgcgacggtcgggtcgtacgggataacgttacttacgtactacctaccaaacctacgtaccgacgaccgtaaccgtccctaggaccgaacgggtacgttaacggaaaggttcgttaggggtaggtaccgtttaaaggtttttattaaacgttttcgggaccgtaaaggtaccttaaaaaggtttactttaacgtttaaaccctttcccctaacccgttacgtaaaccggtttaccgggttaaccccggaaccgggtaaaaaccggggtaaaccgtaaggggtaaaacgggttaaaaccaaaccgtaaaaacccggtaagttaccggggtacggacttaccggaaccgtaacccttag

SEQ ID NO: 379464 - DNA, 644 bp, Homo sapiens
  misc_feature: GZ8MTXP02IX235.22.14.B03.1.454.CMB.2.raw
  modified_base (443)..(443): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagaggccaccatcaactgcaagtccagccagagttatttttacagtcctaccacctaataacgagtttactagtcttggttccagtcaagaaacctaggaccatcgtacctggccactgctctactttacgtcgggtccttacgtaaccccggggaacttccccgggggtccctagaacccccgtagttccgaggtcggacacggtccgggtcgtaggggaacctagtactttcaacgtctacacccgntccagcagccctagccgaggctagaaagacttggcggtaccttagttttacttaagttggtaaccaggtcaaaagttctttaataactttcccaacttcgtaaacgtcggtttaccggaacgtaaacggggtaccctaagggtacgaaaactacgaaaaccgtaacgtcggttacgccgttacgacccgttaaacgttccg

SEQ ID NO: 379465 - DNA, 588 bp, Homo sapiens
  misc_feature: GZ8MTXP02IGNIR.22.14.B03.1.454.CMB.2.raw
  modified_base (225)..(225): a, c, t, g, unknown or other
  modified_base (271)..(271): a, c, t, g, unknown or other
  modified_base (396)..(396): a, c, t, g, unknown or other
  modified_base (398)..(398): a, c, t, g, unknown or other
  modified_base (408)..(408): a, c, t, g, unknown or other
  modified_base (424)..(424): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtggcgagaggccaccatcaactgcaagtccagccagngttattttacagctccacaataagagttactagcttgtccagcaanaaacaggacatcgtactgcactgctctattacgtgggctacgtaccggaacgtccggggtacctgacccgtattcacgtcggtacaggcgggtctcgggaacagtactttcactctacgaaaccncncacgcagtcngacaggtcgagaagtntggtacggtattaagtttactagtagtacgaagtaactaaatttacgtaacttacgttccctaccgtacgtaacgtaccgttaccggaaaccgaaacggacgtaaacggtaacgtaaaacctaaacgaaaacgtacgtacggtacgacgtccgaacctaccacg

SEQ ID NO: 379466 - DNA, 698 bp, Homo sapiens
  misc_feature: GZ8MTXP02GSRL2.22.14.B03.1.454.CMB.2.raw
  modified_base (497)..(497): a, c, t, g, unknown or other
  modified_base (549)..(549): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacgggacattgtgatcgacccagtctcagacctcctggctgtgtctcgtgggcgaggacggccaccgatcaactgacaacgtccagaccagtattacttttacatcctccaaccaaataagtacgttattatcgttcggttaccagacctaagaaaccgtggaactcgtacgtcctgactactcgccttgtaacgtttcggtcgggtaccttaccggtaacccgggtaacgttccccggggtacctcggaacccgtactttccgaaggttcggacggtacggtccgggttcggtacggggtacctaaaggttcctttaccggaccttacctaccgtaccataccggtacgaccgacnccgtgccggagtctagtaagcgttaggcgtacttagtttagttactacggtnaaaccgtattaaattacttaaacgttcttccccgtgtaacgtacggttacccggttcgggaaacccgtaaaggggtaacccaaagggggtaaaacttaaccgaacgaaaacgttaccgaggttacggaccggtactaaccacgtttccg

SEQ ID NO: 379467 - DNA, 787 bp, Homo sapiens
  misc_feature: GZ8MTXP02JC2A2.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatcgacccagtctccagactccctggctgtgtctcgtgggcgaggacgggccaccatcaactgacaagtccagccagtacgttattttacagtcctaccaacctaaagtaagtacgttacttagtacgttggttaccagacaacgaaaccgaggactacgtccgtacctgacctacgtcgtactacgtagttttaccggcgggtaccgttaccgtaccccggggtaaacgttccccggggtaccctacggtaacccccgtacgtttaccgaacgggtccggacgtacggggtcggggttccggttacggggaaaccgtaacggttaacctttccgtaaacccgtttcccaccgtaaccctagtaacccgacgtaccgaacgtccgtacgaccgcggggtaccttagggaaacgtggttcgggtcgggttaaactttaaacgtttttgttaacgtttacgtcgtaaagtcttaaaacgtttacttaacttaaccctttcctaaacccgtagttaccgggttaaccggttaccggaaaacccgggttaaaacggaccggtaaaacggggttaaaccaaacggtaaccgtaaaaccggtacgttaaggtccggactacggtaaccctacgttaacg

SEQ ID NO: 379468 - DNA, 669 bp, Homo sapiens
  misc_feature: GZ8MTXP02JYGHO.22.14.B03.1.454.CMB.2.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagacctccctggctgtgtctcgtgggcgagacggccaccatcaactgacaacgtccagaccagtacgttatttttacagtcctaccaaccaataagtattacttagtcttggttaccacgacaacgaaaccgaggactactccgtcctgctactcgctactagttccgtgggtccgtaccgtacccgggaacgtccccggggtcctacggtaccccgtagtacgaggtcggacgacgggtcgggtcgtacgggactagtacgtttccacgttcctaccaacctactacgaacggtcaaccggtccctaggacccgaaggtccgtaaaggtacgtagtcgggtggtactttaaggttcctagttccgtatacgtattaaactatttactcttacctacccgtaagtacggtacggttaccgacgggtaaaacggcgtaaacgggtaaacgtaaaccaacggtaaaacgtccggttggaccgtactaccggacttaaccgttcg

SEQ ID NO: 379469 - DNA, 536 bp, Homo sapiens
  misc_feature: GZ8MTXP02JV63C.22.14.B03.1.454.CMB.2.raw
  modified_base (369)..(369): a, c, t, g, unknown or other
  modified_base (513)..(513): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttactagcttggtccagcagaaaccaggacatcgtcctgcactgctcatttactgggcgtcgtacccgggaacttccggggtccctgaccccgtattccgagtggcagcgggtcngggacagtatttcactctcaccatcagcagcctgcgaggctagacgatcggtgctagtttatacgttgtcagctaattattatattcctctgacgtacgttcggacccaaggaccaaggtacggtaaactacgaaaacgtaacnggttacgcgtacgaccacctacg

SEQ ID NO: 379470 - DNA, 589 bp, Homo sapiens
  misc_feature: GZ8MTXP02FMTQX.22.14.B03.1.454.CMB.2.raw
  modified_base (319)..(319): a, c, t, g, unknown or other
  modified_base (478)..(478): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagacctcctggctgtgtctcgtgggcgagagggccaccatcaactgcaagtccagccagtagttatttttacagctacccaaccaaataaagtattacttagtcttggtccagacaagaaaccagacatcgtcctgcactgctctattacgngggtccgtccgtacccggaagtcccgggtccctgaccccgattcagtggcaggtcgggtctgggacagtacttccactctaccaccatcagcacgcctagcaggtctaggaacagtggcggtacttaagttttattagttcgtagaactataaaagttnttaacgtatttcccctacgtactaacggtccggttaccggaccgtaaaaggggaacctaagggtaacgaaactaacggaaaaccgtagtacgcggctagaccctaacgtac

SEQ ID NO: 379471 - DNA, 575 bp, Homo sapiens
  misc_feature: GZ8MTXP02FR4A1.22.14.B03.1.454.CMB.2.raw
  modified_base (310)..(310): a, c, t, g, unknown or other
  modified_base (407)..(407): a, c, t, g, unknown or other
  modified_base (431)..(431): a, c, t, g, unknown or other
  modified_base (463)..(463): a, c, t, g, unknown or other
  modified_base (495)..(495): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacgggacattgtgatgaccagtctccagactccctgctgtgtctctggcgagagggccaccatcaactgcaagtccagccagatatttttacagctaccaaccaataagattacttagcttggttccagcaagaaaccaggacaatcgtacctgcactgctcactttacgnggcgtccgtaacccgggaacgtccggggtccctgaccccgtattcgagtcgcaggacgggtctgggacagtactttcaactcgtcaccagtcagcanccgtagcgtaaggctcgaaaagtntgggacggtattaggttttattaagttcgtanaagacaattactttatacgtttccaccgttanacgtacgttcggacccaaaagggccaaaggttacggaacttaacggaaaacgaacttggaccgactacggaccaccgtaa

SEQ ID NO: 379472 - DNA, 769 bp, Homo sapiens
  misc_feature: GZ8MTXP02H8AIZ.22.14.B03.1.454.CMB.2.raw
  modified_base (491)..(491): a, c, t, g, unknown or other
  modified_base (536)..(536): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagactccctggctgtgtctcgtgggcgaggacggccaccatacaactgacaacgtccagccagtagtttacttttacgacgtcctaccaacctaaagtaagtagtttaactagtcgttcggttaccagtacaaacgtaaaccgaggaacctacgttccgtacctacgcctactcgtaccttacgttaacgtttaccgtcggggtccgttaccggtacccgggtaacgttccccggggtacctacggacccgtagttccgaggtacggcgtaggtcgggtcgtacggggaactaggtttactttccgactcctaccaaccgtanaccgaacgccgtacgccgttacgaccggtacgtcgtaaggtagtnttaagggttccgttaattaagtttttgttaaaccgttggtaacaacgttaacttaatttatttaacgtttaccttaccttaccgttaacgacgggtttacccggtttaccgggaaaacccggttaaaacggggaacccgtttaaaggggaaacccgtttaaaagaaacccgggttaaaaccggttacggtaacggttccgggtacctaaccggtaacctttaccggtttaccc

SEQ ID NO: 379473 - DNA, 687 bp, Homo sapiens
  misc_feature: GZ8MTXP02GWGAD.22.14.B03.1.454.CMB.2.raw
  modified_base (194)..(194): a, c, t, g, unknown or other
  modified_base (567)..(567): a, c, t, g, unknown or other
tcagacatacgcgtcacgaccggtgctcgatttagtgtgagtagttccgcgggggagctacaacaggcaggcaggggcagcaagatggtgttgcagacccaggtcttctatttctctgttgctctggatctctggtgcctagggacattgtgatgacccagtctccagactccctggctgtgtctctggcgagngggccacatcaactgcaagtcccaagccaagtagttatttttaacagactccaaccaataagagttataggtcttggtccagacagaaaccaggaacatcgtacctgctaactgaccttctaacgtttaagcggggtccggtacgttaacccccggggaaacgttaccccgggggtaccccttcggaaacccgttaccgtttcaaacgggttcgggacgtaaccggcggggttccgttaggggaaccgtagacgttttaccgacttacctaccctacccgattacacgccaggtcccttggaccaaggttccgaggaaagtaccgtaggtaccgggcttaaggttttaattaccgtttagggcaaaccggtanaaatttattaaaccgtcttaccctcgttacaacggtaccgttcggactaaacggggaacctaacgggtagaaagtaccctaaaaggaacctttggacgtcgtacgacccaacggttaacc

SEQ ID NO: 379474 - DNA, 758 bp, Homo sapiens
  misc_feature: GZ8MTXP02JZUTC.22.14.B03.1.454.CMB.2.raw
  modified_base (588)..(588): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacgggggactattgtgatcgaccagtctccagacctccctggctgtgtctcgtgggcgagacgggccaccatacaactgacaacgtccagccagtagttactttttacagtctaccaccaataagtagttacttagtacgttcggttaccagactaacgaaaccagggtaaccacgttcggtacctcgacgactcgctactaactttacgtcgggacgtttccggtaaacccgggaaccgttccccggggtcctacggtaaccccggtacttacgtacgggtacgaccgaggtccggggtttccggacgggaccgtaaggttaaccttcggaaccttcctactaaaccccgtagttaccgacgttacccggacgtacccttcggacccggtaggtcgtaacggtaagtacgtcggggtaagtaccgttaggtttaattgttacggttanacgttacgaaaattcgtttaactagtttacccttacgtacctaacgggttacggttaccccggaaaacgaccggggttaaataaaccggggtaacgtaaaacccgttaacggtaaacccgtaaaggttccggtacggggttaacctcgggttaacgtaaacctttcccgg

SEQ ID NO: 379475 - DNA, 733 bp, Homo sapiens
  misc_feature: GZ8MTXP02GLYH2.22.14.B03.1.454.CMB.2.raw
  modified_base (183)..(183): a, c, t, g, unknown or other
  modified_base (277)..(277): a, c, t, g, unknown or other
  modified_base (298)..(298): a, c, t, g, unknown or other
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtntctcgtgggcgaggagggcccaccatacaactgacaagtccagccagtagttatttttacagtctccaacaataagtattactagcttgtccancaagaaccaggacatcgtccngcactagctatatttacgcggggtccgtaccgtaacccgggaacgtcccggggtcctacgaccccgtagttccgaggtcggcgacggtcgggtccggtggacagtacttaccaactcctaccaacgactacgagccaacgtcccgttacggaccgtaagggtaccggttaaggaaaacgtcggttagggttaccggggtacttttaaagggtttttaacctttagtttagggtaccgtaaacgttaactaaaacgtttttaacttaagtttaacccttttaccccggttccttaacccgtaaaagggtacccggtttttaacccgggaaaccggtaaaaccgggtaaccggtaaaagggtaaacgggtaaaacttaaaaccccgaaaaggtaccttaggggtaccggtaccgtttaaacgaccgtaaccgtaacg

SEQ ID NO: 379476 - DNA, 538 bp, Homo sapiens
  misc_feature: GZ8MTXP01D29AO.45.73.G07.1.454.CMB.2.raw
  modified_base (325)..(325): a, c, t, g, unknown or other
  modified_base (519)..(519): a, c, t, g, unknown or other
tcagacgcgatcgacacgaccggtgctcgatttagctctacgctcagggggagtcagaccctgtcaggacacagcatggacatgagggtccccgctcagctcctggggctcctgctgctctggctcccaggtgccggatgtgccatcctgatgacccagtctccatcctcactctctgcatctataggagacagggtcaccgtcacttgtcgggcgagtcaggattattaggtaaattttttagcctggtatcagcagagaccagggacacgcccctaggcttcttgtatttattctgcgtctctgttcaagttggattctcctnaagtacttcagcggcagcggctcgtgggacactatttcactctacaccatcgacagcctgaccacgacccgaagtacttaggaaacgttactactggtacagtacaatatacgtaaatcgtaccggtggtacgttcggccgtagggggtaaccaagggttggtaacgttacgaaacggtacttggttgctgacncctatcttgttccttctcc

SEQ ID NO: 379477 - DNA, 494 bp, Homo sapiens
  misc_feature: GZ8MTXP01C1P6Q.45.73.G07.1.454.CMB.2.raw
  modified_base (313)..(313): a, c, t, g, unknown or other
  modified_base (471)..(471): a, c, t, g, unknown or other
  modified_base (490)..(490): a, c, t, g, unknown or other
tcagacgcgatcgacacgaccggtgctcgatttagctctacgctcagggggagtcagaccctgtcaggacacagcatggacatgagggtccccgctcagctcctggggctcctgctgctctggctcccaggtgccggatgtgccatcctgatgacccagtctccatcctcactctctgcatctataggagacagggtcacgtcacttgcgggcagtcaggatattggtaaatttttgcctggtatcagcagagaccagggacagcccctaggctcttgatttatctgcgtctctgttcaagttggagtctctnaagtcttcagcggcagcggctcgtgggacactattcactctcacatcgacagcctgcacgcccgaagtactttgaacgtactactggtcagacaatatacgtaaatgtccgtggtacgttcggcaggggtccaagggttgtagttcgaaacgcttggngctgcaacatcttgtcttntaac

SEQ ID NO: 379478 - DNA, 597 bp, Homo sapiens
  misc_feature: GZ8MTXP01A8TFN.45.73.G07.1.454.CMB.2.raw
tcagacgcgatcgacacgaccggtgctcgatttagctctacgctcagggggagtcagaccctgtcaggacacagcatggacatgagggtccccgctcagctcctggggctcctgctgctctggctcccaggtgccggatgtgccatcctgatgacccagtctccatcctcactctctgcatctataggagacagggtcaccgtcacgttggtcgggcgagtcaaggtattagttaggtaaattttttgcttggtatcagcagagaccgagggacacgcccctaggcttcttgtattttattctgtcgttcctcttgttactaaggtttggagttctcctacaagtacttcgaggcggacacggccgggtctcgtagggacctactactttccactctaccacctagtcgacgagccctgaccacgacccgtaagtacgtttaggaaccttactacgtggtacagactaatatacgtaaatcgtccggtggtaccgttcggccgtaggggtaaccaaggggttcggtaagttaccgaaacggtacgttgggttcgacgttgaccgtaaccctcgttccgttacgttccttaacgtccg

SEQ ID NO: 379479 - DNA, 531 bp, Homo sapiens
  misc_feature: GZ8MTXP01AN0AK.45.73.G07.1.454.CMB.2.raw
tcagacgcgatcgacacgaccggtgctcgatttagctctacgctcagggggagtcagaccctgtcaggacacagcatggacatgagggtccccgctcagctcctggggctcctgctgctctggctcccaggtgccggatgtgccatcctgatgacccagtctccatcctcactctctgcatctataggagacagggtcaccgtcacttgtcgggcgagtcaggatattggtaaatttttgcctggtatcagcagagaccgagggacatcccctaggcttcttgtatttatctgcgttcctctgttcaagttggatctcctcaagtcttcagcggcaggcggctcgtgggactactactttcactctccaccatcgacacgcctgcagcccgaagtcttaggaactactactggtacagcaagtactacgtaaatcgtccggtggtaccgttcggccgtaggggtccaagggttggtacgttacgaaacggtacttggttcggcttgcaacgtactcttcgtcttcgtaacc

SEQ ID NO: 379480 - DNA, 578 bp, Homo sapiens
  misc_feature: GZ8MTXP01DWWIW.45.73.G07.1.454.CMB.2.raw
  modified_base (342)..(342): a, c, t, g, unknown or other
tcagacgcgatcgacacgaccggtgctcgatttagctctacgctcagggggagtcagaccctgtcaggacacagcatggacatgagggtccccgctcagctcctggggctcctgctgctctggctcccaggtgccggatgtgccatcctgatgacccagtctccatcctcactctctgcatctataggagacgagggtccaccgtcacgttggtcgggcgagtcaggtattagttaggtaaattttttagctggtatcagcagagaccagggacacgcccctaggctcttgtatttattctcgtcgttcctcttgtttactaaggtttggagttcctcctanaagtacttcgaggccggcaggccggctcgtgggactactactttcactctacacctatcgacacgcctgactacgacccgtaagtacgttaggaacttactactggtacagactaatatacgtaaatcgtaccggtggtaccgttcggaccggtaggggtaaccaagggttggaacgtttacgaaacggtaacgttggcggttcgtcgacaacctatcgttacttcgttctaaccg

SEQ ID NO: 379481 - DNA, 576 bp, Homo sapiens
  misc_feature: GZ8MTXP01EPRR8.45.73.G07.1.454.CMB.2.raw
  modified_base (560)..(560): a, c, t, g, unknown or other
tcagacgcgatcgacacgaccggtgctcgatttagctctacgctcagggggagtcagaccctgtcaggacacagcatggacatgagggtccccgctcagctcctggggctcctgctgctctggctcccaggtgccggatgtgccatcctgatgacccagtctccatcctcactctctgcatctataggagacgagggtcaccgtcacgttggtcgggcgagtcgaggtattagttaggtaaattttttagcgtggtatcagcagagacgaggacactcccctaggtcttcttgtatttattctgtccgttccttcttgtttacgtaaggttggacgttctcctacaagtacttcgaggcggcgacggccgggctcggtgggacctactactttccactctaccacctatccgacacgtcctagaccgacgtacccgaaagtacgtttacggaaacgttactacgtggtacagtactaatactacgtaaatcgtacggtggtacgtcggcgagggtcaaggttggacgttacgaaacgtagttggttcgctcgctaacgtntcttgttccttcgtcc

SEQ ID NO: 379482 - DNA, 644 bp, Homo sapiens
  misc_feature: GZ8MTXP01CUMZG.45.73.G07.1.454.CMB.2.raw
tcagacgcgatcgacacgaccggtgctcgatttagctctacgctcagggggagtcagaccctgtcaggacacagcatggacatgagggtccccgctcagctcctggggctcctgctgctctggctcccaggtgccggatgtgccatcctgatgacccagtctccatcctcactctctgcatctataggagacagggtccaccgtcacgttggtcgggcgagtcaggtattagttaggtaaattttttgctggtatcagcagagaccgaggacacgcccctaggcttcttgtattttatctgtccgttcctcgttgttacgtaaggttggtacgttcctcctacaagtaccttcgaggtcggacacggccgggctcggtacgggaacctacttactttccacttctaccaccataccgacacgcctcgacgacgacccgtaagtacgttaggaaccttactacgtggtacagtactaaattagtaacgtaaagttcgttaccgggtacggtaaccggtttccggaccgggtaacggggtaacccgtaaaggggttacggtaaacgttaccgaaaacggtacgttcgggttcggccttcggaccgtaacccgttaattccggttacgtttcccgttcgttaacccg

SEQ ID NO: 379483 - DNA, 521 bp, Homo sapiens
  misc_feature: GZ8MTXP01AM5LD.45.73.G07.1.454.CMB.2.raw
  modified_base (505)..(505): a, c, t, g, unknown or other
tcagacgcgatcgacacgaccggtgctcgatttagctctacgctcagggggagtcagaccctgtcaggacacagcatggacatgagggtccccgctcagctcctggggctcctgctgctctggctcccaggtgccggatgtgccatcctgatgacccagtctccatcctcactctctgcatctataggagacagggtcaccgtcacttgtcgggcgagtcaggatattggtaaattttttgcctggtatcagcagagaccagggacacgcccctaggctcttgtatttatctgcgtcctctgttcaagttgagtctctcagacttcagcgcagcggctcgtgggacacatttcactctcaccatcgacagcctgcacgcccgaagtactttaggaacgtactacgtggtcagtacaatatacgtaaatcgtccggtaggtacgttcggccgtagggggtccaagggttggacgttacgaaacgtacttggttcgactgcaacctntcttgtcttcgtaacc

SEQ ID NO: 379484 - DNA, 570 bp, Homo sapiens
  misc_feature: GZ8MTXP01B0RNX.45.73.G07.1.454.CMB.2.raw
tcagacgcgatcgacacgaccggtgctcgatttagctctacgctcaggggggagtcagaccctgtcaggacacagcatggacatgagggtccccgctcagctccgtggggctcctgctgctctggctcccaggtgccggatgtgccatcctgatgacccagtctccatcctcactctctgcatctataggagacagggtccaccgtcacgttggtcgggcgagtcaggtattagttaggtaaattttttagcttggtatcagcagagaccgagggacacgcccctaggctcttgtatttattctgcgttcctcttgttactaagttggacgttctcctacaagtcttcgaggcggcaggccggctcgtgggactactactttcacttctcaccatcgacagcctgacacgacccgtaagtacttaggaacttactacgtggtacagtactaatactacgtaaatcgtacggtcggtacgttcggcgtaggggtaaccgtaagggttggtaacgttacgaaacggtacgttggttcggctcgacctaacgtatcgttgtccttcgtaaccg

SEQ ID NO: 379485 - DNA, 550 bp, Homo sapiens
  misc_feature: GZ8MTXP01C7YY3.45.73.G07.1.454.CMB.2.raw
  modified_base (529)..(529): a, c, t, g, unknown or other
tcagacgcgatcgacacgaccggtgctcgatttagctctacgctcagggggagtcagaccctgtcaggacacagcatggacatgagggtccccgctcagctcctggggctcctgctgctctggctcccaggtgccggatgtgccatcctgatgacccagtctccatcctcactctctgcatctataggagacagggtcaccgtcacttggtcgggcgagtcaggtatattaggtaaatttttagcctggtatcagcagagaccagggacacgcccctaggctcttgatttatctgtcgtctctgtttcaagttggagttctcctcaagacttcagcggcaggccggctcgtgggactacgtatttccactctccaccatccgacacgcctgcacggccctaagactttggaacgtatacgtggtcagtactaatatacgtaaatgtaccgtggtaccgttcggccgtagggggtaacctaaaggggttggacgtttacgaaaacgcgttgggttcggcgtcgctaacgnttcttcgttaacttcctaacg

SEQ ID NO: 379486 - DNA, 595 bp, Homo sapiens
  misc_feature: GZ8MTXP01DJ02T.45.73.G07.1.454.CMB.2.raw
  modified_base (305)..(305): a, c, t, g, unknown or other
  modified_base (574)..(574): a, c, t, g, unknown or other
tcagacgcgatcgacacgaccggtgctcgatttagctctacgctcaggggggagtcagaccctgtcaggacacagcatggacatgagggtccccgctcagctcctggggctcctgctgctctggctcccaggtgccggatgtgccatcctgatgacccagtctccatcctcactctctgcatctataggagacagggtcaccgtcacttggcgggcagtcaggtattagttaggtaaattttttgctggtatcagcagagacgagggacacgcccctagcttcttgtatttatctgtccgtcctnttgttactaaggttggacgttcctacctactaagtacttcgaggcggacgacggccgggtctcggtagggactactactttccacttctaccacctatcgacacgcctgacgacgtacccgtaagtaccgttacggaacttactacgtcggtacaagactaatagtaacgtaatacgtaccggtaggtaccgttaccggaccgtaggggtaacctaagggttcggtaacgttacgaaaacgtacgttggttcggactcgaccaaccgtntacgttcgttccttcgtaacc

SEQ ID NO: 379487 - DNA, 666 bp, Homo sapiens
  misc_feature: GZ8MTXP01EXN1V.45.73.G07.1.454.CMB.2.raw
tcagacgcgatcgacacgaccggtgctcgatttagctctacgctcaggggggagtcagaccctgtcaggacacagcatggacatgagggtccccgctcagctcctggggctcctgctgctctggctcccaggtgccggatgtgccatcctgatcgacccagtcctccatcctcactctctgcatctataggagacgagggtcaccgtcacgttggtcgggcgagtcgaggtattagttagggttaaattttttgcttggtatcagcagagaccgagggacacgcccctaggcttcttgtattttatctcgtccgttcctcttgttacgtaaggtttggacgttcctcctacaagtacttcgaggcggcgacggccggtctcggtacgggacctacttactttaccacctctaccaacctagtaccgactcgccctggaccacggtaccccgtaaagttaccgttacggaaaccgttactacgttacggtacaacgtaactaaacgttaactacgttaaaacgttcggttaccggtacgggtaccgggttaccgggtaccgggtaacgggggtaacgtaaaggggttcggtaaacgtttaacgaaacggtacgttgggttcgccgtaacgactaacctagtcgttacgttccgtttaacgtaacccg

SEQ ID NO: 379488 - DNA, 643 bp, Homo sapiens
  misc_feature: GZ8MTXP01A03PV.45.73.G07.1.454.CMB.2.raw
  modified_base (307)..(307): a, c, t, g, unknown or other
  modified_base (335)..(335): a, c, t, g, unknown or other
  modified_base (624)..(624): a, c, t, g, unknown or other
tcagacgcgatcgacacgaccggtgctcgatttagctctacgctcagggggagtcagaccctgtcaggacacagcatggacatgagggtccccgctcagctcctggggctcctgctgctctggctcccaggtgccggatgtgccatcctgatcgacccagtcctccatcctcactctctgcatctagtaggagacgagggtccaccgtctacgttggtcgggcgagtcgaaggtattagttaggttaaattttttagccgttaggtatcgagacagacgaccgagggacacggtccccgtaggtctnttgtatttacttcgtcgtccgttccttnttgttacgtaaggtttcggacgttcctacctacgtaagtaccttcgaggccggcgacggccggtctcggtacgggacctacttactttccacctctaccacctatacgacgtacgccgtagaccgaccgaccgtaagtaccgttaggaaccttacttacgtcgtacgtagtactaaagttaacttaacgtaattcgtaccggtacggtacggttccggacggtacggggtaaccgtaagggttgtaacgttaacgtaaacggtacgttggttcgacgtcacgtaacctnttcgttcttccttcgtccc

SEQ ID NO: 379489 - DNA, 598 bp, Homo sapiens
  misc_feature: GZ8MTXP01EZ498.45.73.G07.1.454.CMB.2.raw
  modified_base (583)..(583): a, c, t, g, unknown or other
tcagacgcgatcgacacgaccggtgctcgatttagctctacgctcaggggggagtcagaccctgtcaggacacagcatggacatgagggtccccgctcagctcctggggctcctgctgctctggctcccaggtgccggatgtgccatcctgatgacccagtctccatcctcactctctgcatctataggagacagggtcaccgtcacttggtcgggcagtcaggattagttggtaaattttttgcctggtatcagcagagaccgagggacacgcccctaggcttctttgtattttattctgtcgttccttcgttgttcgtaaggtttggacgttcctcctacgtaagtacttcgagcggcacggcggtctcgtcggggactactactttcactctccaccagtccgacacgcctgaccgacgacccgtaagtacgttacgaacgttactactcgggtcagtacctaatacgtaacgtaaatacgtaccggtggtaccggttccgggaccggtagggggtaacccgtaagggttcggaacgttacgaaacgtaacgttggttgttcgtcgctaacctatcgttnttccgttaacgtccg

SEQ ID NO: 379490 - DNA, 713 bp, Homo sapiens
  misc_feature: GZ8MTXP01ERF14.45.73.G07.1.454.CMB.2.raw
  modified_base (318)..(318): a, c, t, g, unknown or other
tcagacgcgatcgacacgaccggtgctcgatttagctctacgctcagggggagtcagaccctgtcaggacacagcatggacatgagggtccccgctcagctcctggggctcctgctgctctggctcccaggtgccggatgtgccatcctgatgacccagtctccatcctcactctctgcatctataggagacgagggtcaccgtcacgttggtcgggcgagtcaaggtattagttagggttaaattttttcgccttaggtatcgagcagagaccgagggacacgcccctaggctcgttgtatttattctgcgttcctnttgttccgtaaaggttggtagttctacctacgaaacgtacttccgaggccggtacacgggcccggtacttccggttagggaacctaacgttactttttaccacttacctacctacccagttaccgaacacggtccctaggaccgaaacggtaccccggtaaagtttaccggtttaacggggaaaccttaacgttaacgttcggggtactaaacggtacctaaattaacgtaacgtaaacgttacgttaccgggtacgggtaccgggttaccgggtaccgggtaacgggggtaacccgttaaaggggttgggtaaacggtttacgaaaaccgggtaacttcggggttacggttcgtcggaccgtcgttactcgttacggttaaccttcgttaaccc

SEQ ID NO: 379491 - DNA, 619 bp, Homo sapiens
  misc_feature: GZ8MTXP01B1KI0.45.73.G07.1.454.CMB.2.raw
  modified_base (333)..(333): a, c, t, g, unknown or other
tcagacgcgatcgacacgaccggtgctcgatttagctctacgctcagggggagtcagaccctgtcaggacacagcatggacatgagggtccccgctcagctcctggggctcctgctgctctggctcccaggtgccggatgtgccatcctgatgacccagtctccatcctcactctctgcatctataggagacagggtcaccgtcacttggtcgggcagtcaggtattattgggtaaattttttgctggtatcagcagagaccgagggacacggcccctaggcttctttgtatttatctgcgttcctcttgttctaaggttggagttcctcctnaagtacttccaggtcggcaggccgggtctcgtggggaactacgtactttcacttctacacctatccgacacgcctgaccgacggacccgaaagtacgtttacggaaacgttactacgttggtacagtacctaagttactacgtaaattacgtaccggttaggggtaaccgtttccgggaccggtaacgggggttcccgtaaaggggttcgggtaaacgtttaccggaaaacggtacttgggttcggttctcggacctaacgtactccgttgttcctttcgttaacc

SEQ ID NO: 379492 - DNA, 604 bp, Homo sapiens
  misc_feature: GZ8MTXP01EWXQF.45.73.G07.1.454.CMB.2.raw
  modified_base (585)..(585): a, c, t, g, unknown or other
tcagacgcgatcgacacgaccggtgctcgatttagctctacgctcaggggggagtcagaccctgtcaggacacagcatggacatgagggtccccgctcagctcctggggctcctgctgctctggctcccaggtgccggatgtgccatcctgatcgacccagtcctccatcctcactctctgcatctataggagacgagggtcaccgtctacgttggtcgggcgagtcgaggtattagttaggtaaatttttagcctggtatcagcagagacgaggacacgccctaggcttcttgtatttatcgtgtccgttcctcgttggttactaaggtttggacgttcctacctacgaaagtacttcgaggtcggactaggccgtctcgtagggaacctacgtactttaccacttctaccacctagtccgacacggcctgaccacggtacccgtaagtacgttacgaaacgttactactgggtacaagtactaattatacgttaaatcgtacggtagtcgttacggacggtaggggtaaccgtaagggttggtacgttacgaaacgtacgttggttcgctcgactaaccgttntcgttacgttccttcgaac

SEQ ID NO: 379493 - DNA, 595 bp, Homo sapiens
  misc_feature: GZ8MTXP01ANU8R.45.73.G07.1.454.CMB.2.raw
  modified_base (322)..(322): a, c, t, g, unknown or other
tcagacgcgatcgacacgaccggtgctcgatttagctctacgctcagggggagtcagaccctgtcaggacacagcatggacatgagggtccccgctcagctcctggggctcctgctgctctggctcccaggtgccggatgtgccatcctgatgacccagtctccatcctcactctctgcatctataggagacagggtcaccgtcacttgtcgggcagtcaggtatagttggtaaattttttagcctggtatcgagcagagaccgagggacacgcccctaggctcttgatttatctgcgtctctgttacagttggatctctanagacttcagcgcagcggctcgtgggacactatttcactctacacatcacacgcctagacgacgacccgaaagtacgtttacgggaaacttacgtactggggtacaagtacctaaattactaacggtaaacttacgtaccggtgggtaaccgtttccgggaccgtacgggggtaacccgtaaaggggttcgggtaacgtttacgaaaaccggtaacgttcggttgggaacttcggacccaacccgttatcccttggttccctttcgtaaccccg

SEQ ID NO: 379494 - DNA, 604 bp, Homo sapiens
  misc_feature: GZ8MTXP01CH4W5.45.73.G07.1.454.CMB.2.raw
  modified_base (377)..(377): a, c, t, g, unknown or other
tcagacgcgatcgacacgaccggtgctcgatttagctctacgctcagggggagtcagaccctgtcaggacacagcatggacatgagggtccccgctcagctcctggggctcctgctgctctggctcccaggtgccggatgtgccatcctgatgacccagtctccatcctcactctctgcatctataggagacagggtccacgtcacgttggcgggcgagtcaggtattagttggtaaattttttgcctggtatcagcagacgacgaggacacgcccctaggctctttgtattttattctgtccgttcctcgttgtttacgtaaggttggtacgttcctccctataagtaccttcgaggccggcgacggccggctcgngggaccactattccactcacaccagtcgacagcctagacacggacccgtaagtaccgttagaaccgtactacgtagggtacaagtactaatataaccgttaaagtacgttccggtaggtaccgtttcgggaccgtacgggggtaacctaaggggttacggtacgttaacgaaaccgtacgttggcggttcgtcgaccaactagttcttcgttaaccttaacgttccc

SEQ ID NO: 379495 - DNA, 610 bp, Homo sapiens
  misc_feature: GZ8MTXP01BXR09.45.73.G07.1.454.CMB.2.raw
  modified_base (185)..(185): a, c, t, g, unknown or other
tcagacgcgatcgacacgaccggtgctcgatttagctctacgctcagggggagtcagaccctgtcaggacacagcatggacatgagggtccccgctcagctcctggggctcctgctgctctggctcccaggtgccggatgtgccatcctgatgacccagtctccatcctcactctctgcatctanaggagacagggtcaccgtcacgttggcgggcagtcaggtattagttaggtaaattttttgctaggtatcgagcagacgacgaggacacgcccctaggtctacttgtatttatcgtgtccgttctcttagttactaagttgtacgtctcacaagtcttacagtcgcagccggctcgtgggactacgtctttcactctaccaccgatcgacacgccctagaccacgacccgaagtaccttagggaaaccttactacgtgtactagtaactaattaacgtacgtaaacgttctaccgggttcggtaaccggttcgggccggtaacgggggtaacccgtaaggggttaggacgtttaaccggaaaacggttccgttaggttcggccgtcgaccctaacccgttgttaccgttcgttaacccttcgtccg

SEQ ID NO: 379496 - DNA, 707 bp, Homo sapiens
  misc_feature: GZ8MTXP01C6G30.45.73.G07.1.454.CMB.2.raw
tcagacgcgatcgacacgaccggtgctcgatttagctctacgctcaggggggagtcagaccctgtcaggacacagcatggacatgagggtccccgctcagctcctggggctcctgctgctctggctcccaggtgccggatgtgccatcctgatgacccagtctccatcctcactctctgcatctataggagacgagggtccaccgtcacgttggtcgggcgagtcaaggtatattagggtaaattttttagctggtatcagcagagaccgagggacacgcccctaggctctttgtatttattctgtcgttcctcttgtttactaaggttggtacgttcctcctacgaagtacttcgagtccggcgacggtccggtcctcgtacgggtacctactacttttccaacctttcctaccctaaccctagttacccggaaccacggtcccctacggaccgaaccgggtaccccgtaaacggttaaccgtttacgggaaacccgtttacgtacctttaggggtaacgtaacgtaacttaaaattacgttaaccgttaaaagttcgttaccggtagggtaaccggtttccgggaccggtaacgggggtaaccgtaaggggttaggtaacgttaaccgaaaacggtacgttacggggttccggttacttaacggaccctaaccgtacgttcttacgtttccgttccgttaacccg

SEQ ID NO: 379497 - DNA, 492 bp, Homo sapiens
  misc_feature: GZ8MTXP02H9QI7.45.73.G07.1.454.CMB.2.raw
tcagacgcgatcgacacgaccggtgctcgatttagctctacgctcaggggagtcagaccctgtcaggacacagcatggacatgagggtccccgctcagctcctggggctcctgctgctctggctcccaggtgccggatgtgccatcctgatgacccagtctccatcctcactctctgcatctataggagacagggtcaccgtcacttgtcgggcagtcaggatattggaaatttttgctggtatcagcagagaccaggacagcccctaggcttttgatttattctgcgtctctgttcaagttggagtctcctcagattccagtcggcagcggctctgggacacatttcactctcaccatcgacagcctgcagcccgaagacttggacgtactactgtcagcaatatcgtaaatatccgtggacgtttcggcctaggggtccaaggtcggtagttacaaacggactgtcggctgcacatctgtcttcacttcc

SEQ ID NO: 379498 - DNA, 588 bp, Homo sapiens
  misc_feature: GZ8MTXP02JAPS2.45.73.G07.1.454.CMB.2.raw
  modified_base (559)..(559): a, c, t, g, unknown or other
tcagacgcgatcgacacgaccggtgctcgatttagctctacgctcagggggagtcagaccctgtcaggacacagcatggacatgagggtccccgctcagctcctggggctcctgctgctctggctcccaggtgccggatgtgccatcctgatgacccagtctccatcctcactctctgcatctataggagacagggtcaccgtcacgttggtcgggcgagtcaggtatagttaggtaaattttttagcctggtatcagcagagaccgaggacacgcccctaggctcttgtatttattctgtccgttcctctgtttactaaggtttggacgttcctcctacaagtacttcgaggcggcacggcggctcgtgggtacacttactttccacttcctacaccagtccgacacgccctgaccgacggacccgtaaagtaccgtttacggaacgttactacgtgtacagactaatacgtacgtaaatacgtccggtaggtaccggttcggaccggtaacggggtaccgtaagggtggtacgttaacgaaacggtacgtggtcgcncgcctaacgtcttctcgttcctactaccg

SEQ ID NO: 379499 - DNA, 521 bp, Homo sapiens
  misc_feature: GZ8MTXP02F4TIP.45.73.G07.1.454.CMB.2.raw
tcagacgcgatcgacacgaccggtgctcgatttagctctacgctcagggggagtcagaccctgtcaggacacagcatggacatgagggtccccgctcagctcctggggctcctgctgctctggctcccaggtgccggatgtgccatcctgatgacccagtctccatcctcactctctgcatctataggagacagggtcaccgtcacttgtcgggcgagtcaggatattggtaaatttttagctggtatcagcagagaccgaggacagcccctaggctcttgatttattctgcgtcctctgttcaagttggagtctcctcaagacttcagcggcaggcggctcgtgggactactatttcactctcaccatcgacagcctgaccacgacccgaaagtacttagggaacttactactgtacagactaaatataacgtaaatagtccgtaggtaccgttcggcgaaggggtaccaagggtggaacgttacaaacgtactggtacgctgcactatctagtctctac

SEQ ID NO: 379500 - DNA, 600 bp, Homo sapiens
  misc_feature: GZ8MTXP02HGSQD.45.73.G07.1.454.CMB.2.raw
  modified_base (401)..(401): a, c, t, g, unknown or other
tcagacgcgatcgacacgaccggtgctcgatttagctctacgctcagggggagtcagaccctgtcaggacacagcatggacatgagggtccccgctcagctcctggggctcctgctgctctggctcccaggtgccggatgtgccatcctgatgacccagtctccatcctcactctctgcatctataggagacagggtcaccgtcacgttggtcgggcgagtcaggattattaggtaaatttttgctggtatcagcagagaccgaggacactccccgtaggcttcttgtattttattctgtcgttcctctgttactaaggttggacgttcctacctcaagtacttcgagtcggcaggcggtctcgtgggactacgtatttccactctacaccctatccgacncgcctgcacgcccgtaagtaccgtttaggaaccgttactacgttcgactagactaaattactacgttaaatacgtaccggtacggtaccggttaccgggaccggtaacgggggtacctaaaggggtcgtaacggttaacgaaaacggtacgtggtcggtactcggacctaacccgtagttccgtcgttccttactcccg

SEQ ID NO: 379501 - DNA, 529 bp, Homo sapiens
  misc_feature: GZ8MTXP02I5VNW.45.73.G07.1.454.CMB.2.raw
  modified_base (319)..(319): a, c, t, g, unknown or other
  modified_base (322)..(322): a, c, t, g, unknown or other
  modified_base (350)..(350): a, c, t, g, unknown or other
tcagacgcgatcgacacgaccggtgctcgatttagctctacgctcagggggagtcagaccctgtcaggacacagcatggacatgagggtccccgctcagctcctggggctcctgctgctctggctcccaggtgccggatgtgccatcctgatgacccagtctccatcctcactctctgcatctataggagacagggtcaccgtcacttgtcgggcgagtcaggatattggtaaattttttgctggtatcagcagagaccaggacacgcccctaggctcttgatttattctgcgtcctctgttcaagttggagtctcctnaanattcagcgcagcggctcgtgggacactntttcactctcaccatcgacagcctgacacgcccgaagtacgtttaggaaccgttactactgtcagacaatatacgtaaatactccggtaggaccgttcgggaccgaggggtaccaagggtggtacgttaacgaaacgtacgtggtaggactcggacacctactctacgttcttacgtac

SEQ ID NO: 379502 - DNA, 577 bp, Homo sapiens
  misc_feature: GZ8MTXP02HX9F0.45.73.G07.1.454.CMB.2.raw
  modified_base (319)..(319): a, c, t, g, unknown or other
tcagacgcgatcgacacgaccggtgctcgatttagctctacgctcagggggagtcagaccctgtcaggacacagcatggacatgagggtccccgctcagctcctggggctcctgctgctctggctcccaggtgccggatgtgccatcctgatgacccagtctccatcctcactctctgcatctataggagacagggtcaccgtcacttgtcgggcgagtcaggatattaggtaaattttttagctggtatcagcagagaccagggacacgcccctaggctcttgatttatctgcgtctctgttcaagttgagtctcctnaagtcttcagcgcagcggctcgtgggactactatttcactctcacatcgacacgcctgcacggacccgaaagtaccgtttagggaaaccgttaacttacgtagttacaagtactaaagtaactacgtaaattagtcccggtaggtaccggtttacgggaccgtacgggggttaccaaggggttacggtaacgttaacgaaaacgtacgttggtacgggtactaacggtaccaacgtactcttcgtttccttacgtacc

SEQ ID NO: 379503 - DNA, 596 bp, Homo sapiens
  misc_feature: GZ8MTXP02IRHC0.45.73.G07.1.454.CMB.2.raw
tcagacgcgatcgacacgaccggtgctcgatttagctctacgctcagggggagtcagaccctgtcaggacacagcatggacatgagggtccccgctcagctcctggggctcctgctgctctggctcccaggtgccggatgtgccatcctgatgacccagtctccatcctcactctctgcatctataggagacagggtcaccgtcacttggtcgggcgagtcaggatattggtaaatttttgcctggtatcagcagagaccgagggacacgcccctaggctcttgtatttattctgccgtcctctgtttctaaggttggacgtctcctcaagtacttcgagcggcagcggctcgtgggacacgtatttccactcctacaccatcgactacgccctgaccgacgaccccgaagtacgtttacggaacgttaacttacgtgtaccaagtactaattaacgtacgttaaattacgtaccggtacgggtaaccggttccgggaccggtaacgggggtaccgtaaaggggttagggtaacgttaaacggaaaacgtacgtacggtcgactaacgccaacgtactcgttcgttcttactaccg

SEQ ID NO: 379504 - DNA, 569 bp, Homo sapiens
  misc_feature: GZ8MTXP02GLPPD.45.73.G07.1.454.CMB.2.raw
tcagacgcgatcgacacgaccggtgctcgatttagctctacgctcagggggagtcagaccctgtcaggacacagcatggacatgagggtccccgctcagctcctggggctcctgctgctctggctcccaggtgccggatgtgccatcctgatgacccagtctccatcctcactctctgcatctataggagacagggtcaccgtcacgttgtcgggcagtcaggatattggaaattttttgctggtatcagcagagaccagggacagcccctaggctcttgatttatctgtcgtcctctgttcaagttggagtctcctcaagattcagcggcagcggctcgtgggacactatttccactctcaccatcgacagcctgacacggaccccaaagtacctttaggaaaccgttacttaactggtacagcaaattatacgtaaaatctccggtaggtaccgttcgggccgtaacgggggtaccctaaagggggttcggaacggtttacgaaaaccggtaacttgggttacggacgttggaccctaacctattcctacggttcctttacgtaccg

SEQ ID NO: 379505 - DNA, 496 bp, Homo sapiens
  misc_feature: GZ8MTXP02GXLFU.45.73.G07.1.454.CMB.2.raw
  modified_base (490)..(490): a, c, t, g, unknown or other
tcagacgcgatcgacacgaccggtgctcgatttagctctacgctcagggggagtcagaccctgtcaggacacagcatggacatgagggtccccgctcagctcctggggctcctgctgctctggctcccaggtgccggatgtgccatcctgatgacccagtctccatcctcactctctgcatctataggagacagggtcaccgtcacttgtcgggcagtcaggatattggaaatttttagcctggtatcagcagagaccagggacagcccctaggcttttgatttattctgcgtcctctgttcaagttggagtctcctcaagattccagcgcagcggctctggggacacatttcactctcacatcgacagcctgcagccccgaagactttggaacgtactactgtcagcaatatacgtaaatatacgtggacgttcggcgaggggtccgaaggtggagttcaaacgtactgtcgctgcacatctgtcttcncttccg

SEQ ID NO: 379506 - DNA, 584 bp, Homo sapiens
  misc_feature: GZ8MTXP02FXP8X.45.73.G07.1.454.CMB.2.raw
  modified_base (204)..(204): a, c, t, g, unknown or other
tcagacgcgatcgacacgaccggtgctcgatttagctctacgctcagggggagtcagaccctgtcaggacacagcatggacatgagggtccccgctcagctcctggggctcctgctgctctggctcccaggtgccggatgtgccatcctgatgacccagtctccatcctcactctctgcatctataggagacagggtcaccgtnacttgtcgggcgagtcaggtatattggtaaatttttgcctggtatcagcagagaccgagggacacgcccctaggctcttgatttatctgcgtcctctgttcaagttggtacgtctctcaagtcttcagcggcaggcggctcgtagggacactattcactctcaccatcgacagcctgacacgacccgaagtacgttacggaaccgttaactacgtgtaccaagtaccaaaagttattaacgtaaaattacgtacccggtaggtaccggttacgggacccgtaagggggtccgtaaagggggttcggtaacgttaaccgaaaacggtaccgttaggtcggtacgtcgacctaaccgtattccgtcgttaccttctaacccg

SEQ ID NO: 379507 - DNA, 524 bp, Homo sapiens
  misc_feature: GZ8MTXP02JXIEB.45.73.G07.1.454.CMB.2.raw
  modified_base (323)..(323): a, c, t, g, unknown or other
tcagacgcgatcgacacgaccggtgctcgatttagctctacgctcagggggagtcagaccctgtcaggacacagcatggacatgagggtccccgctcagctcctggggctcctgctgctctggctcccaggtgccggatgtgccatcctgatgacccagtctccatcctcactctctgcatctataggagacagggtcaccgtcacttgtcgggcgagtcaggatattggtaaattttttgcctggtatcagcagagaccaggacagcccctaggctcttgatttattctgcgtcctctgttcaagttggagtctcctcaagnttcagcgcagcggctcgtgggacacgtatttcacttctacacccatccgacacgccctgcacgcccgaaagtacgtttacggaacttactactgtacagcaatatacgtaaatagtccgtggacgttcggaccgtaggggtccaagggtggtacgttacaaacgtaactcggtcggctgcgaccatcgtcgtcttactacg

SEQ ID NO: 379508 - DNA, 498 bp, Homo sapiens
  misc_feature: GZ8MTXP02HQ8UA.45.73.G07.1.454.CMB.2.raw
  modified_base (319)..(319): a, c, t, g, unknown or other
  modified_base (341)..(341): a, c, t, g, unknown or other
tcagacgcgatcgacacgaccggtgctcgatttagctctacgctcagggggagtcagaccctgtcaggacacagcatggacatgagggtccccgctcagctcctggggctcctgctgctctggctcccaggtgccggatgtgccatcctgatgacccagtctccatcctcactctctgcatctataggagacagggtcaccgtcacttgtcgggcgagtcaggatattggaaattttttagcctggtatcagcagagaccagggacagcccctaggctcttgatttatctgcgtctctgttcaagttgagtctctcagntcagcgcagcgctctgggacantttcactctcacatcgacagcctgcacgccgaagtctttaggaacgttactactgtacagactaatatacgtaaatactccgtaggacgttcggacgacggggttaccaagggttggacgttacaaacgtactgtggctgcacatctcgtcttctac

SEQ ID NO: 379509 - DNA, 499 bp, Homo sapiens
  misc_feature: GZ8MTXP02FLHDI.45.73.G07.1.454.CMB.2.raw
  modified_base (479)..(479): a, c, t, g, unknown or other
tcagacgcgatcgacacgaccggtgctcgatttagctctacgctcagggggagtcagaccctgtcaggacacagcatggacatgagggtccccgctcagctcctggggctcctgctgctctggctcccaggtgccggatgtgccatcctgatgacccagtctccatcctcactctctgcatctataggagacagggtcaccgtcacttgtcgggcgagtcaggatattggaaattttttgcctggtatcagcagagaccagggacagcccctaggctcttgatttattctgcgtcctctgttcaagttggagtctctcaagattcagcggcagcggctcgtgggacactatttcactctcaccatcgacagcctgcagcccgaagtactttaggaacttactactgtcagcaatatacgtaaatatccgtaggacgttcggccgaggggtccaaaggtggacgttacaaaacgactggngctgcacactctcgtctcac

SEQ ID NO: 379510 - DNA, 599 bp, Homo sapiens
  misc_feature: GZ8MTXP02IR8H0.45.73.G07.1.454.CMB.2.raw
  modified_base (349)..(349): a, c, t, g, unknown or other
tcagacgcgatcgacacgaccggtgctcgatttagctctacgctcagggggagtcagaccctgtcaggacacagcatggacatgagggtccccgctcagctcctggggctcctgctgctctggctcccaggtgccggatgtgccatcctgatgacccagtctccatcctcactctctgcatctataggagacagggtcaccgtcacttggtcgggcagtcaggtatagttggtaaatttttagcctggtatcagcagagaccagggacacgcccctaggctcttgatttattctgccgtcctctgtttacaagtttgcgtctcctcaagtctcagcggcagcggctcgnggactactattcactctacaccatcgacacgcctgacacggacccgtaagtacctttacgggaaccttacgtacctgtaccgtagaaaccttagttaataccgttaaatacgttaccggtacgggtaccgttccgggaccggtacggggtaacgaacggggttaggtaacgttaaccgaaacggtaaacgttcggtacggtacgttcgaaccgtaccctacgtttccgttccggtttaccttacttcccg

SEQ ID NO: 379511 - DNA, 531 bp, Homo sapiens
  misc_feature: GZ8MTXP02HIWBL.45.73.G07.1.454.CMB.2.raw
  modified_base (334)..(334): a, c, t, g, unknown or other
tcagacgcgatcgacacgaccggtgctcgatttagctctacgctcagggggagtcagaccctgtcaggacacagcatggacatgagggtccccgctcagctcctggggctcctgctgctctggctcccaggtgccggatgtgccatcctgatgacccagtctccatcctcactctctgcatctataggagacagggtcaccgtcacttgtcgggcgagtcaggatattggtaaatttttagctggtatcagcagagaccagggacagcccctaggctctgatttatctgcgtctctgtcagtgagtctctacagtactcgagcgcagcgctcgngggacactattcactctcaccatcgacacgcctgctacgaccgtaagtacttaggactactactgtctagactaatatacgtaaagtctacggtaggtaaccggttcggacggtacggggtaccgaagggtgggtaacgtaacgtaaaacggtacgtaggtcggctcggactacctatccgttcgtccttacttccg

SEQ ID NO: 379512 - DNA, 535 bp, Homo sapiens
  misc_feature: GZ8MTXP02GPODU.45.73.G07.1.454.CMB.2.raw
  modified_base (298)..(298): a, c, t, g, unknown or other
  modified_base (348)..(348): a, c, t, g, unknown or other
tcagacgcgatcgacacgaccggtgctcgatttagctctacgctcagggggagtcagaccctgtcaggacacagcatggacatgagggtccccgctcagctcctggggctcctgctgctctggctcccaggtgccggatgtgccatcctgatgacccagtctccatcctcactctctgcatctataggagacagggtcaccgtcacttggtcgggcgagtcaggatattggtaaatttttgcctggtatcagcagagaccgaggacacgcccctaggctcttgatttatctgcgtctntgtcaagttgagtctctcagcttcagtcgcagcggctcgtgggacacgtnttcactctcaccatcgacagcctgcacgaccgaagtactttaggaactactacgtgtacagactaatactacgtaaatcgtccggtaggaccgttacggccgtaaggggtaccaaagggtcggtaaacgttacgaaaacgtacgtaggtcggacttcggaccaacgtactctcgttccttactaccg

SEQ ID NO: 379513 - DNA, 684 bp, Homo sapiens
  misc_feature: GZ8MTXP02F1LHH.45.73.G07.1.454.CMB.2.raw
tcagacgcgatcgacacgaccggtgctcgatttagctctacgctcagggggagtcagaccctgtcaggacacagcatggacatgagggtccccgctcagctcctggggctcctgctgctctggctcccaggtgccggatgtgccatcctgatgacccagtctccatcctcactctctgcatctataggagacgagggtccaccgtcacgttggtcgggcgagtcaggtatattaggtaaatttttgctggtatcagcagagaccgaggacacgcccctaggctcttgtatttattcgtgtccgttccttcgttgttacgtaaaggttcggtacgttcctacctactaagtacttcgacggcggacaggccggctcgtacgggactacttactttccacttcctaccaaccattcccgaacacggtccctaggacctacgtaccgtagaaacgttacgtttacgggaaaaccttacttaacgtagttacgaacgtaactaaattaacgttaacggttaaaattaccggttaccgggttacgggttaaccgggtttaccggggaacccggtaacgggggttacccgtaaagggggttacgggtaaacggttaaaccgaaaaccggttaacgttcggtaacgggccgttacggacctaaaccgttgttaccgttcgttctttacccg

SEQ ID NO: 379514 - DNA, 547 bp, Homo sapiens
  misc_feature: GZ8MTXP02FQKSB.45.73.G07.1.454.CMB.2.raw
  modified_base (204)..(204): a, c, t, g, unknown or other
tcagacgcgatcgacacgaccggtgctcgatttagctctacgctcagggggagtcagaccctgtcaggacacagcatggacatgagggtccccgctcagctcctggggctcctgctgctctggctcccaggtgccggatgtgccatcctgatgacccagtctccatcctcactctctgcatctataggagacagggtcaccgtnacttggcgggcgagtcaggtatagttaggtaaattttttgccttggtatcagcagagaccagggacacgcccctaggctcttgtatttattctgtcgtcctctgttactaagttggagtcctctcaagtacttcagcggcagcggctcgtgggacactactttcactctacaccatcgacagccctgcacgacccgaagtacgtttacggaacgttactactcgtcagtactaaatatacgtaaattcgtaccggttaggaccgtttcgggaccgtaacgggggtaccgaaagggtggaacgttacgaaaacgtacgtggtgctgacactactctctctctac

SEQ ID NO: 379515 - DNA, 770 bp, Homo sapiens
  misc_feature: GZ8MTXP02JT4NC.45.73.G07.1.454.CMB.2.raw
tcagacgcgatcgacacgaccggtgctcgatttagctctacgctcagggggagtcagaccctgtcaggacacagcatggacatgagggtccccgctcagatcctggggctcctgctgctctggctcccaggtgccggatgtgccatcctgatgacccagtctccatcctcactctctgcatctataggagacagggtcaccgtcacgttggtcgggcgagtcaggattattggtaaatttttgctggtatcagcagagaccgaagggacagccccgtaggcctcgtttgtattttattctgtccgttccttcgttgtttactaaggtttgggacgttcctccgtacgtaagtaccgtttccgacggccggacgtacgggtccggtcccgttcggtacgggggaacctaccgttacgtttccaaccttcccttacccaaccctacgtacccgaacgtaccgtcccgtacgacccgaccggtacccccggtaaaagggttacccgttttaacggggaaaccctttaaccttaaccgttcggttacccgaaaggtaaccctaaaacgttaacgttaacggtttaaaacgttaccggtttcccgggttaacgggtaaccccggtttcggggaaccccgggtaaacgggggtttacccgtaaaagggggtttacggtaaaccggtttaaacgaaaaaccggttacgttcgggttacgggacttaaccggaccctaaacccgttatttccgttaccgtttccgttaaccttacccg

SEQ ID NO: 379516 - DNA, 537 bp, Homo sapiens
  misc_feature: GZ8MTXP02G9VWA.45.73.G07.1.454.CMB.2.raw
  modified_base (322)..(322): a, c, t, g, unknown or other
  modified_base (368)..(368): a, c, t, g, unknown or other
  modified_base (372)..(372): a, c, t, g, unknown or other
tcagacgcgatcgacacgaccggtgctcgatttagctctacgctcagggggagtcagaccctgtcaggacacagcatggacatgagggtccccgctcagctcctggggctcctgctgctctggctcccaggtgccggatgtgccatcctgatgacccagtctccatcctcactctctgcatctataggagacagggtcaccgtcacttgcgggcgagtcaggtatattggtaaatttttgctggtatcagcagagaccgagggacacgccccgtaggctcttgattttatctgtcgtctctgttcaagttggactctcctanaagacttcgagcggcaggcgctcgtgggacactattcactctcacntcangcctgcacgtaccgaagtacttagaacgtactactagtcagactaagtactacgtaaatacgtaccgtaggtaccgttacgggcgtacggggtacgaaaggggtgtaaacgttacgaaacgtacgtaggtcgcgtgactaccgtattacgtcttacttactaccg

SEQ ID NO: 379517 - DNA, 643 bp, Homo sapiens
  misc_feature: GZ8MTXP02IBZ2X.45.73.G07.1.454.CMB.2.raw
  modified_base (307)..(307): a, c, t, g, unknown or other
  modified_base (411)..(411): a, c, t, g, unknown or other
  modified_base (615)..(615): a, c, t, g, unknown or other
tcagacgcgatcgacacgaccggtgctcgatttagctctacgctcagggggagtcagaccctgtcaggacacagcatggacatgagggtccccgctcagctcctggggctcctgctgctctggctcccaggtgccggatgtgccatcctgatgacccagtctccatcctcactctctgcatctaatagggagacagggtccaccgtctacgttggtcgggacaggtcaaggtattagttaggtaaaattttttgccgtggtatcagcagagaccgaggacacgcccctaggctcttgtattttatcngtcctctgttgtactaggtgtactctactagaatctacgacggcgcgaggcgtctcggtacggaactacttcttacctactcctaccactacgacgacgtaccncgtcgacaccgtaccgtaaacgtacggttaacggtaaccttacgtacgttcgaacgacgtaacttaaacgtaacgttaaacgttaaacttacggtacgggttacgggttaccgggtaccggtacggggtaacgggtaaccggtaaggggttacggtaaaccgtaaaacgtaaacggtacgttcggaacgttcggaaccgtaacnctacgttcgttacgttcctacttccccg

SEQ ID NO: 379518 - DNA, 637 bp, Homo sapiens
  misc_feature: GZ8MTXP02I63F1.45.73.G07.1.454.CMB.2.raw
  modified_base (315)..(315): a, c, t, g, unknown or other
tcagacgcgatcgacacgaccggtgctcgatttagctctacgctcagggggagtcagaccctgtcaggacacagcatggacatgagggtccccgctcagctcctggggctcctgctgctctggctcccaggtgccggatgtgccatcctgatcgacccagtctccatcctcactctctgcatctagtaggagacagggtcaccgtcacgttggtcgggcgagtcaggtattagttaggtaaatttttcgcttggtatcagcagacgacgaggacacgccccgtaggcttcgttgtatttatctgtccgttccttnttcgttacgtaaggttgtacgttcctacctagtaagtacttccgagtcggacacggccggtctcggtagggactactacttccactctacacctatccgacacgctacgacacgaccgtaagttacgttacgaacttactactcgtacacgtactaatactaacgtaacgttacgtcggtacggtaccggttacggaccggtaacgggggttaccaaaggggttcggtaaacggtttaaaccgaaaacggttacgttacgggtcggtaccgttaacgacccgtaaacttcgttccgtttacgttaacctttaccgttacccg

SEQ ID NO: 379519 - DNA, 575 bp, Homo sapiens
  misc_feature: GZ8MTXP02JJDCP.45.73.G07.1.454.CMB.2.raw
  modified_base (326)..(326): a, c, t, g, unknown or other
tcagacgcgatcgacacgaccggtgctcgatttagctctacgctcagggggagtcagaccctgtcaggacacagcatggacatgagggtccccgctcagctcctggggctcctgctgctctggctcccaggtgccggatgtgccatcctgatcgacccagtctccatcctcactctctgcatctataggagacagggtcaccgtctacgttggtcgggcgagtcaggtattagttaggtaaatttttagctggtatcagcagagacaggacacgccctagctcttgatttatctgccgtctcgtgttacgaagttggatctcctanaagtaccttacgacggcggacacggtccggcttcggtcgggaactaccttatttccaactctaaccacctagtaccgacacgcctcgacgacgaccgaacgtacgttacgtaacgtactacgtacgtacgagactaactataacgtaatacgtacgtacgtacgtacgtacgtacggtacggtacggtaggtacgtacgtaaacgtaagtacgttacgacgtaacgacacgtactcgtctctacttccg

SEQ ID NO: 379520 - DNA, 553 bp, Homo sapiens
  misc_feature: GZ8MTXP02IGKW8.45.73.G07.1.454.CMB.2.raw
  modified_base (297)..(297): a, c, t, g, unknown or other
  modified_base (305)..(305): a, c, t, g, unknown or other
  modified_base (315)..(315): a, c, t, g, unknown or other
  modified_base (321)..(321): a, c, t, g, unknown or other
  modified_base (335)..(335): a, c, t, g, unknown or other
  modified_base (346)..(346): a, c, t, g, unknown or other
  modified_base (359)..(359): a, c, t, g, unknown or other
  modified_base (366)..(366): a, c, t, g, unknown or other
  modified_base (376)..(376): a, c, t, g, unknown or other
  modified_base (381)..(381): a, c, t, g, unknown or other
tcagacgcgatcgacacgaccggtgctcgatttagctctacgctcagggggagtcagaccctgtcaggacacagcatggacatggagggtcccccgctcagctccgtggggctcctgctgctctggctcccaggtgccggatgtgccatcctgatcgacccagtctccatcctcactctctgctatctagtaggagacgagggtccaccgtctacgttggtcgggcgagtcgaaggtattagttaggttaaatttttgcttggtatgagcaagacgacgaggacacgccctagtctntgtatttntctgtctctntgttanagttgatctactanatctcgagcgnagcgctcgtgacnctattcnctcaccactncgacncgctcgacgaccgtacctaagtacgttaggaactacttagtgactaagactaatagtaacgtaaatcgtcggtacggtacgtcggaacggtacgggtacgtaagggtcgaacttaacgaaaacggtcgtcggtagccgtaagacctaactgtccttcgttacttcctaaccg

SEQ ID NO: 379521 - DNA, 553 bp, Homo sapiens
  misc_feature: GZ8MTXP02H2QL6.45.73.G07.1.454.CMB.2.raw
  modified_base (317)..(317): a, c, t, g, unknown or other
tcagacgcgatcgacacgaccggtgctcgatttagctctacgctcagggggagtcagaccctgtcaggacacagcatggacatgagggtccccgctcagctcctggggctcctgctgctctggctcccaggtgccggatgtgccatcctgatgacccagtctccatcctcactctctgcatctataggagacagggtcaccgtcacttggtcgggcgagtcaggattattggtaaatttttgctggtatcagcagagaccaggacagcccctaggctcttgatttatctgctcctctgttcaagttggagtctcctnagtattcagtcgcagcggctcgtgggacactattcactctcacccatcgacacgcctgacacgccgaagtactttaggaacgttactactcgtacagtctaaatactacgtaaatacgttccggtaggtaaccggttcggaccgtaagggggttaccgaaacggggttggtaacgggtttaaacaaaacggtacgttggtacggcttaaggaccacctagtcgtacgttcttctac

SEQ ID NO: 379522 - DNA, 674 bp, Homo sapiens
  misc_feature: GZ8MTXP02HYYJB.45.73.G07.1.454.CMB.2.raw
  modified_base (298)..(298): a, c, t, g, unknown or other
  modified_base (671)..(671): a, c, t, g, unknown or other
tcagacgcgatcgacacgaccggtgctcgatttagctctacgctcagggggagtcagaccctgtcaggacacagcatggacatgagggtccccgctcagctcctggggctcctgctgctctggctcccaggtgccggatgtgccatcctgatgacccagtctccatcctcactctctgcatctataggagacagggtccaccgtcacgttggtcgggcgagtcgaggtattagttaggttaaatttttcgctggtatcagcagagaccgaggacacgcccctaggctcttgtattttntctgtccgttccttgttcgtttacgtaagtttcggtacgtccttacctataacgtacttcgaggcggtacgacggtccggtcttcgggtacgggacctactactttccacttctacccaaccctatacccgaacgtacgccctagacccgaaccggtaaccccgtaaaggttacccgtttagggaaaccctttaacgttcgtacgtactaacgacttaaattaacgtaacgttaaactacggttccggtaacgggttacccggttaccggacgggtaacgggggttaccgaaggggttacggtaacgttaaacgaaaaacggtcgtagggttacgaccgtaacgacctacctaggttctacgtttctttaccnccg

SEQ ID NO: 379523 - DNA, 566 bp, Homo sapiens
  misc_feature: GZ8MTXP02H63TL.45.73.G07.1.454.CMB.2.raw
  modified_base (294)..(294): a, c, t, g, unknown or other
  modified_base (306)..(306): a, c, t, g, unknown or other
  modified_base (314)..(314): a, c, t, g, unknown or other
  modified_base (319)..(319): a, c, t, g, unknown or other
  modified_base (333)..(333): a, c, t, g, unknown or other
  modified_base (335)..(335): a, c, t, g, unknown or other
  modified_base (353)..(353): a, c, t, g, unknown or other
  modified_base (360)..(360): a, c, t, g, unknown or other
  modified_base (365)..(365): a, c, t, g, unknown or other
  modified_base (375)..(375): a, c, t, g, unknown or other
  modified_base (386)..(386): a, c, t, g, unknown or other
tcagacgcgatcgacacgaccggtgctcgatttagctctacgctcagggggagtcagaccctgtcaggacacagcatggacatgagggtccccgctcagctcctggggctcctgctgctctggctccaggtgccggatgtgccatcctgatgacccagtctccatcctcactctctgcatctataggagacgagggtccaccgtcacgttggtcgggcgagtcaaggattagtttggtaaattttttacgccttaggtatcagacgagacgacgaggacacgccccgtagcttntagtatttatcngtcgtctntgttnagttgagtctactnantcagcgacagcgtctcgnggacatnttacnctctcactancgacacgtccngctacgaccgaagtactttaggaactactgtgtactagacaattagtaacgtaaaatcgttaccggtaggtaccgtttcggacggtaaggggtaccgaaagggtttggaaacgtttacgaaaacggttacgtaggtcggactaacggaccaacggtcttactcggttactttactacccg

SEQ ID NO: 379524 - DNA, 628 bp, Homo sapiens
  misc_feature: GZ8MTXP02JREUL.45.73.G07.1.454.CMB.2.raw
tcagacgcgatcgacacgaccggtgctcgatttagctctacgctcagggggagtcagaccctgtcaggacacagcatggacatgagggtccccgctcagctcctggggctcctgctgctctggctcccaggtgccggatgtgccatcctgatgacccagtctccatcctcactctctgcatctataggagacagggtccaccgtcacttggtcgggcgagtcaggtattattaggtaaattttttcgcgttggtatcgagcagacgaccgagggacacgcccctaggtcttcttgtattttacttctgtccgttcctcgttgttactaaaggtttggacgttcctacctacgtaagtacttcgacggtcggacgaggtccggcttcgtagggactacgtactttcactctaccactacgtaccgacgacgtcctgacacggaccgtaagtacgtttacgggaaacttactacgtagtacagactaagtaactacgttaaactcgttacggtacggtaccggttaccgggacggtaacggggtaccgtaaagggtcggtaaacgttacaaaacgggtacttacgggacggtctaacgactaaccgtatccttagttacccttcgtaccg

SEQ ID NO: 379525 - DNA, 679 bp, Homo sapiens
  misc_feature: GZ8MTXP02JKNCO.45.73.G07.1.454.CMB.2.raw
  modified_base (96)..(96): a, c, t, g, unknown or other
  modified_base (644)..(644): a, c, t, g, unknown or other
tcagacgcgatcgacacgaccggtgctcgatttagctctacgctcagggggagtcagaccctgtcaggacacagcatggacatgagggtcccccgntcagctcctggggctcctgctgctctggctcccaggtgccggatgtgccatcctgatgacccagtcctccatcctcactctctgcatctagtaggagacagggtcaccgtctacgttggtcgggacgtagtacaggtaattagtttaggtaaattttttcgccgttaggtatcgagcaagagaccgaggacacggccccgtaggtcttcttgtattttagttcgtcgtccgttccttcgttcgtttacgtaaaggttcgtacgttacctccgtacgtaaagtccgttaccgacggtccgacgtacggtccgtcgtcgtacggggtactacgttacttacctaactcctacgaacctactacgacacggtccctagacctcggtaacccggaaagttaccgttacgtaaacgttacgacgttacgagttaccgaactaaaggttacttaacggttaaataccgttaccggtacggttcccgggtacgtacggtacggggttaccgaaaggggttcgtaaacgttacgaaaacgtcgtacgtcgggtacncggtactaaccgtgtcttacgtacctttcgacccg

SEQ ID NO: 379526 - DNA, 549 bp, Homo sapiens
  misc_feature: GZ8MTXP02IVGQX.45.73.G07.1.454.CMB.2.raw
  modified_base (187)..(187): a, c, t, g, unknown or other
  modified_base (289)..(289): a, c, t, g, unknown or other
  modified_base (298)..(298): a, c, t, g, unknown or other
  modified_base (307)..(307): a, c, t, g, unknown or other
  modified_base (317)..(317): a, c, t, g, unknown or other
  modified_base (323)..(323): a, c, t, g, unknown or other
  modified_base (334)..(334): a, c, t, g, unknown or other
  modified_base (361)..(361): a, c, t, g, unknown or other
  modified_base (374)..(374): a, c, t, g, unknown or other
tcagacgcgatcgacacgaccggtgctcgatttagctctacgctcagggggagtcagaccctgtcaggacacagcatggacatgagggtccccgctcagctcctggggctcctgctgctctggctcccaggtgccggatgtgccatcctgatcgacccagtctccactcctcactctctgcatctanaggagacgagggtccacgtcacgttggtcgggcgagtacgaggtattagttaggttaaatttttgcttggtatcgagcagacgacgaggacacgcctagctnttgtatttntctgctctntgtctagtgntctcanatctcgagcgnacgcgctgtcgactacgtcttcactcncacctagtcgacncgctcgacgaccgaccgtaagtacgttacgaacttactacgtcgactaacgactaagtactaacgtaatacgtaccgtacgggtacgtcgggcggacggtaccggtaggtaggtaacgtaacgaaacggtacgtaggtgacgtcgacgtacgtactcgtacttcctacgttcccg

SEQ ID NO: 379527 - DNA, 553 bp, Homo sapiens
  misc_feature: GZ8MTXP01BRZ0H.52.73.G07.1.454.CMB.2.raw
  modified_base (205)..(205): a, c, t, g, unknown or other
  modified_base (242)..(242): a, c, t, g, unknown or other
  modified_base (508)..(508): a, c, t, g, unknown or other
tcagcgcagtacgacacgaccggtgctcgatttagctctacgctcagggcacgaccggtgctcgatttagctctacgctcagggggtgctttccgagagtcatggacctcctgcacaagaacatgaaacacctgtggttcttcctcctcctggtggcagctcccagatgggtcctgtccccaggtgcacctacaacagtggggcncaggactgttgaagccttcggagacccctgtcccctnacctgcgctgtcgatggtgggtccttcagtggtcgctactggacctggatccgccagcccccagggaagggctggagtggattgggggaaatcaatcatactggaagccattaactataacccgtcccttaaaagagtcgagtcaccatatcagtcgacacgtccaagaaccaattctccctgaaggtgagtctgttaccgccgcggtacacggctgtctattactgtgcgaaaggccctcgacgaatgaaactacgccctaggcncgttattggaactcgtggggccaagggcctaacggttctaacccg

SEQ ID NO: 379528 - DNA, 595 bp, Homo sapiens
  misc_feature: GZ8MTXP01BQP4V.52.73.G07.1.454.CMB.2.raw
  modified_base (180)..(180): a, c, t, g, unknown or other
  modified_base (239)..(239): a, c, t, g, unknown or other
  modified_base (269)..(269): a, c, t, g, unknown or other
  modified_base (271)..(271): a, c, t, g, unknown or other
  modified_base (351)..(351): a, c, t, g, unknown or other
  modified_base (382)..(382): a, c, t, g, unknown or other
  modified_base (424)..(424): a, c, t, g, unknown or other
  modified_base (428)..(428): a, c, t, g, unknown or other
tcagcgcagtacgacacgaccggtgctcgatttagctctacgctcagggcacgaccggtgctcgatttagagagagtgtgttaggtttgggggaggcttggtccagcctggtggttccctgagactctcctgtgcagcctctggattctccgtcagtagcaactacatgagctgggtccnccaggctccgaggggaaggggctgggagtgggtctcaagtctttatgtcggtgtaccanatattatgctgactccgtgaggcatcacancncagagacgagtcaggaacagccttgtttctacaaatggaactagtctgaacgacctgaccgacacggctcgtctattacngtgacgaagaacggaacccgagggggcggancgacgccccgtaagtcgtcgggcgacgggaccggtcacgtcnctcncgcctccacgaacggcccacggtccggttccttccccgtacggcccacccctccctaccaaacgcgcctaccgtccgtcgggggcaccgacggcccggcccggtcgggcttcggcccgttggtaaccgaacggtaaccttaccgtaccttacgtaaccgaacgtccg

SEQ ID NO: 379529 - DNA, 636 bp, Homo sapiens
  misc_feature: GZ8MTXP01E3FJ6.52.73.G07.1.454.CMB.2.raw
  modified_base (473)..(473): a, c, t, g, unknown or other
tcagcgcagtacgacacgaccggtgctcgatttagctctacgctcagggggatcaggactcctcagttcaccttctcacgatgaggctccctgctcagctcctggggctgctaatgctctgggtctctggatccaggtggggagattgtgatgactcagtctccactctccctgccccgtcacccctggagagacggcctccatctcctgcaggtctagtcagagcctctgcatagtaatggatacaagttattggattggtatctgcagaagccgagggctagtcctccacagctccgtgattcttagttttcggggttactaacggtcccggggtcccccgttcccgggggtcctaggtaggtacggtttaccagggttcgggactaagggttggaacgtccgaaggggactaaacgtaagttaacttttaaacaaacttaaaaactcgaagacgaaggaggtagggaggngtaggtaggtagttgggggtttaggggtttaattacgtgactagtgtactaagttactaaactaaactccgtcgtaactacggtttacggaccggttaacgggaacctaaggccgttaggacggtaataacgaaacggtacgtggacggtaacttgtaacccg

SEQ ID NO: 379530 - DNA, 620 bp, Homo sapiens
  misc_feature: GZ8MTXP01EUG1O.52.73.G07.1.454.CMB.2.raw
tcagcgcagtacgacacgaccggtgctcgatttagctctacgctcaggggggatcaggactcctcagttcaccttctcacgatgaggctccctgctcagctcctggggctgctaatgctctgggtctctggatccaggtggggagattgtgatgactcagtctccactctccctgcccgtcacccctggagagacggcctcatctcctgcaggtctagtcagacgcctcctgctaatagtaatggatacaagttatggattggtatctgacagaacgccgagggctagtcctaccagagtcctcctgtacttcgttagtttcgggttactaacggtccggggtcccccgttcccgggggtcctaggacggtaggttcgaggttggctagggtgggactcgagggctaacgtagttaactttaacaaactaaaatcgaagtacgaggaggtgggagtgtaggtaaggttagttaggggggtttaggggtttaattaacgtggtactagtaggtaacttaaagttacctaaactaaactccgtcgtaacttacgtttcgggacgaacggggaacaaggttcgttaggacgaataacgaaacgtagtggttcgcgttcgaacc

SEQ ID NO: 379531 - DNA, 789 bp, Homo sapiens
  misc_feature: GZ8MTXP01CAD92.52.73.G07.1.454.CMB.2.raw
tcagcgcagtacgacacgaccggtgctcgatttagctctacgctcagggggatcaggactcctcagttcaccttctcacaatgaggctccctgctcagctcctggggctgctaatgctctgggtctctggatccagtggggagattgtgatgactcagtctccactctccctgcccgtcacccgtggagacgaccggcctccatcctctgcaggtctagtcagacgccctcctgacaattaagtaaatggaataacgaaagttattggattggtatcgtgacagaacgccgagggctacgtcctccaacgagccttacctgtaactttcgtttagttttcgggttactaacggtcccggggtccccccgttcccgggggttacctggtacggtaggttaccgagggttgggacctaagggttggaacgtacggacggggtaccaaacgtaaacggtttaaacttttaaaccgaaaaaccttaaaaaattaccggtaaaggaaccgtaaaggggtaagggttacggggaagggttaccgttaagggggtaaggggttaacggtttttagggggggggtttttaagggggtttttaactttacggttaggtaacgttaagttacggaacgtttaaacggttttacctaaaaccttaaaacgttccccgttacggtaacccgtttaacggttttcgggaacccgggttaaacgggggaaaccctaaggttaccgttagggaacgtaacgtaacgtaaaccggtagtacggttcgggtaaccttcggtaaccc

SEQ ID NO: 379532 - DNA, 658 bp, Homo sapiens
  misc_feature: GZ8MTXP01AFNSK.52.73.G07.1.454.CMB.2.raw
  modified_base (237)..(237): a, c, t, g, unknown or other
  modified_base (244)..(244): a, c, t, g, unknown or other
  modified_base (254)..(254): a, c, t, g, unknown or other
  modified_base (271)..(271): a, c, t, g, unknown or other
  modified_base (377)..(377): a, c, t, g, unknown or other
tcagcgcagtacgacacgaccggtgctcgatttagctctacgctcagggcacgaccggtgctcgatttagagagagtgtgttgggtttgggggaggcttggtccagcctggtggttccctgagactctcctgtgcagcctctggattctccgtcagtagcaactacatgagctgggtccgccaggctccgaggggaagggctggagtgggtctcaagtctttatgtcggtgtaccanatattangctgactcgngaacggccatcacatcnccagagacgagtccaggaacagccttgtttctacaaatggacagtctagacgacctggaccgacacggtctgtacttatacgtggtcgaacgagaacggaacccgnggggggcgacgcgacgaccccgttaacgttcggcggggacccgaacggggaaccccggtcacccgtcctccgtacaccgtccctaccaaccgaacgggccctacggtcccgggttccccttcccccgcggcccaccccgtccctaccgaaacggaccgcctacccgtcggtcgggggaaccaacgttcgggccccggttccgtcggggcccttcggttccccgttagggtaacccgaaacgggttaacccttacgttacccgttagtaaccgttcgtccgg

SEQ ID NO: 379533 - DNA, 583 bp, Homo sapiens
  misc_feature: GZ8MTXP01BFW6Q.52.73.G07.1.454.CMB.2.raw
  modified_base (286)..(286): a, c, t, g, unknown or other
tcagcgcagtacgacacgaccggtgctcgatttagctctacgctcagggggatcaggactcctcagttcaccttctcacgatgaggctccctgctcagctcctggggctgctaatgctctgggtctctggatccagtggggagattgtgatgactcagtctccactctccctgcccgtcacccctggagagacggcctccatctcctgcaggtctagtcagagcctctgcatagtaatggatacaagtattggattggtatctgcagaagccagggcagtctccanagctcctgattctatttgggtactaacgtccgggccccgttccgggggtcctggagtacggttcagggttggctagggtggatcgagggactaacagtaatttaacaaactaaaatcgagacgagtagtggaggctaggagtagttgggggtttaggggtttattacgtgactagtcgtactaagttactaaacgtaaacttcctacgtaacttacgttttcgggaccgttaacgggggaaccaagttacgttggaagtaactacgaaacgaacgtggttacgggtcttcggaaccc

SEQ ID NO: 379534 - DNA, 566 bp, Homo sapiens
  misc_feature: GZ8MTXP01EIXLB.52.73.G07.1.454.CMB.2.raw
  modified_base (284)..(284): a, c, t, g, unknown or other
tcagcgcagtacgacacgaccggtgctcgatttagctctacgctcagggggatcaggactcctcagttcaccttctcacaatgaggctccctgctcagctcctggggctgctaatgctctgggtctctggatccagtggggagattgtgatgactcagtctccactctccctgcccgtcacccctggagagacggcctccatctcctgcaggtctagtcagagcctctgcatagtaatggatacaagtattggattggtatctgcagaagcagggcagtctcanagctcctgatctagtttggtctaagtcgggcccctccggggtcctgagtaggttcagtggcaggtggatcgaggcacagtatttacaactaaaatcagacagagtggagctgagtattggggttaggggtttattacgttggatatggactaaagttctaaacgtaaaacttcctcgtaacttaacgttttgggaccccggttaagggggtacccaaaggttccgttgggaaacgtaagttaaccgaaaacgtaaccgtggttacgggtcttaacggaaccc

SEQ ID NO: 379535 - DNA, 670 bp, Homo sapiens
  misc_feature: GZ8MTXP01CTEL9.52.73.G07.1.454.CMB.2.raw
  modified_base (206)..(206): a, c, t, g, unknown or other
  modified_base (228)..(228): a, c, t, g, unknown or other
  modified_base (250)..(250): a, c, t, g, unknown or other
tcagcgcagtacgacacgaccggtgctcgatttagctctacgctcagggcacgaccggtgctcgatttagctctacgctcagggggtgctttccgagagtcatggacctcctgcacaagaacatgaaacacctgtggttcttcctcctcctggtggcagctcccagatgggtcctgtccccaggtgcacctacaacaggtggggcncaggactgttgaagccttgganacccctgtcccctcacctgcgntgtcgatggtggttcctgagtggcgctacgtggacctggactcccgccacggcccccgaggggacgggcgtgggagtggagttgggggaaattcgaagtcatacgtggaacgtaccattaactaataaaccccgtacccgttaaaagacgtcgaagttaccaacctatatacagtcgaacacgtaccaaacgaaccaattcctaccctggaaaggtcgtacggtctcggttacccgccgtacggggactaccggggctacgtcttaagttacgtcggtacgacggaaaaccgggtcccctacgaaccgtaacgtaacgaaaaccgtaccccgccccgtagggccgttacgttaacgttcggggtaaccgtcggtaaccgggggacctaacgggggacccaacggggttccctaaccccgg

SEQ ID NO: 379536 - DNA, 593 bp, Homo sapiens
  misc_feature: GZ8MTXP01A5INM.52.73.G07.1.454.CMB.2.raw
tcagcgcagtacgacacgaccggtgctcgatttagctctacgctcagggggatcaggactcctcagttcaccttctcacatgaggctccctgctcagctcctggggctgctaatgctctgggtctctggatccagtggggagattgtgatgactcagtctccactctccctgccccgtcacccctggagacgacggcctccatcctcctgcaggtctagtcagacgcctctgcatagtaatggatacaagtattggattggtatctgcagagcagggcagtctccacagctcctgtattcttagtttgggtctaagtccgggcccctccggggtctggagtggttcagtggcaggtggatcgagggcaactagttaattttaacgaaactaaaatcgaagacgaggtaggtagggaggtcgtaggaggtagttgggggtttaggggtttattacgtgactagtgactaaagttactaaactaaacttcccgtcgtaacgttacgtttcgggacccgttaaggggtaacccaaaggttccgttagggaactaagtaaccgtaaaaccgtagtcggttacggtcgttcgaacccg

SEQ ID NO: 379537 - DNA, 576 bp, Homo sapiens
  misc_feature: GZ8MTXP01DEAU3.52.73.G07.1.454.CMB.2.raw
  modified_base (204)..(204): a, c, t, g, unknown or other
  modified_base (240)..(240): a, c, t, g, unknown or other
  modified_base (428)..(428): a, c, t, g, unknown or other
  modified_base (456)..(456): a, c, t, g, unknown or other
tcagcgcagtacgacacgaccggtgctcgatttagctctacgctcagggcacgaccggtgctcgatttagctctacgctcagggggtgctttccgagagtcatggacctcctgcacaagaacatgaaacacctgtggttcttcctcctcctggtggcagctcccagatgggtcctgtcccaggtgcacctacaacagtggggcncaggactgttgaagccttcggagaccctgtcccctnacctgcgctgtcgatggtggtccttcagtggtcgctactggacctggatccgccagcccccagggaagggctggagtggattgggggaaatcaatcatactggaagcattaactataacccgtcctaaagagtcgagtcaaccatatcagtcgacacgtacaagaaccaagttctaccctgaacggtnagggtctgttaaccgccgcggggaaccnggactgtctattactgtcgacgaaacggccctcacggtaatacgaaaactccgaccccgtggccgcgttgttgggtaaccgtcgtcgggggccaaggggaccctaacggttcgtaacccg

SEQ ID NO: 379538 - DNA, 555 bp, Homo sapiens
  misc_feature: GZ8MTXP01ARM30.52.73.G07.1.454.CMB.2.raw
  modified_base (286)..(286): a, c, t, g, unknown or other
  modified_base (291)..(291): a, c, t, g, unknown or other
  modified_base (296)..(296): a, c, t, g, unknown or other
  modified_base (401)..(401): a, c, t, g, unknown or other
  modified_base (544)..(544): a, c, t, g, unknown or other
tcagcgcagtacgacacgaccggtgctcgatttagctctacgctcagggggatcaggactcctcagttcaccttctcacaatgaggctccctgctcagctcctggggctgctaatgctctgggtctctggatccagtggggagattgtgatgactcagtctccactctccctgcccgtcaccctggagagacggcctccatctcctgcaggtctagtcagacgcctctgcatagtaatggatacaagtattggattggtatctgcagaagccgagggcagtctcangctcngtatnttagtttggtactagtccgggtcccctccggggtcctgagtaggttcagtggcaggtggatcgaggcacagtaatttaacaaactaaaatcagcagagtcggagntaggaggtagttgggggtttggggtttattacgtggtactagtacgacgtaaacgttactaaacctaaacttcccgtcgtaacttacgtttcgggaccgaacggggtaaccagttcgttggaagaactacgaacgtacgttgnggccgttaagc

SEQ ID NO: 379539 - DNA, 723 bp, Homo sapiens
  misc_feature: GZ8MTXP01BJAFD.52.73.G07.1.454.CMB.2.raw
  modified_base (205)..(205): a, c, t, g, unknown or other
  modified_base (271)..(271): a, c, t, g, unknown or other
tcagcgcagtacgacacgaccggtgctcgatttagctctacgctcagggcacgaccggtgctcgatttagctctacgctcagggggtgctttccgagagtcatggacctcctgcacaagaacatgaaacacctgtggttcttcctcctcctggtggcagctcccagatgggtcctgtcccaggtgcacctacaacaggtggggcncaggactggttgaagccttcggagacccctgtcccctcacctgcgctgtcgagtggtgggtccttnagtggcgctactggacctggactccgccacgcccccgaggggaagggctggagtggagttagggggaaatcgaatcaatacgtggaacgacctaattaaactacgtaaaccccgtacccttaaaagacgttcgagtaccaacctaatactacacgttaccgaacctaccgtacccaaagaaccctaaacttccctaccccgtaggtaaacggttgaacggttccgttacggtttaccccggacccggtaccggggggaacctaaccggggtccttacgggttaccttaacgttacccgttggttaccggaccgggtaaaaccgggtcccctaacgaaccgtaacttaaacggaaaacccgtacccggccccgtacgggccgttaccgttgttacgggaaccgttcggcggggacccgaacggggacccgtaaccgggttcccgtaaccccgg

SEQ ID NO: 379540 - DNA, 566 bp, Homo sapiens
  misc_feature: GZ8MTXP01DNERT.52.73.G07.1.454.CMB.2.raw
  modified_base (220)..(220): a, c, t, g, unknown or other
  modified_base (240)..(240): a, c, t, g, unknown or other
  modified_base (245)..(245): a, c, t, g, unknown or other
  modified_base (256)..(256): a, c, t, g, unknown or other
  modified_base (272)..(272): a, c, t, g, unknown or other
  modified_base (457)..(457): a, c, t, g, unknown or other
tcagcgcagtacgacacgaccggtgctcgatttagctctacgctcagggggatcaggactcctcagttcaccttctcacaatgaggctccctgctcagctcctggggctgctaatgctctgggtctctggatccaggtggggagattgtgatgactcagtctccactctccctgcccgtcacccgtggagagcgcctcatctcctgcaggtctagtcagngcctctgacatagatgatanaagtntggatggtatngcagagcaggcagtcncacagctctgtatcttagtttcggttactagtccgggtccccgttccgggggtctggtaacgtaggttacgaggttggctagggtgggatccgagggactaacgtagttaatttaacaaactaaaatacgaagacgaggagtgggaggtgaggtaggtagttggggtttgggtttattacgtgtntagtcgtagtaacttactaactaaaacgtcctcgtctacgtttcggacggacgggaacgagacgttggacgtaataacgaaacgtaacgtggttacgtcgttcgaaccg

SEQ ID NO: 379541 - DNA, 590 bp, Homo sapiens
  misc_feature: GZ8MTXP01DL85I.52.73.G07.1.454.CMB.2.raw
  modified_base (248)..(248): a, c, t, g, unknown or other
  modified_base (286)..(286): a, c, t, g, unknown or other
tcagcgcagtacgacacgaccggtgctcgatttagctctacgctcagggggatcaggactcctcagttcaccttctcacaatgaggctccctgctcagctcctggggctgctaatgctctgggtctctggatccagtggggagattgtgatgactcagtctccactctccctgcccgtcaccctggagagacggcctccatctcctgcaggtctagtcagagcctctgcatagtaatggatacaagtnttggattggtatctgcagaagccgagggcagtctccanagctcctgattcttagtttgggtactaagtccgggccccgttccggggtcctggagtaggttcaggtggctaggtggatcgaggcacagtatttaacaataaatcagacagagtggagcgtaggaggtagttgggggtttaggggtttaattacgtggactagtggtactaaaggtttactaaacgtaaacttcccgtcgtaaccttacgttttcgggaccgttaacgggggtaacccaggttaccgttgggttaacggaacttaacgaaacggtaaccgtggttacgggtccttcggtaaccc

SEQ ID NO: 379542 - DNA, 707 bp, Homo sapiens
  misc_feature: GZ8MTXP01BN3GK.52.73.G07.1.454.CMB.2.raw
  modified_base (143)..(143): a, c, t, g, unknown or other
tcagcgcagtacgacacgaccggtgctcgatttagctctacgctcagggggatcaggactcctcagttcaccttctcacaatgaggctccctgctcagctcctggggctgctaatgctctgggtctctggatccagtgggganattgtgatgactcagtctccactctccctgcccgtcaccctggagagacggcctccatctcctgcaggtctagtcagagccctcctgactaagttaagtaatgggaataacgtaagttagttaggatttcggtaattctggacaaggaacgccgagggctagtcctacccacgacgtcctcctagtactttacgttaggttttacggttactaaacggtcccggggtccccccgttccgggggtccctgggaacggtacgggtttaccagggtgggtaccgtagggttacgggacgttaccgaacggggacctaaaccgtaggtttaaacttttaaaccaaaacttaaaaacgtcgaagtaacgaagggtagggtagggaaggtacgtagggaggttaaggtttggggggtttaagggggttttaatttaccgtaggtactaagttcggtaattaaacgttacctaaactaaacgtccctcgtaacgttaacgtttcgggaccgttagggaacgaagttcgaggacgtaaatacgtaaacgtacgtcgttaggtcttcgtaacc

SEQ ID NO: 379543 - DNA, 683 bp, Homo sapiens
  misc_feature: GZ8MTXP01CZG0Q.52.73.G07.1.454.CMB.2.raw
  modified_base (180)..(180): a, c, t, g, unknown or other
  modified_base (185)..(185): a, c, t, g, unknown or other
  modified_base (197)..(197): a, c, t, g, unknown or other
  modified_base (210)..(210): a, c, t, g, unknown or other
  modified_base (285)..(285): a, c, t, g, unknown or other
  modified_base (337)..(337): a, c, t, g, unknown or other
tcagcgcagtacgacacgaccggtgctcgatttagctctacgctcagggcacgaccggtgctcgatttagctctacgctcagggcacgaccggtgctcgatttagagctcacgtattgggttggggagcttggccagcctggtggttccctgagactctcctgtgcagcctctggattcnccgtnagtagcaactanatgagcgtggccncgaggctacggaaggggaagggctgggagtgggtctacgtaagttctttagtggtcggtacgtaaccatatatangctagacgtcgaggaacggcctatcacatcacagacgacgagaccaagaacngtcttagtttactacaaagtgaactagtcgaagacgaaccgtaggaaccgtacgacggtcttagttactaattacgtgtacggacgaacggaacggaaccgggacgggggacgggacgaccgtaaccgtacccgtaacgttaccggtacggggaccggggaaccggggtaaccccgggtaccgtacccgtacctcccgtaccgaccgtaccccgtaacccgtaaccgtaacccggtcccctaaccgttcccggttccccgttccccgtcgaccccgtaccccgtacccgttaccgaacgaccgaacccgtaccgtcggcggggaccaccggtccggttcccggccg

SEQ ID NO: 379544 - DNA, 581 bp, Homo sapiens
  misc_feature: GZ8MTXP01EZ63Y.52.73.G07.1.454.CMB.2.raw
  modified_base (250)..(250): a, c, t, g, unknown or other
  modified_base (416)..(416): a, c, t, g, unknown or other
tcagcgcagtacgacacgaccggtgctcgatttagctctacgctcagggggatcaggactcctcagttcaccttctcacatgaggctccctgctcagctcctggggctgctaatgctctgggtctctggatccagtggggagattgtgatgactcagtctccactctccctgccccgtcacccctggagagacggcctccatctcctgcaggtctagtcagagcctcctgcatagtaatggatacaagtnttggattggtatctgcagaagccagggcagtctccacagctcctgattcttagtttgggtactaacgtccgggcccccgtaccgggggtcctggagtggttacagtggcaggtggatcgaggcacagtaatttaacaaactaaaatcagacgaagaggtagggagngtagaggtagttgggggtttaggggttttaattaacgtgtactagtgtactaaagttactaaactaaacgtcctacgtaacttacgttttcggaccggttaaggggaccaaggcgttaggaacgtaataaccgtaaacgtacgtaggttacgtcgttcgtaaccc

SEQ ID NO: 379545 - DNA, 652 bp, Homo sapiens
  misc_feature: GZ8MTXP01BAPSF.52.73.G07.1.454.CMB.2.raw
  modified_base (284)..(284): a, c, t, g, unknown or other
  modified_base (288)..(288): a, c, t, g, unknown or other
  modified_base (295)..(295): a, c, t, g, unknown or other
  modified_base (297)..(297): a, c, t, g, unknown or other
tcagcgcagtacgacacgaccggtgctcgatttagctctacgctcagggggatcaggactcctcagttcaccttctcacaatgaggctccctgctcagctcctggggctgccaatgctctgggtctctggatccaggtggggagattgtgatgactcagtctccactctccctgcccgtcaccctggagagacggcctcatctcctgcaggtctagtcagacgcctcctgcatagtaatggatacaagtattggattggtatctgcagaagccgagggcagtcnccanctctctntnttgttagtttggtactacggtccgggtccccgtccgggtctggagtacggttacgaggtcggagtaggtaggtacgtacgacgacgtacgtaacgttaaacgtttaaactaaactaaaactaacgacgacgaggtaggtagggagggtacgtaggtagggttaggtttagggggtttaggggtttacgttacgtacgtacgtacgtacgtaacgttaaacgttaacgttaaaccgtaaacgttaccgtaccgtaaccgttacgttacgggtaccgggacgggaaccgtaacgttacggttacggaacgtaacgtaaccgtaaaccgtaacgtacggttacggtcgttcgtaaccg

SEQ ID NO: 379546 - DNA, 593 bp, Homo sapiens
  misc_feature: GZ8MTXP01ETZWZ.52.73.G07.1.454.CMB.2.raw
tcagcgcagtacgacacgaccggtgctcgatttagctctacgctcagggggatcaggactcctcagttcaccttctcacaatgaggctccctgctcagctcctggggctgctaatgctctgggtctctggatccagtggggagattgtgatgactcagtctccactctccctgccccgtcacccctggagagacggcctccatctcctgcaggtctagtcagagcctcctgcatagtaatggatacaagtattggattggtatctgcagaagcagggcagtctcacagctcctgattctagttttcgggtactaaacgtccggggtccccgtccgggggtcctggagtacggttcaggtggctaaggtgatcgaggcacagtatttaacgaataaaatcagacgagtaggtgggacggtcgtaggtagggtagtttaggggggtttaggggttttaacgtttaagtcggtactaagtggtaactaaggtttaacctaacgtaaaacttcctacgtaacttacgtttaggaccggttaaggggacctaagcgttgggagtaactacgtaaacgctaggttcgtcgttcggaacc

SEQ ID NO: 379547 - DNA, 686 bp, Homo sapiens
  misc_feature: GZ8MTXP01B1DH9.52.73.G07.1.454.CMB.2.raw
  modified_base (185)..(185): a, c, t, g, unknown or other
  modified_base (196)..(196): a, c, t, g, unknown or other
  modified_base (205)..(205): a, c, t, g, unknown or other
  modified_base (230)..(230): a, c, t, g, unknown or other
  modified_base (242)..(242): a, c, t, g, unknown or other
tcagcgcagtacgacacgaccggtgctcgatttagctctacgctcagggcacgaccggtgctcgatttagctctacgctcagggggtgctttccgagagtcatggacctcctgcacaagaacatgaaacacctgtggttcttcctcctcctggtggcagctcccagatgggtcctgtcccaggtncacctacaacnggtggggcncaggactggttgaagtccttcgganaccctgtccctnacctgcgctgtcgatggtgggtccttcagtggtcgctactggacctggatccgccacgcccccgaggggacgggctggagtggagttgggggaaattcaatcatacgtggaagcctattaaactactaacccgtcccttaaagacgtcgagtcaccatatcagtcgacacgtaccaaagaaccaattctacccgtagaacggtgaaggtccgttagttaaccgccgacggggacgtacgggtctcggttactaagttaccgtggttacgaccggtaaaacggtccccgttaacgaaccgggtaataaaccggaaaaaaccgttacccggcccccgttacgggggacccttaccggttaaggttccggggtaaaccggtccgggttaacggggggaaccccgtaaacggggggaccccgtaaaccgggggttccctaaccccggg

SEQ ID NO: 379548 - DNA, 585 bp, Homo sapiens
  misc_feature: GZ8MTXP01BNYGB.52.73.G07.1.454.CMB.2.raw
  modified_base (287)..(287): a, c, t, g, unknown or other
  modified_base (371)..(371): a, c, t, g, unknown or other
  modified_base (467)..(467): a, c, t, g, unknown or other
tcagcgcagtacgacacgaccggtgctcgatttagctctacgctcagggggatcaggactcctcagttcaccttctcacaatgaggctccctgctcagctcctggggctgctaatgctctgggtctctggatccagtggggagattgtgatgactcagtctccactctccctgcccgtcaccctggagagacggcctccatctcctgcaggtctagtcagacgcctcctgcatagtaatggatacaagtattggattggtatctgcagaagccagggcagtctccanagctcctgattcttagtttggtctaagtccgggcccctccggggtcctggagtaggttcaggtggcagggtggatcgaggctanagtatttaacaactaaaatcagtacaggtagtggagcgtaggaggtagttgggggtttagggtttatacgtgactagtgtactaagttacctaaanaaacttccgtacgtaacttacgtttacgggaccggttacgggaacccgtaagccggttaggttaacgtaactaaccggtaaaacgtaaccgtggttcggtaaccgttcggtaaccccg

SEQ ID NO: 379549 - DNA, 533 bp, Homo sapiens
  misc_feature: GZ8MTXP01CE2PV.52.73.G07.1.454.CMB.2.raw
  modified_base (503)..(503): a, c, t, g, unknown or other
  modified_base (505)..(509): a, c, t, g, unknown or other
  modified_base (511)..(533): a, c, t, g, unknown or other
tcagcgcagtacgacacgaccggtgctcgatttagctctacgctcagggggggagagatccccaggggtgacagccatggaccctggaagggcctgggctagggacagggaccagagccagtccagggagaggacagagccaatggactggggtgtactgtaacagccctgctggtcccaggcagtgctcggcccctgctgctgctgggtctggccagtcggtcgcccagtcggcctgctgccgccctaatggtcgccaccgcgaaacggccggggacccaggaccccgtggacgcctcgaggttcggaacgcagcccgatcccgagcccgtaggccggacgtccggtgggtcgggggcgtacggcccacgcccccgaaacggccccccccctaaaccccgcttacggtccctacccgttccctacccgtttccccaccccttcccttactaacgtacgactcgctgggacggcgggccgtcgggcgaacgggtcgacagagngnnnnngnnnnnnnnnnnnnnnnnnnnnnn

SEQ ID NO: 379550 - DNA, 645 bp, Homo sapiens
  misc_feature: GZ8MTXP01A06DR.52.73.G07.1.454.CMB.2.raw
  modified_base (144)..(144): a, c, t, g, unknown or other
tcagcgcagtacgacacgaccggtgctcgatttagctctacgctcagggggatcaggactcctcagttcaccttctcacaatgaggctccctgctcagctcctggggctgctaatgctctgggtctctggatccaggtgggganattgtgatgactcagtctccactcctccctgcccgtcacccgtggagacgacggcctccatctcctgcaggtctagtcagacgccctctgacatagtaatggaataacaagttattggattggtatcgtgcaaggaagccgagggctagtcctccaacagtcctcgtagtatttcgttagtttcgggttactacggtcccggggtccccgttcccgggggtcctaggtacggtacggttacagggttcggctaacgggtgactcgaagggctaaacgtagttaatttaacaaacgtaaaatcgaagacgtaggaggtagggaggacgtaggaggttaagttggggggtttagggtttatacgtagtactagtcgtacttaaagttactaaacgtaaactcccgtaagtccgttacggtttcggacggaacgggtactaacgggcgttaggacgtaaacgtaacgtaaaccgtaagtcggttaccgtaacgttcgtaacccg

SEQ ID NO: 379551 - DNA, 682 bp, Homo sapiens
  misc_feature: GZ8MTXP01EGDN8.52.73.G07.1.454.CMB.2.raw
  modified_base (131)..(131): a, c, t, g, unknown or other
  modified_base (193)..(193): a, c, t, g, unknown or other
  modified_base (197)..(197): a, c, t, g, unknown or other
  modified_base (206)..(206): a, c, t, g, unknown or other
tcagcgcagtacgacacgaccggtgctcgatttagctctacgctcagggcacgaccggtgctcgatttagctctacgctcaggggggtgctttccgagagtcatggacctcctgcacaagaacatgaaacncctgtggttcttcctcctcctggtggcagctcccagatgggtcctgtcccaggtgcacctanaacnggtggggcncaggactggttagaacgtccgttcgggactaccccttcgtcccctcacctgccgtctggtcgtagtgggtggggtccttcgagtggtcgctacgtggacctggactccgccacggcccccaggggacgggctggagtggagtaggggaaatcaatcatacgtaggaagcattaactactaaccccgtacctaaaaggagtcgagtaccaacagtactcagtaccgactaccgtacaagaacctattctaccctagaggtgacggtctcgttaccgccggtacggggacgtacggtcttacggtactagttacgtcggtacgtaccggaaacggtcccttaacgaaccgtaagttaacggaaaacccgtcccggttaccccgttgggaccgttcgttacggaccggggttaacggtccgggttaacgggggaccccgtaaacgggggacccgtaaaccgggttccgttaaccccggg

SEQ ID NO: 379552 - DNA, 656 bp, Homo sapiens
  misc_feature: GZ8MTXP01D0SS1.52.73.G07.1.454.CMB.2.raw
  modified_base (297)..(297): a, c, t, g, unknown or other
tcagcgcagtacgacacgaccggtgctcgatttagctctacgctcagggggatcaggactcctcagttcaccttctcacaatgaggctccctgctcagctcctggggctgctaatgctctgggtctctggatccaggtggggagattgtgatgactcagtctccactctccctgcccgtcaccctggagacgacgcctcatcctcctgcaggtctagtcagacgtcctctgacaataagtaatggaataacgtaagttattggattggtatctgacagaacgccgaggcagtcacanagctcctgtatcgttgtttaggtactaacgtccgggtccccgtccggggtctaggacgttaggttcgaaggtcgggactaagggttggaactccgaagggactaaacgtattaacttttaaacaaacttaaaaataccgaagacgaagtaggtagggaaggtgtaggtagggttagtttaggggggtttaaggggttttaagttacgtaggtactaaagtcgtaacgtaaacgtttacctaaaacgtaaaccttcccgtacgtaacgttaacggtttcgggaccggttaaacggggtaacccaaggttcgagaacgttaacgaacgtaaaccgtagtggttacggtaacttcgtaaccc

SEQ ID NO: 379553 - DNA, 595 bp, Homo sapiens
  misc_feature: GZ8MTXP01A3690.52.73.G07.1.454.CMB.2.raw
  modified_base (252)..(252): a, c, t, g, unknown or other
  modified_base (563)..(567): a, c, t, g, unknown or other
  modified_base (569)..(595): a, c, t, g, unknown or other
tcagcgcagtacgacacgaccggtgctcgatttagctctacgctcagggggggagagatccccaggggtgacagccatggaccctggaagggcctgggctagggacagggaccagagccagtccagggagaggacagagccaatggactggggtgtactgtaacagccctgctggtcccaggcagtgctggcccctgctgctgcgtgggtctggccagtcggtcgccatcggcctgctgcgcctagtggtcncaccgacgaaacggccggggaacccacggaccccgtggacgtccgtacgtaggttcgggaaagccgaacggccccgaactccccgacggccccgtgggaccgggtacggtccccggtggggtacgggggaccgtacgggtcccgaaccgggacccccgaaaccgggaccccccccaaaccccgtacgtcggtaccctaccgttccccgttacccgttcccccaccctttaccctaccgtaactacccggtactccggtcgtacggacgggtccgggcgtacgggaccgaacgggtaccgacgtaagagcgnnnnngnnnnnnnnnnnnnnnnnnnnnnnnnnn

SEQ ID NO: 379554 - DNA, 560 bp, Homo sapiens
  misc_feature: GZ8MTXP01AECJ0.52.73.G07.1.454.CMB.2.raw
  modified_base (216)..(216): a, c, t, g, unknown or other
  modified_base (262)..(262): a, c, t, g, unknown or other
  modified_base (276)..(276): a, c, t, g, unknown or other
  modified_base (282)..(282): a, c, t, g, unknown or other
  modified_base (304)..(304): a, c, t, g, unknown or other
  modified_base (307)..(307): a, c, t, g, unknown or other
  modified_base (327)..(327): a, c, t, g, unknown or other
  modified_base (349)..(349): a, c, t, g, unknown or other
tcagcgcagtacgacacgaccggtgctcgatttagctctacgctcagggcacgaccggtgctcgatttagctctacgctcagggcacgaccggtgctcgatttagagctcacgtattgggtttggggaggcttggtccagcctggtggttccctgagactctcctgtgcagcctctggattctccgtcagtagcaactacatgagcgtgggtcccncaggctccgaggggaagggctgggagtgggtctcgaagttctttanggtcggtgtaccanatatangctgactcgtgaggcatcaccntcncagagacgatccgaagaacngccttgtttctacaaatgaacngtcaagacgctgacgagacgctgtactatacgtgtgacgagacgaccggaggggcgagcgacgcccgtaacgtcgcggggaccgaacggggtacccgtcgacccgtctaccgtcgaccgcccgtaccgaccgaacggccctacgtcccgtcccttccccgcgccccaccctccaccgacgcgccaccgtcggcgggcacgcgcccggtccg

SEQ ID NO: 379555 - DNA, 571 bp, Homo sapiens
  misc_feature: GZ8MTXP01BBUE7.52.73.G07.1.454.CMB.2.raw
  modified_base (282)..(282): a, c, t, g, unknown or other
  modified_base (286)..(286): a, c, t, g, unknown or other
  modified_base (397)..(397): a, c, t, g, unknown or other
tcagcgcagtacgacacgaccggtgctcgatttagctctacgctcagggggatcaggactcctcagttcaccttctcacatgaggctccctgctcagctcctggggctgctaatgctctgggtctctggatccagtggggagattgtgatgactcagtctccactctccctgcccgtcacccctggagagacggcctccatctcctgcaggtctagtcagagcctcctgcatagtaatggatacaagtattggattggtatctgcagaagccagggcagtcncacngctctgatctatttggtctaagtccggcccctccggggtctgagtggttcagtggcaggtggatcgaggcacagtatttaacaactaaaatcaagacagtaggtaggaggntggaggtagttgggggtttaggggtttaagttacgttgacgtagtggactaaagtttactaaactaaaacttcccgtacgtcgttaccgttttggaccgttacgggaacccgtaagccgttggaaggttaataccgtaaaacgaacgttgggttacgggtcgttcggtaacccg

SEQ ID NO: 379556 - DNA, 646 bp, Homo sapiens
  misc_feature: GZ8MTXP01BWBAF.52.73.G07.1.454.CMB.2.raw
  modified_base (192)..(192): a, c, t, g, unknown or other
tcagcgcagtacgacacgaccggtgctcgatttagctctacgctcagggcacgaccggtgctcgatttagctctacgctcagggggtgctttccgagagtcatggacctcctgcacaagaacatgaaacacctgtggttcttcctcctcctggtggcagctcccagatgggtcctgtcccaggtgcacctanaacagtggggcgcaggactgttgaagccttcggagaccctgtcccctcacctgcgctgtcgagtggtgggtccttcagtggcgctactggacctggactccgccacggcccccgaggggaaggggctgggagtggtagtagggggaaatcaatcatacgtggaagccattaactactaacccgtccttaaagacgtcgagtcacatatcagtccgactaccgtaccaaacgaacctaattcctccccgtagaacggtggacggtcttacgggttacccgcccggacgggggacgacgggtcctggttacctagttacgtgttacggacgtaaacggcccctacgacgtaagtacgaaaacctcccgcccgtgggccgttaccgttggttccgggtaacggtccggtcgggggaacccaacgggggttacccgtaaccgggttcctaacccccgg

SEQ ID NO: 379557 - DNA, 613 bp, Homo sapiens
  misc_feature: GZ8MTXP01BG1CT.52.73.G07.1.454.CMB.2.raw
  modified_base (249)..(249): a, c, t, g, unknown or other
  modified_base (282)..(282): a, c, t, g, unknown or other
tcagcgcagtacgacacgaccggtgctcgatttagctctacgctcagggggatcaggactcctcagttcaccttctcacgatgaggctccctgctcagctcctggggctgctaatgctctgggtctctggatccagtggggagattgtgatgactcagtctccactctccctgcccgtcacccctggagagaccggcctcatcctcctgcaggtctagtcagacgcctctgcatagtaatgatacagtntgatggtatctgcagagcgagggcagtctccanagtcctctagtattcgttagtttggtactaacggtccggtccccgtccgggggtcctggacggtagtcaggtcggcgtagggttcggatcgaggactaacgtagttaaatttacaaacttaaaacgtcgaagacgaaggaggttgggagtgtaggaggttagtttagggggtttaggggtttaatcgtgactagtcggtaactaacgttacctaaacgtaaacctccgtcgtaacgttacgtttcgggaccggttacggggaactacggttacgttaggacgtaacgttaacgaaaccggttaagtcgggttacgtccgttaacgaacccg

SEQ ID NO: 379558 - DNA, 652 bp, Homo sapiens
  misc_feature: GZ8MTXP01EEBOE.52.73.G07.1.454.CMB.2.raw
tcagcgcagtacgacacgaccggtgctcgatttagctctacgctcagggggatcaggactcctcagttcaccttctcacaatgaggctccctgctcagctcctggggctgctaatgctctgggtctctggatccagtggggagattgtgatgactcagtctccactctccctgcccgtcacccctggagagacggcctccatctcctgctaggtctagtcagacgtccctcctgactaagttaagtaatggaataacgtaagttattaggattggtatcgtgacaaggaacgccgagggctacgtcctacccacgtagtccttaccgtagtactttcgtttaagttttcgggttactaaacggtcccggggtccccccgttcccggggtcctggaggtacggtttcgaggttgggactagggtgactcgaggactaactagttaatttaaacaaataaaatcgaagtacgaaggtaggtagggaggtcgtaggtaagggttagttaggggggttttaggggtttaattacgtgtactagtacgtaacgttaaacgttactaaactaaacttccgtacgtaacgttagttcggaccggaggaaccgtaagcgttaggagtaactacgaacgtacgtgttacgcgttcgtaacc

SEQ ID NO: 379559 - DNA, 602 bp, Homo sapiens
  misc_feature: GZ8MTXP01B0FA5.52.73.G07.1.454.CMB.2.raw
  modified_base (233)..(233): a, c, t, g, unknown or other
  modified_base (266)..(266): a, c, t, g, unknown or other
  modified_base (518)..(518): a, c, t, g, unknown or other
  modified_base (570)..(570): a, c, t, g, unknown or other
  modified_base (572)..(572): a, c, t, g, unknown or other
  modified_base (574)..(578): a, c, t, g, unknown or other
  modified_base (580)..(602): a, c, t, g, unknown or other
tcagcgcagtacgacacgaccggtgctcgatttagctctacgctcaggggggggagagatccccaggggtgacagccatggaccctggaagggcctgggctaggggacagggaccagagccagtccaggggagaggacagagccaatggactgggggtgtactgtaacagccctgctggtcccaggcagtgctcggcccctgctgctgctgggtctggcctagtcggtcgccntcggcctgctcgccgacccgtaagttcgggtcnccgaccgacggaaacgggcccgggggacccacggccccgtaggacgtccgtacgtagggtcggaacgcacggacccgtacgtccccgaggccccggtaggccgggtacggtcccggtagggggtcgggggacctagggacccgaacgacccccgaacggtaccccccccaacccccgtacgtaccgtcctacccgttcccgtcccgttcccccctaccctttaccctccgtaacgttaaccgcgtaccggtnttaccggggacgggccgggtcgtacggggaccaaggggccccgagtaacggngngnnnnngnnnnnnnnnnnnnnnnnnnnnnn

SEQ ID NO: 379560 - DNA, 659 bp, Homo sapiens
  misc_feature: GZ8MTXP01EVUJW.52.73.G07.1.454.CMB.2.raw
tcagcgcagtacgacacgaccggtgctcgatttagctctacgctcagggcacgaccggtgctcgatttagctctacgctcagggggtgctttccgagagtcatggacctcctgcacaagaacatgaaacacctgtggttcttcctcctcctggtggcagctcccagatgggtcctgtcccaggtgcacctacaacaggtgggcgcaggactgttgaagccttcgggagaccctgtcccctcacctgcgctggtcgagtggtcgggtccttcgagtggtcgctactgggacctggactccgccacggccccccgaggggaagggccgtggagtggtagttgggggaaatcgaaatcagtaaccgtggaaagccaattaactaacgtaaccccgtacccttaaaagagttcgagtcaccatatcagtcgacactaccaagaacctaatctacccctggaaacgtgaaggtcgtacgttaccgcccggacggggacaccgggtcctggtctaagttacctggttcgaccggtaaacggacccctccgaacgaacgtaaacgttaaaccgtaccgttccccgtagggccttacgttacgttcggtaaccggcgttaacgggggcccgtaacggggacccgtaacccggggttcctaaccccgg

SEQ ID NO: 379561 - DNA, 587 bp, Homo sapiens
  misc_feature: GZ8MTXP01DJMH4.52.73.G07.1.454.CMB.2.raw
  modified_base (204)..(204): a, c, t, g, unknown or other
  modified_base (339)..(339): a, c, t, g, unknown or other
  modified_base (472)..(472): a, c, t, g, unknown or other
tcagcgcagtacgacacgaccggtgctcgatttagctctacgctcagggcacgaccggtgctcgatttagctctacgctcagggggtgctttccgagagtcatggacctcctgcacaagaacatgaaacacctgtggttcttcctcctcctggtggcagctcccagatgggtcctgtcccaggtgcacctacaacagtggggcncaggactgttgaagccttcggacgtaccctgtccctcacctgcgctgtcgatggtgggtccttcagtgtcgctactggacctggatccgccagcccccgagggagggcgtggagtggattgggggaaatcgaatnaatacgtggaacgtccattaaactactaacccgtaccttaaagagtcgacgtcaacatatcagtcgacacgtaccaaagaaccattcacctgagtgagtctcgtaccgccgaggggacacggctgtctattcngtgacgtaaacggccctacacgaactcgaaaacctccgaccccgtggccggacttcgttacgggaacggtcgtcgggggacccgaacggggaccctaacgggttccgtaacccgg

SEQ ID NO: 379562 - DNA, 550 bp, Homo sapiens
  misc_feature: GZ8MTXP02H1Q8F.52.73.G07.1.454.CMB.2.raw
  modified_base (226)..(226): a, c, t, g, unknown or other
  modified_base (238)..(238): a, c, t, g, unknown or other
  modified_base (423)..(423): a, c, t, g, unknown or other
  modified_base (469)..(469): a, c, t, g, unknown or other
tcagcgcagtacgacacgaccggtgctcgatttagctctacgctcagggcacgaccggtgctcgatttagctctacgctcaggggtgctttccgagagtcatggacctcctgcacaagaacatgaaacacctgtggttcttcctcctcctggtggcagctcccagatgggtcctgtccccaggtgcacctacaacagtgggcgcaggactgttgaagccttcgganaccctgtccctnacctgcgctgtcgatggtggtccttcagtggtcgctactggacctggatccgccagcccccagggaagggctggagtggattggggaaatcaatcaatactggaagccattaactataacccgtccttaagatcgagtcaccatatcagtcgacacgtcaagaccaatctaccctgagtgagtcngttaccgcgcggacacgactgtctattactgtgcgaaaggccctanacgactgaaaactacgacccctggccgctaactcggaacgtcgtagggggacccaaggggaccccacgggtaccaacccgg

SEQ ID NO: 379563 - DNA, 531 bp, Homo sapiens
  misc_feature: GZ8MTXP02JJL6Q.52.73.G07.1.454.CMB.2.raw
tcagcgcagtacgacacgaccggtgctcgatttagctctacgctcagggggatcaggactcctcagttcaccttctcacatgaggctccctgctcagctcctggggctgctaatgctctgggtctctggatccagtggggagattgtgatgactcagtctccactctccctgcccgtcacccctggagagacggcctccatctcctgcaggtctagtcagagcctcctgcatagtaatggatacaagtatttggattggtatctgcagaagccgagggcagtctccacagctcctgattcttagtttgggtctaaagtcgggccccgtccggggtccctgagtaggttcagtggcaggtggatcgaggcacagtatttaacaactaaaatcaagacagagtaggaggcgtagaggtagttggtttaggggtttattacgtgcagtgactaagttactaacaaatctacgctacgtttggaccgaggggaccaagcgtaggagaagtacgaaaacgacgtggtagctcgacc

SEQ ID NO: 379564 - DNA, 589 bp, Homo sapiens
  misc_feature: GZ8MTXP02I8853.52.73.G07.1.454.CMB.2.raw
  modified_base (254)..(254): a, c, t, g, unknown or other
tcagcgcagtacgacacgaccggtgctcgatttagctctacgctcagggggatcaggactcctcagttcaccttctcacaatgaggctccctgctcagctcctggggctgctaatgctctgggtctctggatccagtggggagattgtgatgactcagtctccactctccctgcccgtcacccctggagagacggcctccatcctcctgcaggtctagtcagacgccctcctgacatagtaatggatacaagtntttggattggatctgcagaagccgaggctagtcctcgacagtcctccgtagacttccgttagtttcgggtactaagttccggggcccctcccggggtcctggacgtggttcagtggcaggtgatcgagcatagtatttacaactaaagtcagacagagtggagacgtagaggtagttggtttagggtttattacgtagtactagtgtacgtaagttactaacgtaaaacgtccgtacgtacgttacggtttacggaccggtaaacggggaacccgtaaggtcgtaggtaacgaacgtacgtaaaacgtacgttaggtcggtacttacggaacccg

SEQ ID NO: 379565 - DNA, 552 bp, Homo sapiens
  misc_feature: GZ8MTXP02HS18K.52.73.G07.1.454.CMB.2.raw
  modified_base (236)..(236): a, c, t, g, unknown or other
  modified_base (271)..(271): a, c, t, g, unknown or other
  modified_base (389)..(389): a, c, t, g, unknown or other
  modified_base (414)..(414): a, c, t, g, unknown or other
  modified_base (418)..(418): a, c, t, g, unknown or other
  modified_base (424)..(424): a, c, t, g, unknown or other
tcagcgcagtacgacacgaccggtgctcgatttagctctacgctcagggcacgaccggtgctcgatttagagagagtgtgttgggtttggggaggcttggtccagcctggtggttccctgagactctcctgtgcagcctctggattctccgtcagtagcaactacatgagctgggtccgccaggctccgagggaagggctggagtgggtctcaagttctttatgtcggtgtaccanatattatgctgactcgtgaaggccattcaccatcnccagagacgagtccaggaacagcctgtttctacaaatggacagtctgagacctgaccgacacggctgtactattactgtgcgagacggaccgagggggcgagcacgcccgttaatcgngggccgagggacccggcacccgtcncctnacgccnccacgacggcccagtccgtcctccccgtgcccaccctccaccaagcgccaccgtcgtcggggaccacgcgccggccgtcggctcgccctgggaaccaaggtaccttaccgtactacgtacgtactccg

SEQ ID NO: 379566 - DNA, 586 bp, Homo sapiens
  misc_feature: GZ8MTXP02GOO17.52.73.G07.1.454.CMB.2.raw
  modified_base (237)..(237): a, c, t, g, unknown or other
  modified_base (292)..(292): a, c, t, g, unknown or other
  modified_base (348)..(348): a, c, t, g, unknown or other
  modified_base (389)..(389): a, c, t, g, unknown or other
tcagcgcagtacgacacgaccggtgctcgatttagctctacgctcagggcacgaccggtgctcgatttagagagagtgtgttgggtttgggggaggcttggtccagcctggtggttccctgagactctcctgtgcagcctctggattctccgtcagtagcaactacatgagctgggtccgccaggctccaggggaagggctggagtgggtctcaagtctttatgtcggtggtaccanatattatgctgactcgtgaaggcattcaccatctccagagacgagtccaggaacngccttgtttctacaaatggacagtctgacgacctgacgacacggctgtctattacngtgcgagcgaacccgagggggcggagcacgcccgtaatcgngggccgacggggaacccggtcaccgtctcctcacgcctccaccgacgggcccacgtccggtccttcccccgtggccctacccctccgtacccaacgacgcctacccgtcggtcgggggaccacgacggcccggcccgtcgggcctcggccgtcggtaacgaacggtaccttaccgttcctacgtaaccgtcgtccgg

SEQ ID NO: 379567 - DNA, 561 bp, Homo sapiens
  misc_feature: GZ8MTXP02GUTZ6.52.73.G07.1.454.CMB.2.raw
tcagcgcagtacgacacgaccggtgctcgatttagctctacgctcagggggatcaggactcctcagttcaccttctcacatgaggctccctgctcagctcctggggctgctaatgctctgggtctctggatccagtggggagattgtgatgactcagtctccactctccctgcccgtcacccctggagagacggcctccatctcctgcaggtctagtcagagcctcctgcatagtaatggatacaagtattggattggtatctgcagaagccagggcagtctcacagctcctgattcttagtttgggttactaagtcggccccgtccggggtcctggagtggttcagtggcagtggatcgaggtcacagtatttaacaactaaaatcagacagagtggagcgtaggagtagttggtttaggggtttattacgtggtactagtgactaagttactaaactaaagtccgtacgtacgttacgttttggaccgtaacggggaccgaaaggtccgtaggaacggaacttaacgaaaacggtacgtaggtcggtacgtcgaacccg

SEQ ID NO: 379568 - DNA, 570 bp, Homo sapiens
  misc_feature: GZ8MTXP02F9KJY.52.73.G07.1.454.CMB.2.raw
  modified_base (214)..(214): a, c, t, g, unknown or other
  modified_base (303)..(303): a, c, t, g, unknown or other
  modified_base (384)..(384): a, c, t, g, unknown or other
tcagcgcagtacgacacgaccggtgctcgatttagctctacgctcagggcacgaccggtgctcgatttagcgagacgcgcagggcacgaccggtgctcgatttagatcgtctgtgttgggtttggggaggcttggtaaagcgggggggtatctgagactctcctgttcagtctctggattcaaccttaaataactatggcatgagctgggtccnccaggctccgagggaaggggctggagtgggtctcattatcagtggtactggtggtagcacatactacgcagactccgtgaaggccgttnaccatctaccaaagacaatccaaagaacacgctgtattacaaatgaacagctgagagccgaggacacgggcctatattacngtagtagaaagatctccacgtcctcgccccttgacttggttactttcgactcctcggggccagggaaccctagtacgccgtctccctcacgcctaccaccaaacgggcccaacgtccggtcccttccccctcggccacccctccctaccaacgacgcaccctcgtcggggcaccgacgccggcccg

SEQ ID NO: 379569 - DNA, 561 bp, Homo sapiens
  misc_feature: GZ8MTXP02IRJR8.52.73.G07.1.454.CMB.2.raw
  modified_base (222)..(222): a, c, t, g, unknown or other
tcagcgcagtacgacacgaccggtgctcgatttagctctacgctcagggggatcaggactcctcagttcaccttctcacaatgaggctccctgctcagctcctggggctgctaatgctctgggtctctggatccagtggggagattgtgatgactcagtctccactctccctgcccgtcacccctggagagacggcctccatctcctgcaggtctagtcagngcctctgcatagtaatggatacaagtattggattggtatctgcagaagccagggcagtctccacagctcctgatcttagtttgggttctaagtccgggcccctccggggtccctgacgtaggttcagtggcagtggatcgaggcacagtatttacaataaaatcagcagagtggagcgtagaggtagttggttaggggtttattacgtggctagtgactaagttactaaactaaaacgtccgtacgtacgttacgttttcgggacccgtaagggggaacccaaaggtccgttaggaaggaacttacgaaaacgtaacgtggtacggacttacggaaccc

SEQ ID NO: 379570 - DNA, 572 bp, Homo sapiens
  misc_feature: GZ8MTXP02H24YR.52.73.G07.1.454.CMB.2.raw
  modified_base (221)..(221): a, c, t, g, unknown or other
  modified_base (279)..(279): a, c, t, g, unknown or other
  modified_base (283)..(283): a, c, t, g, unknown or other
tcagcgcagtacgacacgaccggtgctcgatttagctctacgctcagggggatcaggactcctcagttcaccttctcacaatgaggctccctgctcagctcctggggctgctaatgctctgggtctctggatccagtggggagattgtgatgactcagtctccactctccctgcccgtcacccctggagagacgcctcatctcctgcaggtctagtcagancctctgcatagtatggatacaagtatttggattggtatctgcagaagcagggcagtcnccanagctctgatctagtttggttacaagtcggccccgtccggggtcctgagtagttcgagtgcagtggatcgaggcacagtattaacaactaaaatacagagaggaagtaggaagggtgaggaagggtagtttaggggtttagggggttttaattaaccgttggactagtacgtacgtaaagttacttaaaactaaactaccgtacgttacgtaccgttttaggaccgtacggggacaacgacgtaggaagaacgtaacgaaaaccgtacgttacgaggtactacgaacccg

SEQ ID NO: 379571 - DNA, 544 bp, Homo sapiens
  misc_feature: GZ8MTXP02IUI8O.52.73.G07.1.454.CMB.2.raw
  modified_base (283)..(283): a, c, t, g, unknown or other
  modified_base (402)..(402): a, c, t, g, unknown or other
tcagcgcagtacgacacgaccggtgctcgatttagctctacgctcagggggatcaggactcctcagttcaccttctcacaatgaggctccctgctcagctcctggggctgctaatgctctgggtctctggatccagtggggagattgtgatgactcagtctccactctccctgcccgtcacccctggagagacggcctccatctcctgcaggtctagtcagagcctcctgcatagtaatggatacaagtattggattggtatctgcagaagccagggcagtcnccacagctcctgatcttagtttggtctaagtccggccctccggggtcctgagtagttcagtggctagtgatcgaggcactagtatttaacaaactaaaatcaagacgaagagtaggagngtaggaggtagttgggttaggggtttatacgtgatatgacgtaagttactaactaaactcctacggtacttacggtttcggaccgtaggggaaccagccgtaggaacgtaataacgaaacgtaacgtgtacggactacgacc

SEQ ID NO: 379572 - DNA, 574 bp, Homo sapiens
  misc_feature: GZ8MTXP02JSOSJ.52.73.G07.1.454.CMB.2.raw
  modified_base (204)..(204): a, c, t, g, unknown or other
  modified_base (240)..(240): a, c, t, g, unknown or other
tcagcgcagtacgacacgaccggtgctcgatttagctctacgctcagggcacgaccggtgctcgatttagctctacgctcagggggtgctttccgagagtcatggacctcctgcacaagaacatgaaacacctgtggttcttcctcctcctggtggcagctcccagatgggtcctgtcccaggtgcacctacaacagtggggcncaggactgttgaagccttcggagaccctgtcccctnacctgcgctgtcgatggtgggtccttcagtggtcgctactggacctggatccgccagcccccagggaacggggctggagtggagttggggaaaatcaatcatactggaagccattaactactaaccgtccttaagagtcgagtcaccatatcagtcgacacgtaccaagaaccattcctaccctgaaggtgaggtctgttaccgccgcggacacggctgtactattactgtcgcgaaacggccctacacgactacgaaaacctaccggacccctggaccgcttaacgtcggaaccgtcgtcgggggaccaaggggacccacggtacctacccgg

SEQ ID NO: 379573 - DNA, 537 bp, Homo sapiens
  misc_feature: GZ8MTXP02HU755.52.73.G07.1.454.CMB.2.raw
tcagcgcagtacgacacgaccggtgctcgatttagctctacgctcagggggatcaggactcctcagttcaccttctcacaatgaggctccctgctcagctcctggggctgctaatgctctgggtctctggatccagtggggagattgtgatgactcagtctccactctccctgcccgtcacccctggagagacggcctccatctcctgcaggtctagtcagagccctcctgcatagtaatggatacaagtattggattggtatctgcagagccagggcagtctcacagctcctgattctagtttgggttactaagtcgggcccctccggggtcctgagaggttcagtggcaggtggatcgaggcacagtatttaacaactaaaatcagacagagtggaggcgtagaggtagttggtttaggggttttattacgtagtctagtgtactaagttactaaactaaatcctcgtacttacgttttcggaccgaggggaccacgtctaggagaagtacaaacgacgtgtacggcgtacgacc

SEQ ID NO: 379574 - DNA, 567 bp, Homo sapiens
  misc_feature: GZ8MTXP02JB57N.52.73.G07.1.454.CMB.2.raw
  modified_base (406)..(406): a, c, t, g, unknown or other
tcagcgcagtacgacacgaccggtgctcgatttagctctacgctcagggggatcaggactcctcagttcaccttctcacaatgaggctccctgctcagctcctggggctgctaatgctctgggtctctggatccagtggggagattgtgatgactcagtctccactctccctgcccgtcacccctggagagaccggcctccatctcctgcaggtctagtcagacgcctctgcatagtaatggatacaagtatttggattggtatctgcagaagccgagggcagtctccacagctcctgattcttagtttgggttactaacgtcgggccccgtccggggtcctgagtggttcagtggcaggtggatcgaggcacagtattaacaactaaaatcagacagagtggagngtaggaggtagttggtttaggggtttattacgtgactagtgactaagttactaaactaaatcctacgtactacgtttacgggaccgtaacggggaacctaaggaccgttaaggaacgtaacgtaacgaaaacgtacgtacggtacgacgtacggtaacccg

SEQ ID NO: 379575 - DNA, 602 bp, Homo sapiens
  misc_feature: GZ8MTXP02I2ZKS.52.73.G07.1.454.CMB.2.raw
  modified_base (247)..(247): a, c, t, g, unknown or other
  modified_base (253)..(253): a, c, t, g, unknown or other
  modified_base (288)..(288): a, c, t, g, unknown or other
  modified_base (292)..(292): a, c, t, g, unknown or other
  modified_base (447)..(447): a, c, t, g, unknown or other
tcagcgcagtacgacacgaccggtgctcgatttagctctacgctcagggggatcaggactcctcagttcaccttctcacaatgaggctccctgctcagctcctggggctgctaatgctctgggtctctggatccaggtggggagattgtgatgactcagtctccactctccctgcccgtcacccctggagagaccggcctccatctcctgcaggtctagtcagacgcctctgcatagtaatggatanaagttnttggattggtatctgcagaagccgagggcagtccnccanagctcctgattcgttagtttcggggttactaaggtccggggcccccgttcccgggggtccctggaaggtcggttaccgagggtggggctaagggtggactcgaaggtcaaacgtaagttatttaaacaaactaaaatcaagcgagaggtggaagngtaggtagggtagttgggtttaggggtttattacgtgtactagtagtacgtaagttactaaactaaatcctacgtactacgtttacggaccggtagggaaccgtagacgtaggaagaacgtaacgaaaacggtacgttggacggtctacggtacc

SEQ ID NO: 379576 - DNA, 616 bp, Homo sapiens
  misc_feature: GZ8MTXP02JCTCW.52.73.G07.1.454.CMB.2.raw
  modified_base (250)..(250): a, c, t, g, unknown or other
  modified_base (435)..(435): a, c, t, g, unknown or other
tcagcgcagtacgacacgaccggtgctcgatttagctctacgctcagggggatcaggactcctcagttcaccttctcacaatgaggctccctgctcagctcctggggctgctaatgctctgggtctctggatccaggtggggagattgtgatgactcagtctccactctccctgcccgtcacccctggagagacggcctccatctcctgcaggtctagtcagacgcctctgcatagtaatggatacagtnttggattggtatctgacagaagccgagggctagtcctcacacgctcctgattcttagtttgggtacctaaggtcccggggccccgttccggggtcctaggtacggtaggttcaggtgggactaggtggatcgaggtacactaagtactttaacaaactaaaagtcaagtacgaggaggtaggagngtaggaggtagttagggtttagggtttattacgtcgtatagtacgtaacgtaacgttactaaacgtaaacctccgtaccgtacgttacggtttacgggaaccggttaacgggggaaacctaggtaccgttaggaaacgtaacgtaaccgaaaacgtacgtaggtacgtcgtacgtaacccg

SEQ ID NO: 379577 - DNA, 616 bp, Homo sapiens
  misc_feature: GZ8MTXP02GUGZZ.52.73.G07.1.454.CMB.2.raw
  modified_base (204)..(204): a, c, t, g, unknown or other
tcagcgcagtacgacacgaccggtgctcgatttagctctacgctcagggcacgaccggtgctcgatttagctctacgctcagggggtgctttccgagagtcatggacctcctgcacaagaacatgaaacacctgtggttcttcctcctcctggtggcagctcccagatgggtcctgtcccaggtgcacctacaacagtggggcncaggactgttgaagccttcggagaccctgtccctcacctgcgctgtcgatggtggtccttcagtggtcgctactggacctggactccgccagcccccagggaagggctggagtggagttggggaaatcaatcaatactggaagcctagttaactactaaaccgtcctaagagtcgagtacaccatactacagtacgacaccgtaccaaacgaaaccaacttactaccctacgaaggtcgaggtctcgttaaccgccgacggacgacggctgtctattactgtgacgaacggtccctacacgtactacgaaaacgtaccgtacccccgaggtaccgacgttacgtacgggtaaccggtaccggttacgggggacccggaaacggggacccgtaccgggtacccgtaaccccgg

SEQ ID NO: 379578 - DNA, 657 bp, Homo sapiens
  misc_feature: GZ8MTXP02JTRPH.52.73.G07.1.454.CMB.2.raw
  modified_base (239)..(239): a, c, t, g, unknown or other
tcagcgcagtacgacacgaccggtgctcgatttagctctacgctcagggggatcaggactcctcagttcaccttctcacaatgaggctccctgctcagctcctggggctgctaatgctctgggtctctggatccagtggggagattgtgatgactcagtctccactctccctgcccgtcacccctggagagaccggcctccatctcctgcaggtctagtcagacgcctctgcatagtanggatacagtattggattggtatctgacagaacgccgagggcagtcctaccacacgctcctgattcttagtttcgggttactaacggtccggggtcccccgtcccggggtcctaggacggtacggttcgaggttcgggacgtaggtggactcgagggcaacgtaagttaacttttaaacaaacttaaaactcgaagtacgaaggtaggtagggacggtacgtaggtaagggttaggtttaggggtttaggggtttattacggtgacgtaagtgaacgttaagttacctaaacgtaaaacttcccgtacgttaccgttacgtttacgggaacccggtaaggggtaaccctaacggtacggttaacggggaactaaacgttaacccgaaaacgtacggtggtacggtactacggtaacccg

SEQ ID NO: 379579 - DNA, 559 bp, Homo sapiens
  misc_feature: GZ8MTXP02JKL75.52.73.G07.1.454.CMB.2.raw
  modified_base (378)..(378): a, c, t, g, unknown or other
tcagcgcagtacgacacgaccggtgctcgatttagctctacgctcagggggatcaggactcctcagttcaccttctcacaatgaggctccctgctcagctcctggggctgctaatgctctgggtctctggatccagtggggagattgtgatgactcagtctccactctccctgcccgtcacccctggagagaccggcctccatctcctgcaggtctagtcagagcctctgcatagtaatggatacaagtattggattggtatctgcagaagccagggcagtctaccacagctccgtgattcttagtttggggtactaacgtccgggaccccctccggggtccctgaggtacggttcaggtgcaggtggatcgaggcanagtatttaacaactaaaatcaagacgtaggaggtaggagggactaggaggtagttgggtttaggggtttaattacgtggactagtggactaagttactaaccgtaaatccgtacgtacgtacgtttcggaccgtaagggaccaacgcgtaggagaatacgaaacgactacgtagctagacc

SEQ ID NO: 379580 - DNA, 561 bp, Homo sapiens
  misc_feature: GZ8MTXP02I29OI.52.73.G07.1.454.CMB.2.raw
  modified_base (338)..(338): a, c, t, g, unknown or other
  modified_base (366)..(366): a, c, t, g, unknown or other
tcagcgcagtacgacacgaccggtgctcgatttagctctacgctcagggcacgaccggtgctcgatttagctctacgctcagggggtgctttccgagagtcatggacctcctgcacaagaacatgaaacacctgtggttcttcctcctcctggtggcagctcccagatgggtcctgtcccaggtgcacctacaacagtggggcgcaggactgttgaagccttcggagaccctgtccctcacctgcgctgtcgatggtgggtccttcagtggtcgctactggacctggatccgccagccccagggaagggctggagtggatggggaaatcaatcatacnggaagcattaactataaccgtcctaagngtcgagtcaccatatcagtcacacgtccaagaaccaaattctaccctgaaggtgaggtctcgttaccgccgtcggacacggctgtctattacgtgtcgacgaaacggccctacgacgtatacgaaaacctaccgccccgtggcgactagtcggaaccgtcgtcggggaccaaggggtacccacggtcctacccgg

SEQ ID NO: 379581 - DNA, 638 bp, Homo sapiens
  misc_feature: GZ8MTXP02IFDNJ.52.73.G07.1.454.CMB.2.raw
  modified_base (204)..(204): a, c, t, g, unknown or other
  modified_base (401)..(401): a, c, t, g, unknown or other
tcagcgcagtacgacacgaccggtgctcgatttagctctacgctcagggcacgaccggtgctcgatttagctctacgctcagggggtgctttccgagagtcatggacctcctgcacaagaacatgaaacacctgtggttcttcctcctcctggtggcagctcccagatgggtcctgtcccaggtgcacctacaacagtggggcncaggactgttgaagccttcggagacccctgtccctcacctgcgctgtcgatggtggtccttcagtggtcgctacgtggacctggactccgccacgcccccgaggggagggctggagtggagttggggaaatcgaatcaatacgtggaagccaattaactactaacccgtcccttaaagacgtcgacgtcaccatacncgagtcgacacgtaccaaagaacctaattcctaccctagaaaggtcgaacggttctcgttaccgccgcggacacggctgtctattacgtgtgacgaaacggccctacgacggtaactacgaaaacctcccgtaccccgtagggaccgacgttaacgcggggtaaacccggtttccggtaccgggggtacccgaaaacgggggacccccgtaaccggggttacccgtaaacccccggg

SEQ ID NO: 379582 - DNA, 606 bp, Homo sapiens
  misc_feature: GZ8MTXP02JIYD3.52.73.G07.1.454.CMB.2.raw
  modified_base (420)..(420): a, c, t, g, unknown or other
tcagcgcagtacgacacgaccggtgctcgatttagctctacgctcagggggatcaggactcctcagttcaccttctcacaatgaggctccctgctcagctcctggggctgctaatgctctgggtctctggatccagtggggagattgtgatgactcagtctccactctccctgcccgtcacccctggagagacggcctccatctcctgcaggtctagtcagacgcctcctgcatagtaatggatacaagtatttggattggtatctgacagaagccgagggcagtcctcacagctcctgattcttagtttgggttactaaaggtccgggccccgttcccggggtccctgagtaggttcaggtggcaggtggatcgaggcaagagtatttaacaaataaaatcagtacagaggtaggaggntgaagggtagttgggtttaggggtttattacgtggtactagttaggacttaaagttactaaactaaaacgttcccgtacgttacttaacggttttcgggaacccggaaagggggtaacccgaaggtaccgttaagggaagaacgtaacgaaaaccggtaaacgtaggtacggtcgtacgtaacccg

SEQ ID NO: 379583 - DNA, 706 bp, Homo sapiens
  misc_feature: GZ8MTXP02GKTKL.52.73.G07.1.454.CMB.2.raw
  modified_base (223)..(223): a, c, t, g, unknown or other
tcagcgcagtacgacacgaccggtgctcgatttagctctacgctcagggggatcaggactcctcagttcaccttctcacaatgaggctccctgctcagctcctggggctgctaatgctctgggtctctggatccagtggggagattgtgatgactcagtctccactctccctgcccgtcacccctggagagacgcctccatctcctgcaggtctagtcagacncctcctgcatagtaatggatacaagttattggattggtatctgacagaacgccgagggcagtcctccacagtctcctgtacttcttagtttggggttactaaacggtccggggtcccccgttcccgggggtccctaggtaacggtcggtttaccgagggtggggtaccgagggttgggatccggagggacctaaacgtaacgttaactttttaaaccaaacttaaaaaagtccgtaacggtacgaacgggtaagggttaggggaagggtacgtagggtaagggtaggtttaggggttttagggggttttaattacggttagtaccgtaagttaggtacgttaaacgtttaactaactaaaacttccgttaccgtacgtttacgtttacgggacccggtaaacggggaaacccgtaggtaccgtagggtaaacgtaaacgtaacgaaaaccggtacgttaggtacgggtactacggtaaccccg

SEQ ID NO: 379584 - DNA, 611 bp, Homo sapiens
  misc_feature: GZ8MTXP02GD16Y.52.73.G07.1.454.CMB.2.raw
  modified_base (237)..(237): a, c, t, g, unknown or other
  modified_base (244)..(244): a, c, t, g, unknown or other
  modified_base (293)..(293): a, c, t, g, unknown or other
tcagcgcagtacgacacgaccggtgctcgatttagctctacgctcagggcacgaccggtgctcgatttagagagagtgtgttgggtttgggggaggcttggtccagcctggtggttccctgagactctcctgtgcagcctctggattctccgtcagtagcaactacatgagctgggtccgccaggctccgagggaaggggctggagtgggtctcaagtctttatgtcggtgtaccanatattangctgactcgtgaaggccattcaccatctccagagacgagtccaggaacngcctgtttctcaaatggacagtctggacacctgacgacgacggctcgtactattacgtgtgacgagacggaacccgggagggggccggagccgacgtccccgttaaagtcgtcggggaccgacggggaacccggtcacccgtcctcctcgacgccctaccaaccgaacgggtccctacgttcgtcccgttcccccgtcggacccaccccctcctaccgaaacgccgaccaccgtcggcggggaccacgcggccggcccgtcgggcctcggccgtaggtaaccgaacggtaccttaccttaccgtacgtacgtactccg

SEQ ID NO: 379585 - DNA, 463 bp, Homo sapiens
  misc_feature: GZ8MTXP02IKP7I.52.73.G07.1.454.CMB.2.raw
  modified_base (286)..(286): a, c, t, g, unknown or other
  modified_base (298)..(298): a, c, t, g, unknown or other
  modified_base (409)..(409): a, c, t, g, unknown or other
  modified_base (449)..(463): a, c, t, g, unknown or other
tcagcgcagtacgacacgaccggtgctcgatttagctctacgctcaggggggagagatccccaggggtgacagccatggaccctggaagggcctgggctagggacagggaccagagccagtccagggagaggacagagccaatggactggggtgtactgtaacagccctgctggtcccaggcagtgctggcccctgctgctgctgggtctggccatcggtcgcccatggcctgctgccgcccaatggttgccaccgcgaaacggccggggacccagaccctggacncctgagtggaancagccgatccagccgtggcggagccgtggtcgggcaggtccacggacccgaacggcccccaaacccccgctcgtccacttccttcgttcccccaccctctactactaccgntccgcgtgacgccggctaggaccgaaaggcgacgatacgnnnnnnnnnnnnnnn

SEQ ID NO: 379586 - DNA, 560 bp, Homo sapiens
  misc_feature: GZ8MTXP02F7IM0.52.73.G07.1.454.CMB.2.raw
  modified_base (204)..(204): a, c, t, g, unknown or other
  modified_base (475)..(475): a, c, t, g, unknown or other
tcagcgcagtacgacacgaccggtgctcgatttagctctacgctcagggcacgaccggtgctcgatttagctctacgctcagggggtgctttccgagagtcatggacctcctgcacaagaacatgaaacacctgtggttcttcctcctcctggtggcagctcccagatgggtcctgtcccaggtgcacctacaacagtggggcncaggactgttgaagccttcggagaccctgtccctcacctgcgctgtcgatggtggtcttcagtggtcgctactggacctggatccgccacgcccccgagggaagggctggagtggagttggggaaatcaatcatacgtggaagccattaactataacccgtcctaagagtcgagtcaccatatcagtcacacgtaccaaagaacaattctacctgaacgtgagctgtaccgcgcgacacgctgtatacttctgtgacgaaacggcccctanaccgtatacgaaaacctccgtaccccgtggccgtctagtcggaacgtcgtacgggggaccaacgggacctacgggtctaacccgg

SEQ ID NO: 379587 - DNA, 592 bp, Homo sapiens
  misc_feature: GZ8MTXP02JCGHX.52.73.G07.1.454.CMB.2.raw
  modified_base (204)..(204): a, c, t, g, unknown or other
  modified_base (240)..(240): a, c, t, g, unknown or other
tcagcgcagtacgacacgaccggtgctcgatttagctctacgctcagggcacgaccggtgctcgatttagctctacgctcagggggtgctttccgagagtcatggacctcctgcacaagaacatgaaacacctgtggttcttcctcctcctggtggcagctcccagatgggtcctgtcccaggtgcacctacaacagtggggcncaggactgttgaagccttcggagaccctgtcccctnacctgcgctgtcgatggtgggtccttcgagtggtcgctactggacctggactccgccacgcccccaggggaacgggctggagtggagttaggggaaatcgaatcagtactaggaacgcgtaattaactactaacccgtccgttaagacgtcgatcaccatatcagtcaacacgtaccaacgaaccaattcctaccctagaaggtgagtctcgttacccgcgcggacgacgctcgtctagttccgtgtgacgaaacggccctacgacgactacgaaaactaccgccccgtggccgtactacgtcggaaccgtcggtacggggacccgaagggacccgacggtaccgtacccgg

SEQ ID NO: 379588 - DNA, 564 bp, Homo sapiens
  misc_feature: GZ8MTXP02HNAKU.52.73.G07.1.454.CMB.2.raw
  modified_base (287)..(287): a, c, t, g, unknown or other
  modified_base (370)..(370): a, c, t, g, unknown or other
  modified_base (389)..(389): a, c, t, g, unknown or other
tcagcgcagtacgacacgaccggtgctcgatttagctctacgctcagggggatcaggactcctcagttcaccttctcacaatgaggctccctgctcagctcctggggctgctaatgctctgggtctctggatccagtggggagattgtgatgactcagtctccactctccctgcccgtcacccctggagagacggcctccatctcctgcaggtctagtcagagccctctgcatagtaatggatacaagtattggattggtatctgcagaagccagggcagtctccanagctcctgatcttagtttgggttactagtccgggcccctccggggtcctggagtaggttcaggtggcaggtggatcgaggcanagtatttaacaactaaaancagacgagagtaggagcgtaggaggtagttgggtttaggggttttattacgtggtactagtacgactaagttactaactaaacgtcctacgtacgttacgtttacggaccgtacggggaaccaagtccgtaggaacgtaactaacgaaaacgtaacgtgtacggtactacgaccg

SEQ ID NO: 379589 - DNA, 719 bp, Homo sapiens
  misc_feature: GZ8MTXP02HHREK.52.73.G07.1.454.CMB.2.raw
  modified_base (222)..(222): a, c, t, g, unknown or other
tcagcgcagtacgacacgaccggtgctcgatttagctctacgctcagggggatcaggactcctcagttcaccttctcacaatgaggctccctgctcagctcctggggctgctaatgctctgggtctctggatccagtggggagattgtgatgactcagtctccactctccctgcccgtcacccctggagagacggcctccatctcctgcaggtctagtcagngccctctgcatagtaatggatacaagtatttggattggtatctgcagaagccgagggcagtctccacagtctccgtgtacttcgttagtttggggttactaacggtccggggtccccccgttcccgggggtccctaggtacggtacgggtttccgaagggttcggggaccgtagggttgggaacttcgaagggacctaaaccgtaagttaaactttttaaaccaaaacttaaaaaaacgttcgtaaacgtaccgaaagggtaagggtagggtaagggtacgtagggtaaagggttagtttaggggtttagggggtttttaacttacgtgggtacctagttacgtaacgttaaacggtttacgtaaacctaaaacgttccgttaccggtacgttaacggttttccgggaacccggtaaacgggggaacctaacggtccgttagggaacgtaacgttaacgaaaaccggtacgtacggtccgggtacttacggaacccg

SEQ ID NO: 379590 - DNA, 554 bp, Homo sapiens
  misc_feature: GZ8MTXP02F9LMW.52.73.G07.1.454.CMB.2.raw
  modified_base (204)..(204): a, c, t, g, unknown or other
  modified_base (427)..(427): a, c, t, g, unknown or other
  modified_base (507)..(507): a, c, t, g, unknown or other
tcagcgcagtacgacacgaccggtgctcgatttagctctacgctcagggcacgaccggtgctcgatttagctctacgctcagggggtgctttccgagagtcatggacctcctgcacaagaacatgaaacacctgtggttcttcctcctcctggtggcagctcccagatgggtcctgtcccaggtgcacctacaacagtggggcncaggactgttgaagccttcggagaccctgtccctcacctgcgctgtcgatggtggtccttcagtggtcgctactggacctggatccgccacgcccccaggggaacggggctggagtggagttggggaaatcaatcatactggaagccagtaactactaacccgtccttaagacgtcgagtacacatatcagtacacacgtccaagaacatctacctagagtgngtctgtaccgcgacgacgacgctgtctattactgtgacgaacggccctcaacgatacgaaaacctccgacccctcggacnctaagtcggaacgtcggtcgggaccaaggggaccaacggtctacccg

SEQ ID NO: 379591 - DNA, 739 bp, Homo sapiens
  misc_feature: GZ8MTXP02G5H09.52.73.G07.1.454.CMB.2.raw
  modified_base (185)..(185): a, c, t, g, unknown or other
  modified_base (203)..(203): a, c, t, g, unknown or other
  modified_base (226)..(226): a, c, t, g, unknown or other
  modified_base (238)..(238): a, c, t, g, unknown or other
tcagcgcagtacgacacgaccggtgctcgatttagctctacgctcagggcacgaccggtgctcgatttagctctacgctcagggggtgctttccgagagtcatggacctcctgcacaagaacatgaaacacctgtggttcttcctcctcctggtggcagctcccagatgggtcctgtcccaggtncacctacaacagtgggcncaggactgttgaagccttcgganaccctgtccctnacctgcgctgtcgagtggtcggtccttcgagtggtcgctacgtcggacctggactcccgaccacgacccccgaaggggaacgggctgggagtcggagttaggggaaatcgaatccagtacgtaggaagcctaattaaactataaccccgtaccttaaagacgtccgaagttcacccgtatacttacgacgttaccgaaccaccgttaacccaaacgtaaaccctaaacgttaccttacccctagggtaaacggttcggtaaacgggttccgtacggtttaacccgcccgggtaccggtaaccgtacgggtaccttcgggttaccttaacgttaacgttcggtacggtaacggaaacggtacccctacgaaacgtaactaacggaaaacccgtaccggtaccccgtacgggacccgtacgttaacggtaccgggtaaccgttaccgggaccgggggaaaccctaacgggggacccctacgggggtaacccttaacccccggg

SEQ ID NO: 379592 - DNA, 689 bp, Homo sapiens
  misc_feature: GZ8MTXP02I5AQW.52.73.G07.1.454.CMB.2.raw
  modified_base (213)..(213): a, c, t, g, unknown or other
  modified_base (243)..(243): a, c, t, g, unknown or other
  modified_base (253)..(253): a, c, t, g, unknown or other
  modified_base (273)..(273): a, c, t, g, unknown or other
tcagcgcagtacgacacgaccggtgctcgatttagctctacgctcagggcacgaccggtgctcgatttagctctacgctcagggcacgaccggtgctcgatttagagctcacgtattgggtttggggagcttggtccagcctggtggttccctgagactctcctgtgcagcctctggattctccgtcagtagcaactacatgagctgggtccncaggctcgagggaagggctggagtggtctnaagtctttanggtcggtgtaccacatatangctgactccgtagaacggccattcaccatcctacagacgacgagtccaaggacagtcctgtttacaccaaagtggactaggtctacggacgaccgtcgaccgaacgaccgggtcttacggtaccttaattaacgtgtcggacgaaggaaccggaacccggaggggggccggaacgccgtaaccggacccccgttaaacgttccggaccgggggtacccgaaccgggggtaaccccgggtcccgtaacccgggttccctaacccgttccgacgccccgtacccgaaccgaaaccggggcccctaacggttcccgggttccccttcccccggtacggtcccccaccccttcccgaccaaccggtaccgaacccgtacccgtcggtaccgggggccaaccggaccggtcccggtcccgg

SEQ ID NO: 379593 - DNA, 657 bp, Homo sapiens
  misc_feature: GZ8MTXP02IV9FQ.52.73.G07.1.454.CMB.2.raw
  modified_base (240)..(240): a, c, t, g, unknown or other
tcagcgcagtacgacacgaccggtgctcgatttagctctacgctcagggcacgaccggtgctcgatttagctctacgctcagggggtgctttccgagagtcatggacctcctgcacaagaacatgaaacacctgtggttcttcctcctcctggtggcagctcccagatgggtcctgtcccaggtgcacctacaacagtggggcgcaggactgttgaagccttcggagaccctgtcccctnacctgcgctgtcgatggtgggtccttcagtggtcgctactggacctggatccgccagcccccaggggaacggggctgggagtggagttggggaaatcatcatactaggagccagttaactactaacccgtacccttaacgagtcgtacgtcaccactatacagtcgacacgtaccaagaaccaattacctaccctacgaaggtgaggtactcgttaaccgccgtcggaccgacggtcgtggtacctacgttactcgtggtacggaaacggtaccccgtacgaacgaacgtacggaaaaaccgtaacccggtaacccccgttcgggaccggtacccgtaacgttacggggaaccggttccggttcgggggtacccggaaacggggaccccggtaaaccgggtcccgttaaacccccgg

SEQ ID NO: 379594 - DNA, 691 bp, Homo sapiens
  misc_feature: GZ8MTXP02HMQ9C.52.73.G07.1.454.CMB.2.raw
  modified_base (244)..(244): a, c, t, g, unknown or other
tcagcgcagtacgacacgaccggtgctcgatttagctctacgctcagggggatcaggactcctcagttcaccttctcacaatgaggctccctgctcagctcctggggctgctaatgctctgggtctctggatccagtggggagattgtgatgactcagtctccactctccctgcccgtcaccctggagagacggcctcatctcctgcaggtctagtcagagccctcctgcatagtaatggatanaagttattgattggtatctgcaagaacgccgaggctagtcctaccactacgccttccgtagtatttcctttaggttttcggggttacctaaacggttcccggggtccccccggtttccccgggggtccctagggtaacggttagggtttaccgagggtcgggtacgtaagggttcggacttaccgggaaggcctaaacgtaaagtttaactttttaaaacctaaaacttaaaaaactccgtaagacgaagggtaggttagggaggtacgtaggaaggttagtttgggtttaggggttttatacgtgtatagtagtacttaagttactaaacgtaaaacttctaccgtacgttacggtttacgggacccggaacggggtaaccaaaggtccgttaaggaacgtaacgtaaacgtaaaacgtaaccggttggtaccggcttacggaacc

SEQ ID NO: 379595 - DNA, 722 bp, Homo sapiens
  misc_feature: GZ8MTXP02GLJ54.52.73.G07.1.454.CMB.2.raw
  modified_base (250)..(250): a, c, t, g, unknown or other
  modified_base (287)..(287): a, c, t, g, unknown or other
tcagcgcagtacgacacgaccggtgctcgatttagctctacgctcagggggatcaggactcctcagttcaccttctcacatgaggctccctgctcagctcctggggctgctaatgctctgggtctctggatccagtggggagattgtgatgactcagtctccactcctccctgcccgtcaccctggagagacggcctccatctcctgcaggtctagtcagacgcctcctgcatagtatggatacaagttnttggattggtatctgcagaagccgaggcagtctccanacgctcctgtacttctttagttcgggttactaacggtccggggcccccgttcccggggtcctggacgtacgggtttcagggtcgggacgtagggttcggacgttcgaacgggcctaaacgtaaaggttaacgtttttaaaccaaaccgttaaaaaactccgtaaagtacgaagggtaaggtaggggacgggtacgtaggggtaaggttaggtttagggtttacgggggtttttaattacgttggtacgtaaagttacggtaaccgttaaaacgttaacccgttaaaactaaaacccgtttccgtaacccgttaccgttaaccggtttttaccggggacccggttaaacgggggaaacccgtacggtaccgtaaggggtaacgtaacgttaaccgtaaaaacggttacgtacggtacggtaccgtacggtaacccg

SEQ ID NO: 379596 - DNA, 569 bp, Homo sapiens
  misc_feature: GZ8MTXP02FGR9V.52.73.G07.1.454.CMB.2.raw
  modified_base (203)..(203): a, c, t, g, unknown or other
  modified_base (239)..(239): a, c, t, g, unknown or other
  modified_base (264)..(264): a, c, t, g, unknown or other
  modified_base (311)..(311): a, c, t, g, unknown or other
  modified_base (418)..(418): a, c, t, g, unknown or other
  modified_base (455)..(455): a, c, t, g, unknown or other
  modified_base (483)..(483): a, c, t, g, unknown or other
  modified_base (526)..(526): a, c, t, g, unknown or other
tcagcgcagtacgacacgaccggtgctcgatttagctctacgctcagggcacgaccggtgctcgatttagctctacgctcagggggtgctttccgagagtcatggacctcctgcacaagaacatgaaacacctgtggtcttcctcctcctggtggcagctcccagatgggtcctgtcccaggtgcacctacaacagtggggcncaggactgttgaagccttggagacccctgtcccctnacctgcgctgtcgatggtggtcctnagtggtcgctactgacctggatccgcacgccccagggaagggctggngtggagtggggaaatcaagtcagtactggaagccaagttaacagttaaccccgtacctaagagtcgagctaccatactcacgtcgacacgtccaaagaaaccattcnccctagaagcgtgtactagttaccgcgcgacacggtntgtctattacagtgacgaaaggcccctnaaccggattaacggaaaccttacgacccccgtggaccgtacgntacggaacgttcgacggggacgaacggaccacgggtcacccgg

SEQ ID NO: 379597 - DNA, 595 bp, Homo sapiens
  misc_feature: GZ8MTXP02IYI9X.52.73.G07.1.454.CMB.2.raw
  modified_base (205)..(205): a, c, t, g, unknown or other
  modified_base (241)..(241): a, c, t, g, unknown or other
tcagcgcagtacgacacgaccggtgctcgatttagctctacgctcagggcacgaccggtgctcgatttagctctacgctcagggggtgctttccgagagtcatggacctcctgcacaagaacatgaaacacctgtggttcttcctcctcctggtggcagctcccagatgggtcctgtccccaggtgcacctacaacagtggggcncaggactgttgaagccttcggagaccctgtcccctnacctgcgctgtcgatggtgggtccttcagtggtcgctactggacctggatcccgccagcccccaggggaagggctggagtggagttggggaaatcaatcaatactggagccattaactataaccccgtccttaagagtcgagtcaccatatcagtcgacacgtaccaaagaaccaattcctacctgaaggtgagtctcgttaccgccgcgacacggctgtactattactgtagtacggaaacgtccctcaacgtactacggaaaacttacccggacccctagggaccgtacgtaacgtcggtaacgttccggtacgggggacccgtaacgggaccccgacgggtacctacccgg

SEQ ID NO: 379598 - DNA, 735 bp, Homo sapiens
  misc_feature: GZ8MTXP02HOTDF.52.73.G07.1.454.CMB.2.raw
  modified_base (205)..(205): a, c, t, g, unknown or other
tcagcgcagtacgacacgaccggtgctcgatttagctctacgctcagggcacgaccggtgctcgatttagctctacgctcagggggtgctttccgagagtcatggacctcctgcacaagaacatgaaacacctgtggttcttcctcctcctggtggcagctcccagatgggtcctgtcccaggtgcacctacaacaggtggggcncaggactgttgaagccttcggagaccctgtccctcacctgcgctgtcgagtggtggtccttcagtggtcgctacgtggacctggactccgccacggcccccgaggggaacgggcgtgggagtggagttaggggaaatcaatcatactggaagctaataactactaaccgtccttaagagtcgacgtacactaatatacgagtccgaaccaaccgtaccaaagaaccctaatttcccgtacccgtaggtaacggttcggtaacgggttccgttacggttaaaccccggcccgggtaccgggtaaccgtaccggggtacttaccgggttacttaacgtttaacccgttggggtacggtaccggaaaaccggggtcccccttaaccgaaacggtaaacgtaaccgggaaaaaacctttcccgggacccccgttcgggaccgtacccgttaaaggtccggggtaaccggttaccgggacgggggtacccgaaaacgggggtcccccgaaccggggtttaaccccgtacccccgg

SEQ ID NO: 379599 - DNA, 704 bp, Homo sapiens
  misc_feature: GZ8MTXP02F4GNH.52.73.G07.1.454.CMB.2.raw
  modified_base (204)..(204): a, c, t, g, unknown or other
  modified_base (289)..(289): a, c, t, g, unknown or other
tcagcgcagtacgacacgaccggtgctcgatttagctctacgctcagggcacgaccggtgctcgatttagctctacgctcagggggtgctttccgagagtcatggacctcctgcacaagaacatgaaacacctgtgttcttcctcctcctggtgcagctcccagatgggtcctgtcccaggtgcacctacaacgaggtggggcncaggacttggttagaacgtccttcggacgtaccctgtcccctcacctgcgctgtcgtagtggtggtccttgagtggtcgctacgnggacctggactcccgccacgcccccgaggggaagggctgggagtggtagttagggaaatcgaatcatacgaggacgctaaattaacctaacgtaaccccgttaccgtaaagacgttacgacgtacaacctatactacgaacgtcaaactacgtaaccaaagaaaccctaattcccgtacccgtaggtaacggtgtacggttaccgttacggttaccccggaccggaccggtaaccgtaccggtaccttaggtaccttaacgtttacgtcgggttacggaaaccggtaaaccggtccccgtaacgaacggtaactaaaccggtaaaaaccgtccccggtaccccgtggggaccctacgtacgttacggaaccggttcgacggggaaccgtaacggaccgtaccggtactacccccg

SEQ ID NO: 379600 - DNA, 685 bp, Homo sapiens
  misc_feature: GZ8MTXP02JD9XM.52.73.G07.1.454.CMB.2.raw
  modified_base (204)..(204): a, c, t, g, unknown or other
tcagcgcagtacgacacgaccggtgctcgatttagctctacgctcagggcacgaccggtgctcgatttagctctacgctcagggggtgctttccgagagtcatggacctcctgcacaagaacatgaaacacctgtggttctcctcctcctggtggcagctcccagatgggtcctgtcccaggtgcacctacaacaggtggggcncaggactgttgaagccttcggacgaccctgtccctcacctgcgctgtcgagtggtgggtccttcgagtggtcgctacgtggacctggactccgccacgcccccgaggggaacgggcgtgggacggtggagttaggggaaaatcgaatcaagtacgaggaagacctaataactactaacccgtctaagagtcgagtcacctatactacacgtacgaacctaccgaccaaaacgaaccctaactttccctacccgtagaacggttacgaacggttccgtacggttaccccggaccggacggaaccgtaccggtacttcggttacgttaaacttcgttaggtacggtacgaaaccgggtcccctacgaacgtaacgtaaacggtaaaacccgtcccggaaccccttgggacccgtacttacggacggtaaccggtacgggtacggggacccgtaacggggacccgtaaccgggtcctaccccgg

SEQ ID NO: 379601 - DNA, 682 bp, Homo sapiens
  misc_feature: GZ8MTXP02H6JXI.52.73.G07.1.454.CMB.2.raw
  modified_base (256)..(256): a, c, t, g, unknown or other
tcagcgcagtacgacacgaccggtgctcgatttagctctacgctcagggggatcaggactcctcagttcaccttctcacaatgaggctccctgctcagctcctggggctgctaatgctctgggtctctggatccagtggggagattgtgatgactcagtctccactctccctgcccgtccaccctggagagacggcctccatcctcctgccaggtctagtcagacgcctcctgctatagtaatggatacgaagttnttagattggtatcgtgacgagaacgccgagggctacgtctaccacagtccctctagtattacgtttagtttcggggttacttaacggtccgggtccccccgttacccgggggtccctagggtacgtagggtttcagggtcggggccgtaggtggtacttcgaaggctaacgtaagttaacttttaaacaaaaccgttaaaaatccgaaagcaaggtaaggttgggaaggtacgtaggtaaggtagtttaggggtttacggggtttaattacggtcgtagtaagtgtaactaagttaacctaactaaaaccgtccgtacgtaaccgttacggtttacggaccgggttaaacggggaacctaaaggtcgtaaggaaacgtaaacttaaaccggaaaacgtacggttaggcggtacgtacgttaacccg

SEQ ID NO: 379602 - DNA, 646 bp, Homo sapiens
  misc_feature: GZ8MTXP02IFMJX.52.73.G07.1.454.CMB.2.raw
  modified_base (143)..(143): a, c, t, g, unknown or other
  modified_base (435)..(435): a, c, t, g, unknown or other
  modified_base (452)..(452): a, c, t, g, unknown or other
tcagcgcagtacgacacgaccggtgctcgatttagctctacgctcagggggatcaggactcctcagttcaccttctcacaatggggctccctgctcagctcctggggctgctaatgctctgggtctctggatccaggtggganattgtgatgactcagtctccactcctccctgcccgtcacccctggagagaccggcctcatctcctgcaggtctagtcagacgcctctgacatagtatggatacgtaagttattggattggatctgacagacgcgagggctacgtccaccacagcctccgtgtacttcgtttagtttggtactaacgtccggggtcccgttccccggggtccctaggaggtcggtttacgaggttcggcgtaggttaggacttcgaggcctaacgtagttaacttttaaacaaacttaaaaancgaagacgtagtagggnggagtagtaggaggtagtttgggtttacggggtttaatttacgtggtactagttcgacgtaagtttacaaacgtaaacttccgtacgttacgttacggtttacggccggaaacgggtacccgaaggttaccgtacgggaaatacgtaaacgtaaaccggtaaacgttggtacggtacgttacgaaccgtaaccg

SEQ ID NO: 379603 - DNA, 591 bp, Homo sapiens
  misc_feature: GZ8MTXP02JBTLG.52.73.G07.1.454.CMB.2.raw
  modified_base (250)..(250): a, c, t, g, unknown or other
  modified_base (263)..(263): a, c, t, g, unknown or other
  modified_base (288)..(288): a, c, t, g, unknown or other
  modified_base (434)..(434): a, c, t, g, unknown or other
tcagcgcagtacgacacgaccggtgctcgatttagctctacgctcagggggatcaggactcctcagttcaccttctcacatgaggctccctgctcagctcctggggctgctaatgctctgggtctctggatccaggtggggagattgtgatgactcagtctccactctccctgcccgtcaccctggagagacggcctccatctcctgcaggtctagtcagacgcctctgacatagtaatggatacaagtnttggattggtatntgcagaagccgagggcagtctccanagctctgatcttagtttggtctaagtcggtccccgtccggggtcctagacgtagttcaggtcggctaggtaggacgtgaagggcccaaagtaacgttaaactttaaacaaaactaaaaactcgaagacaaaggaggtagggaaggntaggtaagggtagtttacggggtttaggggtttataacgtaggtactagttacgaactaagttaactaaactaaaacgtctacgtacttacgtttacggaccgaacggggtacacgtacgagagtaatacgaaaacgtacgtagtacgcgtacaacc

SEQ ID NO: 379604 - DNA, 633 bp, Homo sapiens
  misc_feature: GZ8MTXP02JNXXG.52.73.G07.1.454.CMB.2.raw
  modified_base (244)..(244): a, c, t, g, unknown or other
  modified_base (618)..(618): a, c, t, g, unknown or other
  modified_base (626)..(626): a, c, t, g, unknown or other
tcagcgcagtacgacacgaccggtgctcgatttagctctacgctcagggggatcaggactcctcagttcaccttctcacaatgaggctccctgctcagctcctggggctgctaatgctctgggtctctggatccaggtggggagattgtgatgactcagtctccactctccctgcccgtcacccgtggagagaccggcctccatcctcctgctagtctagtcagcgtcctctgactatagtaanggataacgtaagttgttggattggtatcgtagcgaagaacggccgagggctaacggtcctaccaacgacgtccttcgtagtactttcgtttagtttcgggttactaacggtccggtacccccggttcccggggtcctagggacggttacggttccgaggtcgggacgtagggtcgatcgacggactaacgtaagttaaatttaaacgaaaactaaaacgtcaagtacgagggtaggtaggacggtgtaggtaggtagttttagggttacggtttatacggtagtactagtacgtagttaacgttactaaacgtaactcctacgtacttacggttcggacgtaggaacagcgtagagtaactaacgaacgtacgngtcggacncgtaacc

SEQ ID NO: 379605 - DNA, 747 bp, Homo sapiens
  misc_feature: GZ8MTXP02HYKA8.52.73.G07.1.454.CMB.2.raw
tcagcgcagtacgacacgaccggtgctcgatttagctctacgctcagggcacgaccggtgctcgatttagctctacgctcagggggtgctttccgagagtcatggacctcctgcacaagaacatgaaacacctgtggttcttcctctcctggtggcagctcccagatgggtcctgtcccaggtgccacctacaacaggtggggcgcaggactgttgaacgtccttcggagtaccctcgtccctcacctgcgctgtcgagtggtcggtccttcgaggtggtcgctacgtcggaccgtggactcccgccgacggcccccggaggggacggggctggggaggtcggaggttaggggaaactcgaaagtctaacgtacgtaggaagtcctaaacttaaccgtaaccgttaaccccgtacccgttaaaggacgtccgtagtacctaaccatactacgagtaccgacaccgtaccaaacgaacctacttaccctccgtaggtaacggtggacgttcgttacggttacccggacccggtcgggaaccgtaccgggttcgttccgttacgttaacgtttacgtcggttacggaacccgggtaaacggtccccgtaacgtaaaccggtaacggttaaaacgaaaacccgtacccgacccccggtaacggcccgtacgttacggtacgggtaaccgggtccgggtaaccgggggacccggtaaaccggggacccgtaacgggttacccgtaaccccg

SEQ ID NO: 379606 - DNA, 642 bp, Homo sapiens
  misc_feature: GZ8MTXP02IPIZZ.52.73.G07.1.454.CMB.2.raw
  modified_base (204)..(204): a, c, t, g, unknown or other
  modified_base (361)..(361): a, c, t, g, unknown or other
tcagcgcagtacgacacgaccggtgctcgatttagctctacgctcagggcacgaccggtgctcgatttagctctacgctcagggggtgctttccgagagtcatggacctcctgcacaagaacatgaaacacctgtggttcttcctcctcctggtggcagctcccagatgggtcctgtcccaggtgcacctacaacagtggggcncaggactgttgaagccttggagaccctgtcccctcacctgcgctgtcgagtggtcggtccttcagtggtcgctacgtggacctggactcccgccgacgcccccgaggggaacgggctaggagtggagttggggaaaatcgaaatcaatacgaggaanccgtaacttaactactaaacccgttctaaagagtcgaacgtcaccatatacagtacgaccacgtacaaacgaactaattcctacctagaacgtgacgtctcgttaccgccgtacgacgtacggcttcgtactaacgttcgtaggtacgacggaaaccgtccctacgaaccgtaacgtaacgaaaacccgttacccgccccggttacggaccgtactaacggcggtaaccggtcggtacggggacccgtaacggggaccccgaacgggttccctaaccccgg

SEQ ID NO: 379607 - DNA, 602 bp, Homo sapiens
  misc_feature: GZ8MTXP02I0VAZ.52.73.G07.1.454.CMB.2.raw
  modified_base (232)..(232): a, c, t, g, unknown or other
  modified_base (251)..(251): a, c, t, g, unknown or other
  modified_base (266)..(266): a, c, t, g, unknown or other
  modified_base (286)..(286): a, c, t, g, unknown or other
  modified_base (566)..(566): a, c, t, g, unknown or other
tcagcgcagtacgacacgaccggtgctcgatttagctctacgctcagggggatcaggactcctcagttcaccttctcacaatgaggctccctgctcagctcctggggctgctaatgctctgggtctctggatccaggtggggagattgtgatgactcagtctccactctccctgcccgtccacccgtggagagaccggcctccatcctcctgcaggtctagtcagcgcctcngcatagtatggatacagtnttggattgtatctgnagacgcgaggcagtcaccancgctcctgtattcttagtttggtactaaggtccgggccccgttccggggtcctgtaggtacgttcgaggtgggctaggtggactcgacgggctaacgaagtttaactttaacaaactaaaatccgaagtacgaggtaggtcggaaggagtagggaaggttacgtttgggtttaggggttttacttagtcgtactagtcgtaacgtaacgttactaaactaacgttccgtcgtaacgttcgttacggggaccggtagggaaaccctagtacgtagggtaanaacgtaaacgaacgtacgtggtacgcgttacgaacc

SEQ ID NO: 379608 - DNA, 490 bp, Homo sapiens
  misc_feature: GZ8MTXP02GPFM4.52.73.G07.1.454.CMB.2.raw
  modified_base (245)..(245): a, c, t, g, unknown or other
  modified_base (284)..(284): a, c, t, g, unknown or other
  modified_base (475)..(490): a, c, t, g, unknown or other
tcagcgcagtacgacacgaccggtgctcgatttagctctacgctcaggggggagagatccccaggggtgacagccatggaccctggaagggcctgggctagggacagggaccagagccagtccagggagaggacagagccaatggactggggtgtactgtaacagccctgctggtcccaggcagtgctggccctgctgctgctgggtctggccagtgcgccatggctgctgccgcctagtggtcncgaccgacgaaacggccgggacccacggacccgtggacnctcgaggtcggaagcagccgatccagccgtaggccggtgccgtgggtcgggctaggaccaccggaccgaaccgacccccccaaaccccgtcgtacgtccctacttcccgttccgttcccccctacccttccctacgtaactaccgtacttccgcgtacgggcgcccgggagtcggacgaagccgatagcgnnnnnnnnnnnnnnnn

SEQ ID NO: 379609 - DNA, 598 bp, Homo sapiens
  misc_feature: GZ8MTXP02HMZN8.52.73.G07.1.454.CMB.2.raw
  modified_base (143)..(143): a, c, t, g, unknown or other
  modified_base (190)..(190): a, c, t, g, unknown or other
  modified_base (243)..(243): a, c, t, g, unknown or other
  modified_base (248)..(248): a, c, t, g, unknown or other
  modified_base (253)..(253): a, c, t, g, unknown or other
  modified_base (266)..(266): a, c, t, g, unknown or other
  modified_base (286)..(286): a, c, t, g, unknown or other
  modified_base (383)..(383): a, c, t, g, unknown or other
  modified_base (398)..(398): a, c, t, g, unknown or other
  modified_base (409)..(409): a, c, t, g, unknown or other
tcagcgcagtacgacacgaccggtgctcgatttagctctacgctcagggggatcaggactcctcagttcaccttctcacaatgaggctccctgctcagctcctggggctgctaatgctctgggtctctggatccagtgggganattgtgatgactcagtctccactctccctgcccgtcaccctggagancggcctcatctcctgctaggtctagtcagagcctctgcatagtaatggactanaagtnttagntggtatctgacanaagcgtaggcagtcctccanagtctccgtgactgttaagtttcggttacaaggttcggaccccgtccggggaccctagacggtagttacaggtggacctaggtcgactgacggcaanagttaactttaaaanaaacgtaaacnctagagagaggtaggagtagtagtaggtaggttaggtttaggtttagttagtagtacgtagtacgtacgtaacgttaacgtaaacgtaacgtacgtacgttacgttacggttacggtaacggaacgggtaacgtaacgtacgtacggaacgtaacgtaacgtaaacgtacgtacgacgtacgtacgacg

SEQ ID NO: 379610 - DNA, 420 bp, Homo sapiens
  misc_feature: GZ8MTXP01EN87B.10.60.F05.1.454.CMB.2.raw
  modified_base (221)..(221): a, c, t, g, unknown or other
  modified_base (231)..(231): a, c, t, g, unknown or other
  modified_base (319)..(319): a, c, t, g, unknown or other
  modified_base (414)..(414): a, c, t, g, unknown or other
  modified_base (417)..(420): a, c, t, g, unknown or other
tcagcatagtagtgcacgaccggtgctcgatttagtacgtcatcagggaaagggcctggagtgggtctcaggtattacttggaatggtggtataataggctatgcggactctgtgaggggccgcttcaccatctccaaggacagcgccaagagatccctctatctgcaaatgaacagtctgagaactgaggacacggcctactactactgtgacaaaaagntgattccggnagttacttcttagataacgtgggggcccggggaaccctggtcgccgtctctcagcctccaccaagggcccatcggtctccccctggcnccctgctccaggagcacctccgagagcacagcccggccctgggctgccctggcaaggctacttcccatactatgctgagcgggctgcgagcgcanagnnnn

SEQ ID NO: 379611 - DNA, 422 bp, Homo sapiens
  misc_feature: GZ8MTXP01AGHNF.10.60.F05.1.454.CMB.2.raw
  modified_base (219)..(219): a, c, t, g, unknown or other
  modified_base (415)..(422): a, c, t, g, unknown or other
tcagcatagtagtgcacgaccggtgctcgatttagtacgtcatcagggaaagggcctggagtgggtctcaggtattacttggaatggtggtataataggctatgcggactctgtgaggggccgcttcaccatctccaaggacagcgccaagagatccctctatctgcaaatgaacagtctgagaactgaggacacggcctactactactgtgcaaaagntgattccggcagttacttcttagataactggggccggggaacctggtcgccgtctctcagcctccaccaagggcccatcggtctccccctggcgccctgctccaggagcacctccgagagcacagcccggccctgggctgcctgggtcaaggctacttcccactctatgctgagcgggctgggcaaggcgcatagnnnnnnnn

SEQ ID NO: 379612 - DNA, 558 bp, Homo sapiens
  misc_feature: GZ8MTXP01AP6LO.10.60.F05.1.454.CMB.2.raw
  modified_base (256)..(256): a, c, t, g, unknown or other
  modified_base (301)..(301): a, c, t, g, unknown or other
  modified_base (442)..(442): a, c, t, g, unknown or other
tcagcatagtagtgcacgaccggtgctcgatttagtacgtcatcagggaaaggggggggtctcaggaggcagcactctcgggacgtctccaccatggcctgggctctgctcctcctcagcctcctcactcagggcacaggatcttgggctcagtctgccctgactcagcctcgctcagtgtccgggtctcctggacagtcagttaccatctcctgcactggaacctcaatgatgttggtgttatatctatgtctcnggtaccaacaacacgcaggcaaacgcccccgaagtcatgatttangatgtcagtaacgcggccctcgacggggtccctcgaccgtcttctcgtcggcctaccgaagtctcggacaaaccgccgggccctcctacgaccctacgtcctcgtcgccctcgaggctggacggatgaggtctgtaacttnttatgctgctcatactgcgacggtcggtaccgttgggttccggttagttcgttcgttacggacgttcgggaccttaccggtcaccggtcgtacgggtccacggcccaacggtcccc

SEQ ID NO: 379613 - DNA, 539 bp, Homo sapiens
  misc_feature: GZ8MTXP01CJK36.10.60.F05.1.454.CMB.2.raw
  modified_base (224)..(224): a, c, t, g, unknown or other
  modified_base (528)..(539): a, c, t, g, unknown or other
tcagcatagtagtgcacgaccggtgctcgatttagtacgtcatcagggaaagggcctggagtgggtctcaggtattacttggaatggtggtataataggctatgcggactctgtgaggggccgcttcaccatctccaaggacagcgccaagagatccctctatctgcaaaatgaaacagtctgagaactgaggacacggcctaactactactgtgacaaaaagntgattccggctagttacttcttaagataacggtgggggacccgggaaccctggtccgccgtctctcacgccctccaaccgaacgggccccagtccggtcccttccccccgtggcccgcccctggccctaccgagggacgcccaacccgtccggaagacgaccaaccgacggccccccggccccgtgggggcccttcggccccgttaggggttacccaaacgggtaccctttaacccttacccccaaccttaactagtcgccgttaggacggccggggcctagggaccaaacggggccacatagnnnnnnnnnnnn

SEQ ID NO: 379614 - DNA, 463 bp, Homo sapiens
  misc_feature: GZ8MTXP01APR4N.10.60.F05.1.454.CMB.2.raw
  modified_base (219)..(219): a, c, t, g, unknown or other
  modified_base (229)..(229): a, c, t, g, unknown or other
  modified_base (315)..(315): a, c, t, g, unknown or other
  modified_base (327)..(327): a, c, t, g, unknown or other
  modified_base (455)..(463): a, c, t, g, unknown or other
tcagcatagtagtgcacgaccggtgctcgatttagtacgtcatcagggaagggcctggagtgggtctcaggtattacttggaatggtggtataataggctatgcggactctgtgaggggccgcttcaccatctccaaggacagcgccaagagatccctctatctgcaaatgaacagtctgagaactgaggacacggcctactactactgtgacaaaagntgattccggnagttacttctagataacgtgggggcccgggaaccctggtcgccgtctctcagcctccacaaggcccatcggtcctccccgtggccnccctgctcaggnccacctccgagagcacgacggcccggccctggggcctcgcccgtcgggtaccaacgggtacccttaccttcccccaacttacctattggcccttggacggccggggctgggaccaagggccgcatagnnnnnnnnn

SEQ ID NO: 379615 - DNA, 559 bp, Homo sapiens
  misc_feature: GZ8MTXP01DOC80.10.60.F05.1.454.CMB.2.raw
  modified_base (297)..(297): a, c, t, g, unknown or other
  modified_base (365)..(365): a, c, t, g, unknown or other
  modified_base (449)..(449): a, c, t, g, unknown or other
tcagcatagtagtgcacgaccggtgctcgatttagtacgtcatcagggaaagggggggtctcaggaggcagcactctcgggacgtctccaccatggcctgggctctgctcctcctcagcctcctcactcagggcacaggatcttgggctcagtctgccctgactcagcctcgctcagtgtccggtctcctggacagtcagttaccatctctgcactggaacctcaatgatgttggtgttatatctatgtctctgtaccaacaacacgcaggcaaagcccccgaaagtcatgatttangatgtcagtaagccggccctcgacggggtccctgacccgtcttctctggcctcaagtctgggacaacncggcctcctgaccctatcctcgtcggccctcgaggtcctagacggatgagggtctaggtaacttagtttagttgcctgcccttnaattacgtgacgacggtccggtacgttgggttcccggttatcggttcgttacggaacgttcgggaccttacggtcacccgtctaagggtccacgcccgaacggtaacccc

SEQ ID NO: 379616 - DNA, 545 bp, Homo sapiens
  misc_feature: GZ8MTXP01B7EQM.10.60.F05.1.454.CMB.2.raw
  modified_base (299)..(299): a, c, t, g, unknown or other
tcagcatagtagtgcacgaccggtgctcgatttagtacgtcatcagggaaagggggggtctcaggaggcagcactctcgggacgtctccaccatggcctgggctctgctcctcctcagcctcctcactcagggcacaggatcttgggctcagtctgccctgactcagcctcgctcagtgtccgggtctcctggacagtcagttaccatctctgcactggaacctcaatgatgttggtgttatatctatgtctctggtaccaacaacacgcaggcaaacgcccccgaagtcatgatttangatgtcagtaagcggccctcgacggggtccctcgaccgcttctcctggcctaccaagtctcggaccaacgaccggccctccctcgaccctatcctcgtcggccctccgaggcctagaggatgaggctagtactagtttatgactgctcatatcgcgtacggcggaccgttgggttccgggttatcggttcgttacggacttcggggccacggtccaccgtctaggtccacgtcccgaacgaacccc

SEQ ID NO: 379617 - DNA, 442 bp, Homo sapiens
  misc_feature: GZ8MTXP01EMXL0.10.60.F05.1.454.CMB.2.raw
  modified_base (221)..(221): a, c, t, g, unknown or other
  modified_base (312)..(312): a, c, t, g, unknown or other
  modified_base (317)..(317): a, c, t, g, unknown or other
  modified_base (331)..(331): a, c, t, g, unknown or other
  modified_base (344)..(344): a, c, t, g, unknown or other
  modified_base (431)..(442): a, c, t, g, unknown or other
tcagcatagtagtgcacgaccggtgctcgatttagtacgtcatcagggaaagggcctggagtgggtctcaggtattacttggaatggtggtataataggctatgcggactctgtgaggggccgcttcaccatctccaaggacagcgccaagagatccctctatctgcaaatgaacagtctgagaactgaggacacggcctactactactgtgacaaaaagntgattccggcagttacttcttagataacgtgggggccggggaacctggtcgccgtctctcagcctccacaagggcccatcggtctcccccnggccnccctgctccagganccacctccgagancacagcccggccctgggctgccctgggtcaaggacctaccttccccaacttactatcgactgaggcgggctggcaaaggcgcaatgnnnnnnnnnnnn

SEQ ID NO: 379618 - DNA, 466 bp, Homo sapiens
  misc_feature: GZ8MTXP01CGES9.10.60.F05.1.454.CMB.2.raw
  modified_base (220)..(220): a, c, t, g, unknown or other
  modified_base (315)..(315): a, c, t, g, unknown or other
  modified_base (321)..(321): a, c, t, g, unknown or other
  modified_base (459)..(466): a, c, t, g, unknown or other
tcagcatagtagtgcacgaccggtgctcgatttagtacgtcatcagggaaagggcctggagtgggtctcaggtattacttggaatggtggtataataggctatgcggactctgtgaggggccgcttcaccatctccaaggacagcgccaagagatccctctatctgcaaatgaacagtctgagaactgaggacacggcctactactactgtgacaaaagntgattccggcagttacttctagataacgtgggggccgggaacctggtcgccgtctctcagcctccaccaagggccccagtccggtccttcccccngggccncccctgcctccgaggacgccaaccctccgagacgccacgacggcccccggccctggggcctcgcccgtagggttaccaagggtaccttacccttcccactactactgcctgacggcgggctgggacaaggcgacatgnnnnnnnn

SEQ ID NO: 379619 - DNA, 666 bp, Homo sapiens
  misc_feature: GZ8MTXP01EXTUK.10.60.F05.1.454.CMB.2.raw
  modified_base (303)..(303): a, c, t, g, unknown or other
tcagcatagtagtgcacgaccggtgctcgatttagtacgtcatcagggaaaggggggggtctcaggaggcagcactctcgggacgtctccaccatggcctgggctctgctcctcctcagcctcctcactcagggcacaggatcttgggctcagtctgccctgactcagcctcgctcagtcgtccggtctcctggacagtcagttaccatctcctgcactgaacctcaatgatgttggtgttatatctatgtctctggtaccaacaacacgcaggaccaaacgcccccgaagtcatgtatttangatgtacaagtaacgccggccctcgacggggtccctcggaccgtctttacgtcttcgggacccttaccgaagttccgtacgggacccaaacccgtacccgggtcccccttaccccttacggaacccctattcccgttcgtccgggtccccttaccgtaacggggtcccgtttaggggaaaccggtacgttagggaacgggtcgttacggtaacctttaagttttaacgtttcggcctttagcccttagtaacttagtcggcgtaacgggtcccggtaaccgttggggttacccggttagtcgttacgttcggaacgttcgggacgcggtccacgtccgtaggcacgaaccgttaacgaacccc

SEQ ID NO: 379620 - DNA, 535 bp, Homo sapiens
  misc_feature: GZ8MTXP01COWMA.10.60.F05.1.454.CMB.2.raw
  modified_base (301)..(301): a, c, t, g, unknown or other
  modified_base (375)..(375): a, c, t, g, unknown or other
  modified_base (381)..(381): a, c, t, g, unknown or other
  modified_base (404)..(404): a, c, t, g, unknown or other
  modified_base (439)..(439): a, c, t, g, unknown or other
  modified_base (496)..(496): a, c, t, g, unknown or other
tcagcatagtagtgcacgaccggtgctcgatttagtacgtcatcagggaaaggggggggtctcaggaggcagcactctcgggacgtctccaccatggcctgggctctgctcctcctcagcctcctcactcagggcacaggatcttgggctcagtctgccctgactcagcctcgctcagtgtccggtctcctggacagtcagttaccatctctgcactgaacctcaatgatgttggtgttatatctatgtctctggtaaccaacaacacgcacggacaaacgcccccgaagtcatgatttangatgtcagtacgcgacctgcgggtcctcgaccgtctctcgtcgactcaagtctacggacacgaccggcctccgngacccntcctcacgtcctcgagctgagtntgagctagacttattagttgctgcctacgatacgnggtacgagggtccgcgttcggggtacgttagtggttcgttacgggacttcgggaccncggtccaccgtcgtacggtccacgtcccgaacgtaaccc

SEQ ID NO: 379621 - DNA, 600 bp, Homo sapiens
  misc_feature: GZ8MTXP01DSHU1.10.60.F05.1.454.CMB.2.raw
  modified_base (301)..(301): a, c, t, g, unknown or other
tcagcatagtagtgcacgaccggtgctcgatttagtacgtcatcagggaaaggggggggtctcaggaggcagcactctcgggacgtctccaccatggcctgggctctgctcctcctcagcctcctcactcagggcacaggatcttgggctcagtctgccctgactcagcctcgctcagtgtccggtctcctggacagtcagttaccatctcctgcactgaacctcaatgatgttggtgttatatctatgtctctggtaccaacaacacgcaggacaaacgcccccgaaagtcatgatttangatgtacagtaagccgcctgacggggtccctcgaccgtcttctctcggacctccaagtctcgggaccaaccgaccggccctccgtacgaccctagtcctcgtcggccctccgaagggctaggagggtataggagtctagtaacttaatttagtcgtactcgtacctagtagttagtcgacgtacgggtccggtaccggttcgggttacggttagttcggttacgttacgggtaacgttacgggacccgttaccggtccgtaccgtccggtacggaccgaccgtaacccgaacgaacccc

SEQ ID NO: 379622 - DNA, 574 bp, Homo sapiens
  misc_feature: GZ8MTXP01BHCK1.10.60.F05.1.454.CMB.2.raw
  modified_base (255)..(255): a, c, t, g, unknown or other
  modified_base (295)..(295): a, c, t, g, unknown or other
tcagcatagtagtgcacgaccggtgctcgatttagtacgtcatcagggaaaggggggggtctcaggaggcagcactctcgggacgtctccaccatggcctgggctctgctcctcctcagcctcctcactcagggcacaggatcttgggctcagtctgccctgactcagcctcgctcagtcgtccgggtctcctggacagtcagttaccatctctgcactgaacctcaatgatgttggtgttatatctatgtctcngtaccaacacacgcagacaacgccccgaagtcatgattangatgtacagtagccgcctgacgggtcctcgaccgtcttctcgtcggacctactaagtctcgggaccaaaccgccggccctcctcgaccctatcctcgtcggtccctcgaggcctagaggactgagtctagtacttatttagtgctgctcgtatacgtcgacgaggtaccgtccgttaaggggttccggttagtcgttcggtaccgggtaacgttccggggaacccttccggtaaccgtacccgtccgttaacgggcaaccgtccccgaacggtaacccc

SEQ ID NO: 379623 - DNA, 668 bp, Homo sapiens
  misc_feature: GZ8MTXP01C4SI8.10.60.F05.1.454.CMB.2.raw
  modified_base (252)..(252): a, c, t, g, unknown or other
  modified_base (298)..(298): a, c, t, g, unknown or other
tcagcatagtagtgcacgaccggtgctcgatttagtacgtcatcagggaaagggggggtctcaggaggcagcactctcgggacgtctccaccatggcctgggctctgctcctcctcagcctcctcactcagggcacaggatcttgggctcagtctgccctgactcagcctcgctcagtgtccggtctcctggacagtcagttaccatctctgcactgaacctcaatgatgttggtgttatatctatgtctcnggtaccaacaacacgcaggacaaacgcccccgaagtcatgatttangatgtcagaacgcgccctcgacggggtccctgaccgtcttctctcggacctaccaaggtctcgggacctaaaccgaccgggtccctcccgagaccctagttcctcgtcggcccttacgaacggtccttaggacgggtagttaggacgggtacttacggtaacctttaagtttacgttcgtccgttaggtcccttaccgtaattaagtcggaccgtaacggggtcccgggttaacccggttcgggggtttaccccgggttaagttccgggttaccgtttaccggggaaaccgttccgggggaccccttaccggggttcccctaaccggttccgtacgggtaccacccggtaaccccgaacggtaacccccc

SEQ ID NO: 379624 - DNA, 644 bp, Homo sapiens
  misc_feature: GZ8MTXP01DB9MS.10.60.F05.1.454.CMB.2.raw
tcagcatagtagtgcacgaccggtgctcgatttagtacgtcatcagggaaagggggggtctcaggaggcagcactctcgggacgtctccaccatggcctgggctctgctcctcctcagcctcctaactcagggcacaggatcttgggctcagtctgccctgactcagcctcgctcagtcgtccggtctcctggacagtcagttaccatctcctgcactgaacctcaatgatgtgtgttatatctatgtctctgaccaacacacgcagacaaacgccccgaagtcatgatttatgatgtcagtaacgccggcctcgacggggtccctcgacccccgtcttcgtcgtcggcctaccgaacgtcgtacgggacccaaaccgcccgggtcccctcccgtacgaccctactcctccgtcgccctcgaacgggctagggacggacgtcggacgtcgtaacgtacgtttaatttcgtgtccgtacgtctactaagtcgacgtcggtaccggggtaccgttaccggtttcggggttaaccggttcgttacggtttccgggttaaccggtaccgggtcggttaacccggttccggttacccgtaacccgttcgtaaccgtaccgaccgttaccgtaaccgaacccctaacccg

SEQ ID NO: 379625 - DNA, 453 bp, Homo sapiens
  misc_feature: GZ8MTXP01C82QM.10.60.F05.1.454.CMB.2.raw
  modified_base (220)..(220): a, c, t, g, unknown or other
  modified_base (230)..(230): a, c, t, g, unknown or other
  modified_base (272)..(272): a, c, t, g, unknown or other
  modified_base (330)..(330): a, c, t, g, unknown or other
  modified_base (360)..(360): a, c, t, g, unknown or other
  modified_base (438)..(442): a, c, t, g, unknown or other
  modified_base (444)..(453): a, c, t, g, unknown or other
tcagcatagtagtgcacgaccggtgctcgatttagtacgtcatcagggaaagggcctggagtgggtctcaggtattacttggaatggtggtataataggctatgcggactctgtgaggggccgcttcaccatctccaaggacagcgccaagagatccctctatctgcaaatgaacagtctgagaactgaggacacggcctactactactgtgacaaaagntgattccggntagttacttcttagataacgtgggggaccgggaacctggtcnccgtctctcacgccctccaaccgaacgggccccagtccggtcccttcccccgtggccnccctgcctccaggacgccacctccgagacncacacgccccggcctgggctgcctggtacaaggctacgttcccatactatgctgagcggctggacaaggcgacatagnnnnngnnnnnnnnnn

SEQ ID NO: 379626 - DNA, 589 bp, Homo sapiens
  misc_feature: GZ8MTXP01EUB5E.10.60.F05.1.454.CMB.2.raw
  modified_base (263)..(263): a, c, t, g, unknown or other
  modified_base (271)..(271): a, c, t, g, unknown or other
  modified_base (494)..(494): a, c, t, g, unknown or other
  modified_base (499)..(499): a, c, t, g, unknown or other
  modified_base (503)..(503): a, c, t, g, unknown or other
  modified_base (566)..(566): a, c, t, g, unknown or other
tcagcatagtagtgcacgaccggtgctcgatttagtacgtcatcaggggaaaggggggggtctcaggaggcagcactctcgggacgtctccaccatggcctgggctctgctcctcctcagccctcctcactcagggcacaggatcttgggctcagtctgccctgactcagcctcgctcagtcgtccggtctccgtggacagtcagttaccatctcctgcacgtcgaacctcaatgatggttgtgttatatctatcgtctccgngtaccaanacacgcaaggacaaacgccccgaagtcatgtatttagcgtatgtacaagtaagtcggccctaggaccggggtccctcggacccgttctctcgtcggtaacctccaagttccgtacggacaaccgtacccggtaccctccgtacgtaccattccgtcctccggcccttccgaacgggtcttgggaaacgtcgttggaacgggtcttaaccggattaatttgtcncgtancctnaatcgtgagtacggcgtacgtggtcgttatcgttcgtacgacgttcgccgcggtctaccggtntacggcacgcccgaacgaacccc

SEQ ID NO: 379627 - DNA, 518 bp, Homo sapiens
  misc_feature: GZ8MTXP02I9JHZ.10.60.F05.1.454.CMB.2.raw
  modified_base (300)..(300): a, c, t, g, unknown or other
  modified_base (344)..(344): a, c, t, g, unknown or other
tcagcatagtagtgcacgaccggtgctcgatttagtacgtcatcagggaaaggggggtctcaggaggcagcactctcgggacgtctccaccatggcctgggctctgctcctcctcagcctcctcactcagggcacaggatcttgggctcagtctgccctgactcagcctcgctcagtgtccgggtctcctggacagtcagttaccatctcctgcactggaacctcaatgatgttggtgttatatctatgtctcctggtaccaacaacacgcaggcaaacgcccccgaagtcatgatttangatgtacagtaagcggccctcgacggggtccctcgaccgcttcnctggctcagtctggccaacaccggcctccctgacccagtcctctcggccctccgaggcctggaggatgaggctgactattatgctgctcatatgcgagcgacgtcggttcggatcgtctacggaacgtcgggaccacggtcaccgtcgtacggtccacgcccgaacggaccccc

SEQ ID NO: 379628 - DNA, 422 bp, Homo sapiens
  misc_feature: GZ8MTXP02JU7W1.10.60.F05.1.454.CMB.2.raw
  modified_base (219)..(219): a, c, t, g, unknown or other
  modified_base (333)..(333): a, c, t, g, unknown or other
  modified_base (349)..(349): a, c, t, g, unknown or other
  modified_base (419)..(422): a, c, t, g, unknown or other
tcagcatagtagtgcacgaccggtgctcgatttagtacgtcatcagggaaagggcctggagtgggtctcaggtattacttggaatggtggtataataggctatgcggactctgtgaggggccgcttcaccatctccaaggacagcgccaagagatccctctatctgcaaatgaacagtctgagaactgaggacacggcctactactactgtgcaaaagntgattccggcagtttacttcttaagataactggggccggggaaccctggtcgccgtctcttcagccctccaccaagggcccatcggtcttccccctggccgccctgctccaggngcacctcgagagcacngccgccctggctgcctggtcaggacctacttcccactactatgctgagcgggctggcaaaggcgcatagnnnn

SEQ ID NO: 379629 - DNA, 487 bp, Homo sapiens
  misc_feature: GZ8MTXP02F0T9K.10.60.F05.1.454.CMB.2.raw
  modified_base (377)..(377): a, c, t, g, unknown or other
  modified_base (416)..(416): a, c, t, g, unknown or other
tcagcatagtagtgcacgaccggtgctcgatttagtacgtcatcagggaaaggggggtctcaggaggcagcactctcgggacgtctccaccatggcctgggctctgctcctcctcagcctcctcactcagggcacaggatcttgggctcagtctgccctgactcagcctcgctcagtgtccgggtctcctggacagtcagttaccatctcctgcactggaacctcaatgatgttggtgttatatctatgtctcctggtaccaacaacacgcaggcaaagcccccgaagtcatgatttatgatgtcagtaagcggccctcaggggtcctgaccgcttctctggctccagtctggcaacacggcctccctgacccatcnctggcctccagctgagatgagctgactatattgctgctnatatgcaggcgactggttccgggtatcgtcttcggactggaccacggtcaccgtcagtcacgccaggaccc

SEQ ID NO: 379630 - DNA, 417 bp, Homo sapiens
  misc_feature: GZ8MTXP02GWWFZ.10.60.F05.1.454.CMB.2.raw
  modified_base (415)..(417): a, c, t, g, unknown or other
tcagcatagtagtgcacgaccggtgctcgatttagtacgtcatcagggaaagggcctggagtgggtctcaggtattacttggaatggtggtataataggctatgcggactctgtgaggggccgcttcaccatctccaaggacagcgccaagagatccctctatctgcaaatgaacagtctgagaactgaggacacggcctactactactgtgcaaaagatgattccggcagttacttcttagataactggggccgggaaccctggtcgccgtctcttcagcctccaccaaggcccatcggtcttccccctggccgccctgctccaggagcacctccgagagcacagccggcccctgggctgcctggtcaggctacttcccactactatgctgagcgggctggcaaggcgcatagnnn

SEQ ID NO: 379631 - DNA, 572 bp, Homo sapiens
  misc_feature: GZ8MTXP02GCEC4.10.60.F05.1.454.CMB.2.raw
tcagcatagtagtgcacgaccggtgctcgatttagtacgtcatcagggaaagggggggtctcaggaggcagcactctcgggacgtctccaccatggcctgggctctgctcctcctcagcctcctcactcagggcacaggatcttgggctcagtctgccctgactcagcctcgctcagtgtccgggtctcctggacagtcagttaccatctcctgcactggaacctcaatgatgttggtgttatatctatgtctctgtaccaacaacacgcaggcaaacgcccccgaagtcatgatttatgatgtcagtaagccggccctgacggggtcctcggacccgtcttctcgtcggccttaccgagtctcggcctaaaccgccggccctccctcgaccctatcctcgtcggccctccgaggcctaggaggatggagctgacttattagtgactgctcatagtgcgaggcggtaccgtgggttaccggtatcggttacgttacgggacgtcggggtacccgtaccgggtaaccgtacccggtacgttacgggtaccacggacccgaacggtaacccccg

SEQ ID NO: 379632 - DNA, 538 bp, Homo sapiens
  misc_feature: GZ8MTXP02G1CC6.10.60.F05.1.454.CMB.2.raw
  modified_base (298)..(298): a, c, t, g, unknown or other
  modified_base (328)..(328): a, c, t, g, unknown or other
  modified_base (338)..(338): a, c, t, g, unknown or other
  modified_base (355)..(355): a, c, t, g, unknown or other
  modified_base (413)..(413): a, c, t, g, unknown or other
tcagcatagtagtgcacgaccggtgctcgatttagtacgtcatcagggaaaggggggtctcaggaggcagcactctcgggacgtctccaccatggcctgggctctgctcctcctcagcctcctcactcagggcacaggatcttgggctcagtctgccctgactcagcctcgctcagtgtccggtctcctggacagtcagttaccatctcctgcactggacctcaatgatgttggtgttatatctatgtctcctggtaccaacacacgcaggcaaacgcccccgaagtccatgatttangatgtcagtaagcggcctcgaggggtcccngaccgcttcnctggctcagtctgcacncgcctcctgacccatcctctcggccctccgaggcctggaggatggaggtctggaactntttatgctgctcatatgcgagggcggtaccgttgggttcccggggtatcggttcgttacgggaaccgtcggggacccacgggtccgaccggttccgtacggtccacggccccgaacggaaccccc

SEQ ID NO: 379633 - DNA, 696 bp, Homo sapiens
  misc_feature: GZ8MTXP02IFIDJ.10.60.F05.1.454.CMB.2.raw
  modified_base (296)..(297): a, c, t, g, unknown or other
  modified_base (302)..(302): a, c, t, g, unknown or other
tcagcatagtagtgcacgaccggtgctcgatttagtacgtcatcagggaaagggggggtctcaggaggcagcactctcgggacgtctccaccatggcctgggctctgctcctcctcagcctcctcactcagggcacaggatcttgggctcagtctgccctgactcagcctcgctcagtgtccggtctcctggacagtcagttaccatctctgcactgaacctcaatgatgttgtgttatatctatgtctcctggtaaccaacaacacgcaggacaaacgccccgaatcatgattannatganagtacgcgcctcgacgggtcctcgaccgtcttctcgtcggcctccgagtccgtaggaccaaaccgacccgtccctccctacgaaccctacttccctccgtcggccctaccgacggtacctgggaacgatacgggacggtcgttacggtaactttaagtttagttcggccgttacgtccttaagtacttaagtcgggtacggaaccgggggtacccggtaaccggtttccgggggttacccgggttaaggttccggttacccgggtttaacggggtaaacccgggttacccgggggtaaaccccgtaccgggggttaacccgtaaccccggtttacccgggttaaacgggtacccgaacccggtaacccccggtaaaaccgggaaaccccccccg

SEQ ID NO: 379634 - DNA, 697 bp, Homo sapiens
  misc_feature: GZ8MTXP02HA15H.10.60.F05.1.454.CMB.2.raw
  modified_base (302)..(302): a, c, t, g, unknown or other
tcagcatagtagtgcacgaccggtgctcgatttagtacgtcatcagggaaagggggggtctcaggaggcagcactctcgggacgtctccaccatggcctgggctctgctcctcctcagccctcctcactcagggcacaggatcttgggctcagtctgccctgactcagcctcgctcagtcgtccggtctcctggacagtcagttaccatctcctgcactgaacctcaatgatggttggtgttatatctatgtctcctagtaccaacacacgacaggacaaacgccccgaagtcatgtattangatgtacagtacgccgaccctcgacggggtcctcgacccgtcttctcgtcggtcctaccgagttcctacgggacctaaacccgaccggtccccttacccgtacggaaccctacgttcccgttccgtccgggtaccccttaccccggaagggtcccgttagggaaacgggtaacgttaggggaaccgggttacttacgtaaaaccgtttagttttaagttcggacctttaggtccccttaagtatttaaacgtcggacccggtaaacggggtcccggtaaccggtttcgggggttacccgggttagttcccggttacggttaccgggtacgtaccgggtaacccgtaccggtccgtacccggtaccgtacggtaccaccgacccgaacgtaccccg

SEQ ID NO: 379635 - DNA, 667 bp, Homo sapiens
  misc_feature: GZ8MTXP02ITVGY.10.60.F05.1.454.CMB.2.raw
tcagcatagtagtgcacgaccggtgctcgatttagtacgtcatcagggaaagggggggtctcaggaggcagcactctcgggacgtctccaccatggcctgggctctgctcctcctcagcctcctcactcagggcacaggatcttgggctcagtctgccctgactcagcctcgctcagtgtccgggtctcctggacagtcagttaccatctcctgcactgacctcaatgattgttggtgttatatctatgtctctgtaccaacacacgcagacaaacgccccgatcatgattatgatgtacagtagccgcctcgacggggtcctgacccgtcttctcgtcgtcctcgagttctcggaccaaaccgccggtccctcccgtacgaccctactccgtcgtcggcccttcccgaggtccctagggagggtactacgggacggtcttaggtaacctttagtttacttcggtcgttacgtccttacgtattacggtacgaccgtaacggggtcccggttaacccgggtttcgggggttaccccggggttagtttccgggtttacccggttacggggtaaaccgtccgggggtaacccttaccggggtaacccgtacccggttacccgtttaaacggggtccccaaccggtacccccgtaaacgggaaccccccc

SEQ ID NO: 379636 - DNA, 551 bp, Homo sapiens
  misc_feature: GZ8MTXP02GK4HL.10.60.F05.1.454.CMB.2.raw
  modified_base (300)..(300): a, c, t, g, unknown or other
  modified_base (356)..(356): a, c, t, g, unknown or other
  modified_base (372)..(372): a, c, t, g, unknown or other
  modified_base (379)..(379): a, c, t, g, unknown or other
  modified_base (486)..(486): a, c, t, g, unknown or other
tcagcatagtagtgcacgaccggtgctcgatttagtacgtcatcagggaaagggggggtctcaggaggcagcactctcgggacgtctccaccatggcctgggctctgctcctcctcagcctcctcactcagggcacaggatcttgggctcagtctgccctgactcagcctcgctcagtgtccgggtctcctggacagtcagttaccatctcctgcactggaacctcaatgatgttggtgttatatctatgtctctggtaccaacaacacgcaggcaaacgccccgaagtcatgtatttangatgtacagtaacgcgccctcgacgggtcctcgaccgtcttctcgtgcctcagtcnggacacgccgcctccncgacctntcctcgtcggccctccgaggctaggaggtatcggacgactgtaacttagtttagtcgctgctacgtatatcggacgagggtccggtaccgttcgggttaccgggttntcggtcgtacggacgtcggaccgtacggtccgtaccgtacgtacgaccgacgaccgaacgtaccc

SEQ ID NO: 379637 - DNA, 468 bp, Homo sapiens
  misc_feature: GZ8MTXP02JFMIV.10.60.F05.1.454.CMB.2.raw
  modified_base (220)..(220): a, c, t, g, unknown or other
  modified_base (230)..(230): a, c, t, g, unknown or other
  modified_base (271)..(271): a, c, t, g, unknown or other
  modified_base (324)..(324): a, c, t, g, unknown or other
  modified_base (456)..(468): a, c, t, g, unknown or other
tcagcatagtagtgcacgaccggtgctcgatttagtacgtcatcagggaaagggcctggagtgggtctcaggtattacttggaatggtggtataataggctatgcggactctgtgaggggccgcttcaccatctccaaggacagcgccaagagatccctctatctgcaaatgaacagtctgagaactgaggacacggcctactactactgtgacaaaagntgattccggntagttacttcttagataacgtggggcccgggaccctggtcnccgtctctcagcctccaccgagggccccagtccggtccttccccctgggcccnccctgcctccgaggacgccaccgtccgagacgccaacgacggccccggccccgtggggcctcggccgtggtaccacggggtacctaccttcccactactatcgctgaggccgggcgtggcgaaggcgcatgnnnnnnnnnnnnn

SEQ ID NO: 379638 - DNA, 632 bp, Homo sapiens
  misc_feature: GZ8MTXP02HKUX0.10.60.F05.1.454.CMB.2.raw
  modified_base (336)..(336): a, c, t, g, unknown or other
tcagcatagtagtgcacgaccggtgctcgatttagtacgtcatcagggaaagggggggtctcaggaggcagcactctcgggacgtctccaccatggcctgggctctgctcctcctcagcctcctcactcagggcacaggatcttgggctcagtctgccctgactcagcctcgctcagtgtccggtctcctggacagtcagttaccatctcctgcactggaacctcaatgatgttggtgttatatctatgtctcctggtaccaacaacacgcaggacaaacgcccccgaagtcatgtatttatgatgtacagtaacgcggccctcgacggggtcccncgaccgtctcgtctggctccagtctaggccaaccgaccggccctcccgtgaccctatcctcgtcggcccttccgaggtctggaacggtatcggacgtctacggtacttatttacgtgccttgctactatagtcgacgtacgggtcggtacccggttcggggttacccgggtatttccggtacggtttaccggggaaaccgttccgggggtaaaccccgtaccggggttaaccccgtaacccggttacccggtaccgggtaccgaacccggtacccccgtaaacgggaacccccccg

SEQ ID NO: 379639 - DNA, 438 bp, Homo sapiens
  misc_feature: GZ8MTXP02IQKEK.10.60.F05.1.454.CMB.2.raw
  modified_base (219)..(219): a, c, t, g, unknown or other
  modified_base (322)..(322): a, c, t, g, unknown or other
  modified_base (427)..(427): a, c, t, g, unknown or other
  modified_base (433)..(438): a, c, t, g, unknown or other
tcagcatagtagtgcacgaccggtgctcgatttagtacgtcatcagggaagggcctggagtgggtctcaggtattacttggaatggtggtataataggctatgcggactctgtgaggggccgcttcaccatctccaaggacagcgccaagagatccctctatctgcaaatgaacagtctgagaactgaggacacggcctactactactgtgacaaaagntgattccggcagttactcttagataacgtggggccggggaaccctggtcgccgtctcttcagccctccaccaacgggccccatccggtccttccccctggccncccctgcctccgaggcgccacctccgagagccacacggcccggccctggggcctgccctggtcaggacctacttccccatactatgctgagcggctggcaaggcncatagnnnnnn

SEQ ID NO: 379640 - DNA, 559 bp, Homo sapiens
  misc_feature: GZ8MTXP02JOIG5.10.60.F05.1.454.CMB.2.raw
  modified_base (299)..(299): a, c, t, g, unknown or other
  modified_base (337)..(337): a, c, t, g, unknown or other
  modified_base (400)..(400): a, c, t, g, unknown or other
  modified_base (404)..(404): a, c, t, g, unknown or other
  modified_base (407)..(407): a, c, t, g, unknown or other
tcagcatagtagtgcacgaccggtgctcgatttagtacgtcatcagggaaagggggggtctcaggaggcagcactctcgggacgtctccaccatggcctgggctctgctcctcctcagcctcctcactcagggcacaggatcttgggctcagtctgccctgactcagcctcgctcagtgtccggtctcctggacagtcagttaccatctcctgcactggaacctcaatgatgttggtgttatatctatgtctcctggtaccaacaacacgcagcaaacgccccgaagtcatcgatttangatgtacagtaagcggccctcgacggggtcctcgaccnccttctctcggctaccagtctggacaaccgcgccctccctgaccactctctcgcctccgagcngagnagngctgtactattatgctgtctacatatcgcgtagggccggtaacgttcgggtttaccggtagtttcggtccggttacggaaccgtcggggtaccctacgggtaaccgtcccggtacggtacggtaccgacgacccccgaagggtaaccccccc

SEQ ID NO: 379641 - DNA, 786 bp, Homo sapiens
  misc_feature: GZ8MTXP02JJ4QL.10.60.F05.1.454.CMB.2.raw
  modified_base (289)..(289): a, c, t, g, unknown or other
tcagcatagtagtgcacgaccggtgctcgatttagtacgtcatcagggaaagggggggtctcaggaggcagcactctcgggacgtctccaccatggcctgggctctgctcctcctcagcctcctcactcagggcacaggatcttgggctcagtctgccctgactcagcctcgctcagtgtccgggtctcctggacagtcagttaccatctcctgcactgacctcatgatgtgtgttatatctatgtctctgtaccaacacacgcagacaacgccccgaatcatgattangatgtacagtaacgccggtccctcgacggggtcctacgacccgcttcctcgtcggaccttccctagtcttacggacctaaccgccggtcccctcccgtacgacccgtactccttccgtacggtccctccgtaacgtcccgtaggaacgggtactacgggacgggtccgttacggttaaaccgtttacgtttaacggtttcgttacccggtttaccggtccccctttaggtaaaacgttccggtttaccgggaaccgggtaccggggggtaccccggttaaaaccccggggttttcccggggggttttacccccggggtttaaaaggtttccccgggggttaaaccggtttaaccccgggggttaaaaccccggtccgggggtaaaaccccccgttcccgggggttaacccgtaccccccgggtttaacccggtttacccgggggttacccgaaccccgggtaacccccccggttaaacccggtaaaaccccccccgg

SEQ ID NO: 379642 - DNA, 613 bp, Homo sapiens
  misc_feature: GZ8MTXP02G4SLN.10.60.F05.1.454.CMB.2.raw
  modified_base (199)..(199): a, c, t, g, unknown or other
  modified_base (256)..(256): a, c, t, g, unknown or other
tcagcatagtagtgcacgaccggtgctcgatttagtacgtcatcaggggaaaggggggggtctcaggaggcagcactctcgggactctccaccatggcctgggctctgctcctcctcagcctcctcactcagggcacaggatcttgggctcagtctgccctgactcagcctcgctcagtcgtccgggtctccgtggacngtcacgttaccattcctcctgctacgtcggaacctcaatgtatggttgtgttatatntatctctcgtcgtaaccaacacacgcgacgacaaccgccccgaagtcagtatatttagagtatgacgtaagtacgccgacccgtcggacgggttcctccggtaccgtccttcgtcgtcggtaccttcgacgttccgtaggacctaacgccggtccctaccgacgtaccctatccgtcgtcggacccttcgaggtcctggacgtagtagacgtcgtagtacttagttacgtcgtcgtagtctacagttagcgaggacgggtccgtacggttacggtcggtgttccgttacgtacggtaaccgtcggtaccgtcgtaaccgtacggtccgtacggacctaccgacgaacccgtaccccg

SEQ ID NO: 379643 - DNA, 663 bp, Homo sapiens
  misc_feature: GZ8MTXP02GOMCL.10.60.F05.1.454.CMB.2.raw
  modified_base (298)..(298): a, c, t, g, unknown or other
tcagcatagtagtgcacgaccggtgctcgatttagtacgtcatcagggaaagggggggtctcaggaggcagcactctcgggacgtctccaccatggcctgggctctgctcctcctcagcctcctcactcagggcacaggatcttgggctcagtctgccctgactcagcctcgctcagtcgtccgggtctccgtggacagtcagttaccatctcctgcactgacctcaatgatgtggtgttatatctatgtctcctgtaccaacaacacgcaggacaaacgccccgaatcatgatttangtatgtacagtacgcgcctcgacggggtcctacgaccgtcttcgtctacggccttaccgagttcctacggaccaaaccgcccgggtccctacccgtcgtaacccagttccctctacggcccttacgacggccttacggaacgggtactacggacgtacgttagtaacgtttagttagttcgtacgttacgtacctacgtacgttacgtacggtaccggtacggggtaccggttaccggttacggggtttaccgggttacggttcggttaaccggtaccgggtaaccggtaccggggtaacccgtaccggttcccgtaacccggttacggtacggtacccgaccggtaacccgaaccggtaccccc

SEQ ID NO: 379644 - DNA, 509 bp, Homo sapiens
  misc_feature: GZ8MTXP01C97P0.45.58.F03.1.454.CMB.2.raw
  modified_base (258)..(258): a, c, t, g, unknown or other
  modified_base (298)..(298): a, c, t, g, unknown or other
  modified_base (466)..(466): a, c, t, g, unknown or other
  modified_base (478)..(478): a, c, t, g, unknown or other
  modified_base (484)..(484): a, c, t, g, unknown or other
tcagacgcgatcgacacgaccggtgctcgatttagtctgatcgagaagggaaaggggaggaactgctcagttaggacccagacggaaccatggaggccccagcgcggcttctcttcctcctgctactctggctcccagataccactggagaaatagtgatgacgcagtctccagtcaccctgtctgtgtctccgaggggagacggccaccctctcctgcagggccagtcagtatgtagcacaattgcctggtaccaanagagacctgcccaggctacccaaactcctcatctctggtntatctaccagggccatggtcgtcccagacaggttcaagggcaggtgggtctgggacagagttcactctcaccatcagcggctgcagtctgaagtattttggacttttattactgtcagctagtataatcacgtgaccgtactacgtttggccggggaccaagctgganatcaaagactgngctgcncatctgtcttcattccttccgctaa

SEQ ID NO: 379645 - DNA, 520 bp, Homo sapiens
  misc_feature: GZ8MTXP01ESVVI.45.58.F03.1.454.CMB.2.raw
  modified_base (301)..(301): a, c, t, g, unknown or other
  modified_base (385)..(385): a, c, t, g, unknown or other
  modified_base (495)..(495): a, c, t, g, unknown or other
  modified_base (520)..(520): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgaggggagacggccaccctctcctgcagggccagtcagtatgttagcacaacttagcctggtaccaacagagacctgcccaggctcccaaactcctcatctctggtntatctaccagggccactggtcgtcccagacaggttcaagggcagtcggtctgggacagagttcactctcaccatcagcgctgcngtctagaagtatttggtactttattactgtcagcagtataagtctactgtccgtactcgtttgggaccggggtacaagtcgtaggagataacaaacgactgttggctgcncatctgtcttcacttctccgttctn

SEQ ID NO: 379646 - DNA, 512 bp, Homo sapiens
  misc_feature: GZ8MTXP01AW5TH.45.58.F03.1.454.CMB.2.raw
  modified_base (200)..(200): a, c, t, g, unknown or other
  modified_base (212)..(212): a, c, t, g, unknown or other
  modified_base (298)..(298): a, c, t, g, unknown or other
  modified_base (369)..(369): a, c, t, g, unknown or other
  modified_base (481)..(481): a, c, t, g, unknown or other
  modified_base (489)..(489): a, c, t, g, unknown or other
  modified_base (491)..(491): a, c, t, g, unknown or other
  modified_base (495)..(495): a, c, t, g, unknown or other
  modified_base (512)..(512): a, c, t, g, unknown or other
tcagacgcgatcgacacgaccggtgctcgatttagtctgatcgagaagggaaaggggaggaactgctcagttaggacccagacggaaccatggaggccccagcgcggcttctcttcctcctgctactctggctcccagataccactggagaaatagtgatgacgcagtctccagtcaccctgtctgtgtctccagggganacggccaccctntcctgcagggccagtcagtatgttagcacaattagcctggtaccacagagacctgcccaggcctcccaaactcctcatctctggtntatctaccagggcccagtggtcgtcccagaccaggttcaagggcaggtgggtctgggacagagttcactcncaccatcagcggctgcagtctgagtatttggtactttattactgtcagcagtataatcaacgtggaccgtactacgtttggccgggggacagctaggagatcaaacgatggngtctcgcncntctntctctcttcctccgctn

SEQ ID NO: 379647 - DNA, 515 bp, Homo sapiens
  misc_feature: GZ8MTXP01CWR8R.45.58.F03.1.454.CMB.2.raw
  modified_base (201)..(201): a, c, t, g, unknown or other
  modified_base (239)..(239): a, c, t, g, unknown or other
  modified_base (481)..(481): a, c, t, g, unknown or other
  modified_base (488)..(488): a, c, t, g, unknown or other
  modified_base (515)..(515): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccagggganacggccaccctctcctgcagggccagtcagtatgttancacaattgcctggtaccaacagagacctgcccaggcctcccaaactcctcatctctggtgtatctaccagggccagtggtctcccagacaggttcaaagggcaggtcgggtctgggacagagttcactctcacatcagcgctgcagtctgaatatttggactttagtactgtcagcaagtataagtcactgaccgtatcgtttcggcggggtaccaagtcgtaggagataacaaacgactgnggctgcnccatctagtcttcattccttcccgctn

SEQ ID NO: 379648 - DNA, 544 bp, Homo sapiens
  misc_feature: GZ8MTXP01E0WGH.45.58.F03.1.454.CMB.2.raw
  modified_base (202)..(202): a, c, t, g, unknown or other
  modified_base (239)..(239): a, c, t, g, unknown or other
  modified_base (257)..(257): a, c, t, g, unknown or other
  modified_base (296)..(296): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgagggganacggccaccctctcctgcagggccagtcagtatgtancacaattgcctgaccaanagagacctgcccaggctcccaaactcctcatctctggtntatctaccgagggccactgggtctccccaagacaggttcaaggggcaggtcgggtctggggacagtagttacactctcacatcagcggctgcagtctgaagtatttggtactttattactgtacagctaagtataatctacgtggacctacgtcgtttcgggccgggggaaccaaggtcgtaggacgtataacgaaacgacgtggttaggctgacgaccattctgttcttcacttccttcccgctaac

SEQ ID NO: 379649 - DNA, 586 bp, Homo sapiens
  misc_feature: GZ8MTXP01CS09J.45.58.F03.1.454.CMB.2.raw
  modified_base (202)..(202): a, c, t, g, unknown or other
  modified_base (240)..(240): a, c, t, g, unknown or other
  modified_base (257)..(257): a, c, t, g, unknown or other
  modified_base (260)..(260): a, c, t, g, unknown or other
  modified_base (294)..(294): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgagggganaccggccaccctctcctgcagggccagtcagtatgtancacaatgcctggaccanganactgcccagctacccaaactcctcatctctggtntatctaccaggggcccagtggtcgtaccccaggacctaggttcgaaaggggctaaggtcgggggtctagggggactaggacgtttaccacttctcaacccatcgacgcggcctgcagtcgtagtaagtatttggtactttattactgtcagtctaagttataactctaacgttcggaccgttacgtaccgttttcggggaccgggggtaaccaaggtccgtaggagaagtaacgaaacgttacgtagcggtacgtcgacgccatcctagtcttcacttccttcccgctaacg

SEQ ID NO: 379650 - DNA, 509 bp, Homo sapiens
  misc_feature: GZ8MTXP01B3JN7.45.58.F03.1.454.CMB.2.raw
  modified_base (201)..(201): a, c, t, g, unknown or other
  modified_base (438)..(438): a, c, t, g, unknown or other
  modified_base (465)..(465): a, c, t, g, unknown or other
  modified_base (478)..(478): a, c, t, g, unknown or other
  modified_base (484)..(484): a, c, t, g, unknown or other
  modified_base (509)..(509): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccagggganacggccaccctctcctgcagggccagtcagtatgttagcaccaacttagcctggtaccaacagagacctgcccaggctcccaaactcctcatctctggtgtatctaccagggcccactggtctcccagacaggttcaagggcagtcgggtctgggacagagttcactctcaccatcagcggcctgcagtctgatatttggactttattactgtcagcagtatatcactggacctacncgtttggccggggtacagtcgtaggantaacaaagactgngctgcnccatctgtcttcattcctcccgctn

SEQ ID NO: 379651 - DNA, 514 bp, Homo sapiens
  misc_feature: GZ8MTXP01D517G.45.58.F03.1.454.CMB.2.raw
  modified_base (239)..(239): a, c, t, g, unknown or other
  modified_base (254)..(254): a, c, t, g, unknown or other
  modified_base (257)..(257): a, c, t, g, unknown or other
  modified_base (260)..(261): a, c, t, g, unknown or other
  modified_base (286)..(286): a, c, t, g, unknown or other
  modified_base (304)..(304): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgaggggagacggccaccctctcctgcagggccagtcagtatgtancacattgcctgacanganacnnccagctccaactctcatctctggtntatctacaggccatggtntcccagacaggttcaagggcaggtcggtctgggacagagttcactctcacatcagcggctgcagtctagaagtatttggtactttattactgtcagctaagtataatcactggacctacgtacgtttgggaccggggtacagtctaggagataacaaacgaactgttacggctcggcgccatcctagtcttctacttccttcccgcctaa

SEQ ID NO: 379652 - DNA, 593 bp, Homo sapiens
  misc_feature: GZ8MTXP01EBU0M.45.58.F03.1.454.CMB.2.raw
  modified_base (203)..(203): a, c, t, g, unknown or other
  modified_base (305)..(305): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactcttgctcccagataccactggagaaatagtgatgacgcagtctccagtcaccctgtctgtgtctccgaggggganacggccaccctctcctgcagggccagtcagtatgttagcaccaattagcctaggtaaccaacagagacctgcccaggctacccaaactcctcatctctggtntatctacaggccatggtgtcccagacaggttcaaagggcaggtcgggtctaggggacagacgttcaactctacaccatcagccggctgctagtctagtaagtatttaggtaacttttattactgtcagtctaagtataagtctacgtggtaccgtacgtacgttttcgggaccgggggtaaccaagtcgttaggagaacgtaacaaacggttaagtcggttagggacttaggaccttaccgttacttcccttcgttccgttctaccgttcccgttcccgttcctaacg

SEQ ID NO: 379653 - DNA, 552 bp, Homo sapiens
  misc_feature: GZ8MTXP01B1DD3.45.58.F03.1.454.CMB.2.raw
  modified_base (243)..(243): a, c, t, g, unknown or other
  modified_base (257)..(257): a, c, t, g, unknown or other
  modified_base (259)..(259): a, c, t, g, unknown or other
  modified_base (261)..(262): a, c, t, g, unknown or other
  modified_base (264)..(264): a, c, t, g, unknown or other
  modified_base (267)..(267): a, c, t, g, unknown or other
  modified_base (273)..(274): a, c, t, g, unknown or other
  modified_base (277)..(278): a, c, t, g, unknown or other
  modified_base (280)..(280): a, c, t, g, unknown or other
  modified_base (282)..(282): a, c, t, g, unknown or other
  modified_base (286)..(286): a, c, t, g, unknown or other
  modified_base (293)..(293): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtccaccctgtctgtgtctccgaggggacgaccggcccaccctctcctgcagggccagtcagtatgtancacatgctagacangncnncngcnccatcnntcnngnancacngcatgcnccagcagtcgaggcaggtcggtctggacagtcttacactctcacatcgagccggtctgctagtctagtagttagtttggtaactttattactgttacgagtactaagttaacttaacgttaccgtacggttacggtacccgttacgttacggttttcgggggacccggggtaacaggtcgtaggaagtacgtaacgaaacgttcgtaggttcggctcgccttacttactcttcgtccttacgccttccctcccgcgtcg

SEQ ID NO: 379654 - DNA, 556 bp, Homo sapiens
  misc_feature: GZ8MTXP01BKKTC.45.58.F03.1.454.CMB.2.raw
  modified_base (261)..(261): a, c, t, g, unknown or other
  modified_base (301)..(301): a, c, t, g, unknown or other
  modified_base (380)..(380): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgaggggagaccggccaccctctcctgcagggccagtcagtatgttagcacaattgcctggtaccaangagacctgcccaggcctacccaaactcctcatctctggtntactctaccagggccacgtgggtctccccagactaggttcaaggggcaggtcgggtctggggacagtacgttcacttcncaccatcagccggctgctagtctgaagtattttggtaactttattactgtacagtctaagtataatctacgtcggtaccgttactacggtttcgggacccgggggtaaccaggtcgtagggacgtataacaaacgacgtggttgctgcacatctgtcttcacttcctcccgctaac

SEQ ID NO: 379655 - DNA, 574 bp, Homo sapiens
  misc_feature: GZ8MTXP01B90WZ.45.58.F03.1.454.CMB.2.raw
  modified_base (202)..(202): a, c, t, g, unknown or other
  modified_base (525)..(525): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgagggganacggccaccctctcctgcagggccagtcagtatgttagcaccaattagcctaggtaaccaacagacgacctgacccaggctcccaaactcctcatctctggtgtactctaccgagggcccacgtggtctacccagacgaggttcaagggcaggtcgggtctgggacagagttcactctcacatcagcggctgcagtcagagtatttggaactttattactgtcagtctagtataatctaacgtcggaccgttactacgtttcggggacccgggggtaacaacggtccgttaggaagtaacgtaacgaaaacgttacgttacgnggtctcggccgttacattctagttcttcacttcctaacccgttctaacg

SEQ ID NO: 379656 - DNA, 603 bp, Homo sapiens
  misc_feature: GZ8MTXP01EW3J0.45.58.F03.1.454.CMB.2.raw
  modified_base (202)..(202): a, c, t, g, unknown or other
  modified_base (238)..(238): a, c, t, g, unknown or other
  modified_base (251)..(251): a, c, t, g, unknown or other
  modified_base (254)..(254): a, c, t, g, unknown or other
  modified_base (256)..(256): a, c, t, g, unknown or other
  modified_base (285)..(285): a, c, t, g, unknown or other
  modified_base (298)..(298): a, c, t, g, unknown or other
  modified_base (500)..(500): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgagggganacggccacctctcctgcagggccagtcagtatgtancacatgctgacangancngccagctcccaaactcctcatctctggtntactcctaaccgngggccacgtgggtctcccagacaggttcaaggggcaggtcggtctgggacagacgttccactctacacctatcgaggcggctgcagtctagagtatttggtactttattactgtcagactaagtataactctaacgtcggtacccgtaacgtccgttttcgggacccgggggtaaccaaaggtccgttagggaacggttaanaaccgtaaaaccgttaacgtcggttagggccttacggaccgaacccgttattccgttacgttcctttcccgtacgtttcccgtttccccccgttccgttaacg

SEQ ID NO: 379657 - DNA, 640 bp, Homo sapiens
  misc_feature: GZ8MTXP01DQEWQ.45.58.F03.1.454.CMB.2.raw
  modified_base (202)..(202): a, c, t, g, unknown or other
  modified_base (262)..(262): a, c, t, g, unknown or other
  modified_base (293)..(293): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgagggganacggccacctctcctgcagggccagtcagtatgttagcacctaattgcctggtaaccaanagacgacctgcccaggcctacccaaactccncatctctggtgtatcctaccgacggcctacgtgggtcgtccccaagacctaggttcgaaggggctaggtcgggtctaggggacagtagttccactctaccaccatcgagcggtctgctagtctagtaagttattttaggtaacttttattacttgtacgagtctaagttagtaacttacgtacgttacggtaccgttaacgttacggttttacggggacccggggtaaccgaacggtacggtagggacgtaagtaaacgaaacgttaacgtcggttacggtccgtacgaccttacccttagttccgtacgttcctttactaccgttaccctttcccgttccgtaacg

SEQ ID NO: 379658 - DNA, 554 bp, Homo sapiens
  misc_feature: GZ8MTXP01E0JHJ.45.58.F03.1.454.CMB.2.raw
  modified_base (202)..(202): a, c, t, g, unknown or other
  modified_base (238)..(238): a, c, t, g, unknown or other
  modified_base (299)..(299): a, c, t, g, unknown or other
  modified_base (523)..(523): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgagggganacggccacctctcctgcagggccagtcagtatgtancacaattagcctggtaccaacagagacctgcccaggcctcccaaactcctcatctctggtntatctaccgagggccacgtggtcgtcccagacaggttcaaggggcaggtcgggtctggggacagagttcactctcaccatcagcggctgcagtctgaagtatttggtactttattactgtcagctagtataatcacgtgaccgttacgtacgttttcggggccgggggtaaccaaggtccgtagggacgaataacgaaaacggttacgtggttggactcggacnccattctgtccttcacttccttcccgctaac

SEQ ID NO: 379659 - DNA, 601 bp, Homo sapiens
  misc_feature: GZ8MTXP01D4Q11.45.58.F03.1.454.CMB.2.raw
  modified_base (202)..(202): a, c, t, g, unknown or other
  modified_base (240)..(240): a, c, t, g, unknown or other
  modified_base (263)..(263): a, c, t, g, unknown or other
  modified_base (293)..(293): a, c, t, g, unknown or other
  modified_base (303)..(303): a, c, t, g, unknown or other
  modified_base (356)..(356): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgagggganacggccaccctctcctgcagggccagtcagtatgttancacctaattgcctggtaaccaangagacctgcccaggcctacccaaactcctnatctctggtntatctaccgagggccaagtggtctcccaagtacaggttcaagggcaggtcggntagggacagtagttcactctacaccatcgagtccggactgcagtcgtagaagtattttaggtaactttatctgtcagcaataataatcaacgttcggaccgttaacgtaccgttttcggggaccgggggtaaccgaaagtccgttaggaacgtaagtaaccgaaaacgttacgtggttacgggcttacggaccgcgttacgttaacgtcgttaaccttctaccttcctttccccgccgttaaccg

SEQ ID NO: 379660 - DNA, 672 bp, Homo sapiens
  misc_feature: GZ8MTXP01D4IEF.45.58.F03.1.454.CMB.2.raw
  modified_base (241)..(241): a, c, t, g, unknown or other
  modified_base (262)..(262): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgaggggagacggcccaccctctcctgcagggccagtcagtatgttancaccaattgcctggtaccaangagacctgcccagcctacccaaactccctacactctcgtggtatactcctaaccgaggggccctacgttcgggtcgtaccccgaaggtaaccgtagggtttccgaaagggggtctaaggggttcggggtccgtagggggaacctaggtacgtttacccacgttcctaccaccctaatccgacggccggacctgctagtcgtagtaagttagttttaggtaacttttattacttgtcagtactaagtaattaatactacgttcgtaccgttacgtacgtttacggggaccggggtaacctaaggcgttaggaacgtacgtaaacgaaacgttaacgtggttacggcctcggaccttaccgttacttccgttcgttcccttctacgttcccttaaccccgttccgttaaccg

SEQ ID NO: 379661 - DNA, 550 bp, Homo sapiens
  misc_feature: GZ8MTXP01ADQQ3.45.58.F03.1.454.CMB.2.raw
  modified_base (201)..(201): a, c, t, g, unknown or other
  modified_base (239)..(239): a, c, t, g, unknown or other
  modified_base (259)..(259): a, c, t, g, unknown or other
  modified_base (287)..(287): a, c, t, g, unknown or other
  modified_base (321)..(321): a, c, t, g, unknown or other
  modified_base (374)..(374): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccagggganacggccaccctctcctgcagggccagtcagtatgttancaccaattgcctggaccaangagacctgcccaggctacccaaactccncatctctggtgtatctaccgagggccactgggtntccccaggacaggttcaaggggcaggtcgggtctggggacagtagttcactcncaccatcagcggctgcagtctgaagtatttggtactttattactgtcagctagtatatcacgtggaccgttactacgtttcgggaccggggacctaaggtccgtaggacgtactaacgaaacgttaacgtgttcggtctgacgccttactctgtccttcacttccttcccgctaac

SEQ ID NO: 379662 - DNA, 650 bp, Homo sapiens
  misc_feature: GZ8MTXP01CPAQK.45.58.F03.1.454.CMB.2.raw
  modified_base (202)..(202): a, c, t, g, unknown or other
  modified_base (262)..(262): a, c, t, g, unknown or other
  modified_base (293)..(293): a, c, t, g, unknown or other
  modified_base (391)..(391): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctccagataccactggagaaatagtgatgacgcagtctccagtcaccctgtctgtgtctccgaggggganaccggccaccctctcctgcagggccagtcagtatgtagcactaacttgcctaggaccaanagacgacctgcccagcctacccaaactcctnactctcgtggtatactcctaccgagggtccacgttggtctacccagacgtaggttcaagggcaggtcgggctaggggactagacgttcactctacacntccgagccggtcctgctagtctagtaagtagttttggtacttttattacttgtacagtactaagttaataatctaacgtcggtaccgttacgttaccgttttacggggacccggggtaaaccgtaaggtaccgtagggtaacgaacgttaacggaaaaccggttaccgttagggttacggtaccgttacggacccgttaccgttaacttccgttacgtttcctttacctaccgtttccccttcccggttccctttaacg

SEQ ID NO: 379663 - DNA, 625 bp, Homo sapiens
  misc_feature: GZ8MTXP01D9CMR.45.58.F03.1.454.CMB.2.raw
  modified_base (442)..(442): a, c, t, g, unknown or other
  modified_base (601)..(601): a, c, t, g, unknown or other
  modified_base (608)..(608): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggcctcccagataccactggagaaatagtgatgacgcagtctccagtcaccctgtctgtgtctccgaggggagaccggccaccctctcctgcgacgggccagtcagtatgttagcaacctaacttagcctacggtaaccaagagacgacctcgacccaggcctacccaaactcctcactctcgtggtctactcctaaccgagggcctacgtgggtcgtacccagacgtaggttacgaagggcgtaggtcggtcgaggggtttacagtcgttacactcgtacacatcgagtcggctgctagtctagtaagttntttaggttaactttattactgtacagacttaagtacttatcgtacgttacgtaccgttacgttaaccggtttcggggaccggggtaaacctaggtaccggtaggtaacgtaataaacgaaacgttacgttggttacgtctcggacttcttacttcgttntcttacncttccctcccgaattcg

SEQ ID NO: 379664 - DNA, 584 bp, Homo sapiens
  misc_feature: GZ8MTXP01COLI8.45.58.F03.1.454.CMB.2.raw
  modified_base (237)..(237): a, c, t, g, unknown or other
  modified_base (251)..(253): a, c, t, g, unknown or other
  modified_base (255)..(256): a, c, t, g, unknown or other
  modified_base (258)..(258): a, c, t, g, unknown or other
  modified_base (267)..(268): a, c, t, g, unknown or other
  modified_base (272)..(272): a, c, t, g, unknown or other
  modified_base (275)..(275): a, c, t, g, unknown or other
  modified_base (277)..(277): a, c, t, g, unknown or other
  modified_base (551)..(551): a, c, t, g, unknown or other
  modified_base (577)..(577): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctccagataccatggagaaatagtgatgacgcagtctccagtcacctgtctgtgtctccgaggggacaccggccaccctctcctgcagggccagtcagtatgtancacattgctgacannncnncngcaccatcnntctntgntnctacgaggcagtgctaccagactaggtcaaggcaggtggtctagggctagtacgttccactcctacacctaagtccgacgggtccggccttaggctaggtactagtaagttagttttacggtaactttttacgttacgttagtaccgtaagtactaaagttattaacgtacgttacgtacggtaccgttacgttacggtttcggggacccgggtacgtagtcgtagtacgaataacgaaacgttcgtggttcgactacgccacgttatccgttntccttccgtacttacccgtcccgttntaacccg

SEQ ID NO: 379665 - DNA, 623 bp, Homo sapiens
  misc_feature: GZ8MTXP01EO2ZW.45.58.F03.1.454.CMB.2.raw
  modified_base (246)..(246): a, c, t, g, unknown or other
  modified_base (265)..(265): a, c, t, g, unknown or other
  modified_base (269)..(269): a, c, t, g, unknown or other
  modified_base (271)..(272): a, c, t, g, unknown or other
  modified_base (292)..(292): a, c, t, g, unknown or other
  modified_base (296)..(296): a, c, t, g, unknown or other
  modified_base (319)..(319): a, c, t, g, unknown or other
  modified_base (457)..(457): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggcctcccagatacccatggagaaatagtgatgacgcagtctccagtccaccctgtctgtgtcctccgaggggacaccggcccaccctctcctggcacgggccagtcagtatgtancaacattgcctagaaccanagancnnccagctaccaactctcatcntgtntactctacgacggccagtggtcncccagacgtaggttacaaggggctagggtcggtcgtaggggactaggtacgttcccaactcctacaaccagtccgaggccggtctgacctagtcgtaagtaagttagtttaggttaacttttattacgtgtacacgtntaaattactaacgtcgtacgtacgtaccgttaacgttacgggtttccggggaaccggggtaaacctaggtacgtaggaacgtaacaaacgtaaacggttacgtggttacgcgtacgacttccttacgttcctgttaacctcgtaccttccctaacccgttgtaacg

SEQ ID NO: 379666 - DNA, 576 bp, Homo sapiens
  misc_feature: GZ8MTXP01EQLX1.45.58.F03.1.454.CMB.2.raw
  modified_base (201)..(201): a, c, t, g, unknown or other
  modified_base (238)..(238): a, c, t, g, unknown or other
  modified_base (252)..(254): a, c, t, g, unknown or other
  modified_base (258)..(258): a, c, t, g, unknown or other
  modified_base (268)..(268): a, c, t, g, unknown or other
  modified_base (270)..(270): a, c, t, g, unknown or other
  modified_base (275)..(275): a, c, t, g, unknown or other
  modified_base (278)..(278): a, c, t, g, unknown or other
  modified_base (280)..(280): a, c, t, g, unknown or other
  modified_base (284)..(284): a, c, t, g, unknown or other
  modified_base (290)..(290): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcacctgtctgtgtctccgagggganacggccaccctctcctgcagggccagtcagtatgtancacattgctgacannnactncagctccaancnatctngtnancacngcatgntccagcagtcaaggcaggtcggctggacagcgttacactctcacatcagtcggcctgcagtctgaacgtatttggtaactttattactgtcagtctaagtaataactcgtacgttggtaccgttaacgtacgttttacggggaccgggggtaaacctaaagggtccgtagggtaaagtaacgtaaccgtaaaaacgttaccgtaggttaccgggctacgggttaccgttaaccgttacgtttcctcggttaacctttaccactttccctccccgttcgttaacccg

SEQ ID NO: 379667 - DNA, 523 bp, Homo sapiens
  misc_feature: GZ8MTXP01DWJ3O.45.58.F03.1.454.CMB.2.raw
  modified_base (201)..(201): a, c, t, g, unknown or other
  modified_base (324)..(324): a, c, t, g, unknown or other
  modified_base (361)..(361): a, c, t, g, unknown or other
  modified_base (396)..(396): a, c, t, g, unknown or other
  modified_base (476)..(476): a, c, t, g, unknown or other
  modified_base (497)..(497): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccagggganacggccaccctctcctgcagggccagtcagtatgttagcaccaacttagcctggtaaccaacagagacctgccccaggctcccaaactcctcatctctggtgtatctaccagggccactggtntcccagacaggttcaagggcaggtcggtctggggacngagtcatctcaccatcagcgctgcagtctgaagtntttggtactttattactgtcagctaagtataatcactcgccgtactacgtttcgggccggggaaccaagtcgtaggacgntaacaaacgactgttgctgcnccatctgtcttcattccttccgctaa

SEQ ID NO: 379668 - DNA, 624 bp, Homo sapiens
  misc_feature: GZ8MTXP01ALTNR.45.58.F03.1.454.CMB.2.raw
  modified_base (244)..(244): a, c, t, g, unknown or other
  modified_base (258)..(258): a, c, t, g, unknown or other
  modified_base (283)..(283): a, c, t, g, unknown or other
  modified_base (289)..(289): a, c, t, g, unknown or other
  modified_base (294)..(294): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtccaccctgtctgtgtctccgaggggacgaccggcccaccctctcctgcgagggccagtcagtatgtancacatgctggacanagcactgccagcctacccaactccncatctntggtntactccgtaccgacgggccctacgtcgggtcgtacccagaccgtaggttacgaaggggctagggtcggggtcgtaggggactaggtacgttaccaccgttctaccaacctatcgacgggccggtcctagacgtagtacgtagtaagttagttttacggtaacttttattacgtggtactaggtactaagtataacgtcgtacgtcggacccgttacgttaccggtttcggggaccgggggtaacacggtcgtaggacgtacgtaacgaaacgttacgtcggttcggtctcgccgttcttactcttcgtcttctacttcccgtcccgctcg

SEQ ID NO: 379669 - DNA, 755 bp, Homo sapiens
  misc_feature: GZ8MTXP01DMAH5.45.58.F03.1.454.CMB.2.raw
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcacctgtctgtgtctccgaggggacgacggcccaccctctcctgcagggccagtcagtatgttagcacctaattgcctaggtaaccaagagacgacctcgaccccgaggaccctaccctaaacctcctacacttcctcgttggttactaccttccgtaacccggacgggtacccctaacgttcggggttccgtacccccgaaggtaccgtagggtttaccgaaaggggtcctaggggttcgggtcgtaggggaactaggtcgttacccaacttcgtaccaccgtaatccgaacgggtcccggtacgtgacgtacgttacgtaggtaaacgtttagttttacggttaaccttttagtttaccgttagttacgaagtaacgttaagttaaacttaacggttaccgtaacggttcggttacccgttaacggttaccgggttttaccgggggacccgggggtaaacctacggtcggttaacgggaagtaaccgtaaacgtaaacggttacgtcgggttacggtaccgtacggttacccacgttattccgttcgttccttactccgttcccttcccgaacttcg

SEQ ID NO: 379670 - DNA, 556 bp, Homo sapiens
  misc_feature: GZ8MTXP01BQB0F.45.58.F03.1.454.CMB.2.raw
  modified_base (241)..(241): a, c, t, g, unknown or other
  modified_base (406)..(406): a, c, t, g, unknown or other
  modified_base (526)..(526): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgaggggagaccggcccaccctctcctgcagggccagtcagtatgtancacattgcctggtaccacagagacctgcccaggcctacccaaactcctcatctctggtgtatcctaccgaggggccacgtggtcgtaccccagaccaggttcaaggggcaggtcggtctggggacagcgttcactctcaccatcagcggcctgcagtctgaagtntttaggtactttattactgtacagtctaagttataatctacgtcggtccgttacgtacgtttcggggacccggggtaccaaggtcgtaggtagactaacgaaacgacgtgttgtcgtgcncgatctgtcttctacttcttcccgctaacg

SEQ ID NO: 379671 - DNA, 624 bp, Homo sapiens
  misc_feature: GZ8MTXP01EFX5I.45.58.F03.1.454.CMB.2.raw
  modified_base (201)..(201): a, c, t, g, unknown or other
  modified_base (239)..(239): a, c, t, g, unknown or other
  modified_base (256)..(256): a, c, t, g, unknown or other
  modified_base (260)..(260): a, c, t, g, unknown or other
  modified_base (293)..(293): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcacctgtctgtgtctccgagggganacggcccacctctcctgcgagggccagtcagtatgtancactaattgctgaacangacnctgcccagcctacccaactcctcatctctggtntactcctaaccgcgggcctagtcggtctaccccgaagtaccgtaggttaccgaaggggtctaggttccggggtacgtaggggactaggtacgttccaacttcctacaaccctagtccgaggccggtctgacctagttactaggtaagtttagttttaggttaacctttttagttacgtcgtacagtactaagttactaactcgtagtccggtaccgtacgttacgttcggggaccgggtaacaggtccgtagaacgtaactaacgaaacgttacgtggttcggactgaccgttacttctcgtattcttcgacttcccgttcccgcttaacg

SEQ ID NO: 379672 - DNA, 937 bp, Homo sapiens
  misc_feature: GZ8MTXP01B3OA7.45.58.F03.1.454.CMB.2.raw
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggaagaaatagtgatgacgcagtctccagtcacctgtctgtgtctccgaggggacaccggccaccctctcctgccgagggccagtctaagtatgttacgcctaacctaattcgccgttacggtaaacccaaagacggaacgacccctcggacccccgaacggtaccctaacccccaaaaccttcccctactaactttccgtaccgttgggttagttaccttaccccgttaacccggacgggggtacccctaaacggttttcgggggtacccgttaacccccgaaggtaaccgttaacgggggtttaccgggaaaaacgggggtcccgttaaaggggggtttcccggggggttaccgttacgggggggggaaaaccctaaggggggtttaacccgtttaaaccccgtaaccgtttaaccccgttaaacccaaccccccgttaaagttaccccgaaaccgggggccccgggttccccgttacggtacccggtaaggttacccggttaaaggttaaaacggttttaagtttttaacgggttaaacttttttacgtttaaccgttagggtacctaaggtacctaaagttaaacttaaactcgtaaacggttccgggtacccgtttaccgttacgggtttaccggggaccgggggtaacctaacggtcgttaaacgggacgtaactaaacggaaaccgttaaacgttggggttacgtacgtcggacccgttaccgttacgttccttacggttccttcctacctttccccgggttaaccccgttaacgtttaaccg

SEQ ID NO: 379673 - DNA, 589 bp, Homo sapiens
  misc_feature: GZ8MTXP01E34CV.45.58.F03.1.454.CMB.2.raw
  modified_base (201)..(201): a, c, t, g, unknown or other
  modified_base (263)..(263): a, c, t, g, unknown or other
  modified_base (311)..(311): a, c, t, g, unknown or other
  modified_base (396)..(396): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccagggganacggccaccctctcctgcagggccagtcagtatgttagcacaacttagcctaggtaaccaanagacgacctgccccaggcctacccaaactccctacactctcgtggttntactcctaaccgagggcccaacgtgggtactccccaagacgtaggttacaaggggcaggtcgggtctggggacagtagtcactcncacatcagcggctgcagtctagaagtatttcggtactttattactgtacagtactaagtaataaacgtctaacgtcggtacccgtaacgtaccgtttcggggacccgggggtaacaaggtcgtagggaacgataacgaaaacgttacgtggttcgcgtcgccaccattctgtccttcacttcctcccgctaac

SEQ ID NO: 379674 - DNA, 628 bp, Homo sapiens
  misc_feature: GZ8MTXP01A9CSG.45.58.F03.1.454.CMB.2.raw
  modified_base (202)..(202): a, c, t, g, unknown or other
  modified_base (239)..(239): a, c, t, g, unknown or other
  modified_base (258)..(258): a, c, t, g, unknown or other
  modified_base (297)..(297): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgagggganaccggccacctctcctgcagggccagtcagtatgtancacaattgcctggtaccangagacctgcccaggctacccaaactcctcatctctggtntatctaccagggccagtggtcgtcccagacgtaggttcaaggggctaggtcgggtctggggacaggtacgttacacgtctaccaccatcgagtccggctgacagtctagagtatttggtactttattactgtcagtactagtataacgtctacgtcggtacccgttacgtaccgtttacggggacccgggggtaacctaaacggtccgtagggaacgtacgttaaccgaaaacgttaccgtagggttacggccgttacggaccgttacccttacttccggttcgttcccgtttacctacctttaccccgttccccgttaacccgttaaccg

SEQ ID NO: 379675 - DNA, 677 bp, Homo sapiens
  misc_feature: GZ8MTXP01BIRSP.45.58.F03.1.454.CMB.2.raw
  modified_base (244)..(244): a, c, t, g, unknown or other
  modified_base (269)..(269): a, c, t, g, unknown or other
  modified_base (273)..(273): a, c, t, g, unknown or other
  modified_base (301)..(301): a, c, t, g, unknown or other
  modified_base (312)..(312): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgaggggagaccggcccaccctctcctggccagggccagtcagtatgttancacctaattagcctaggtaaccaanaganaccctgcccaggcctacccaaactcctnatctcgtggtntatcctacgaggcctacgtggtctcccagacgtaggttcaaggggcagggtcgggtctgggacaggtagttccactctcaccctatccgaggccgtctgctagtcgtagaagtttatttaggttactttagttactggtacagtactaagttacttaaacgtccgtacgttaccgggtaccgtttaaccgttaccgggttttccgggggaacccggggtaacccgtaaagggtcggttacggggaaacgtaacgtaaaccggtaaaccggttaaacgttcgggttaccgggtactacggttaacccttaccttacggtttccttagttccctttacctaccgttcccgttccccgttcttaaccg

SEQ ID NO: 379676 - DNA, 704 bp, Homo sapiens
  misc_feature: GZ8MTXP01AM2C7.45.58.F03.1.454.CMB.2.raw
  modified_base (265)..(265): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggcctcccagataccactggagaaatagtgatgacgcagtctccagtccaccctgtctgtgtctccgaggggacaccggccaccctctcctgcagggccagtcagtatgtagcaactaacttgcctagaaccaangacgacctgacccagcctacccaaactcctacactctctggtatactccgtaccgacggcctacgtcggtcgtacccgagtacgtaggttaccgaaggggtctaggggttcggggtacgtagggggactaggtacgtaccctactcgtaccaacccagtccgacggtcccggcttgcgtagttacgtaggtaagttagtttacggttaacttttagtactgtactacgtactaagttaatacgtacgtacggttccgggtacgttaccgttaccgggtttaccggggacccgggggtaacctaacggtacgtaacgggaactacggttaaaccgaaacgttaacggtacggttacgggtacctaggttacccgaccttacgtttaacccgttcgttaacctttacctaccggttccccgtttaaccccgcgtttaaccg

SEQ ID NO: 379677 - DNA, 698 bp, Homo sapiens
  misc_feature: GZ8MTXP01BM10V.45.58.F03.1.454.CMB.2.raw
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggaagaaatagtgatgacgcagtctccagtccaccctgtctgtgtcctccgagggggacacggcccaccctctcctgcagggccagtcagttatgttagctaacctaacttagccctagggtaaccaacgagacgacctcgcccagcctacccaaactcctacactctctggtcgtactcctaaccgacgggtccctacggtcgggtcgtaccccgtaagaccgtaggttacgaaaggggtctagggtcggggtacgtaggggaactaggtacgttaccacgtcctaccgaaccctagtccgacggtccggtactcggactagtctagtaacgttagttttacggttaacttttagttactgtactagtactagttaacttacgtcgtacgtcggtaccgttacgtaccggtttcggggaccgggtaaccaaggtcgtaaggacgtaacgtaaccgaaacgttacgtcggttacggtacgtcggaccgttaccttacgtttcccttcgtttaaccttacgtacctttcccgttaaccccgttcctttaacg

SEQ ID NO: 379678 - DNA, 617 bp, Homo sapiens
  misc_feature: GZ8MTXP01E0WD7.45.58.F03.1.454.CMB.2.raw
  modified_base (272)..(272): a, c, t, g, unknown or other
  modified_base (317)..(317): a, c, t, g, unknown or other
  modified_base (328)..(328): a, c, t, g, unknown or other
  modified_base (575)..(575): a, c, t, g, unknown or other
  modified_base (580)..(580): a, c, t, g, unknown or other
  modified_base (590)..(590): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggcctcccagataccactggagaaatagtgatgacgcagtctccagtcaccctgtctgtgtcctccgaagggacgaccggcccacccctctcctgccgagggccagtcagtatgtagcaactaacttgccttaggaaccaanagacgacctcgacccaggcctacccaaactcctcatctcgtggtntactcctacgngggcctagtcggtctacccgagtacgtaggttacgaagggtcaggttccgggtcgtaggggaacctaggtcgttaacccacttcctaccacctatccgagggtccggtctagcgtatcgtagtaaagttgttttggttaactttagttactgttacagtactaagttaatacgtctagtcggtaccgtagttcggttcgggaccgggtaaccagtcgtaggactagtaacgaaagttactggcgtcncgacnccttatcgtnttcctactcttcccgtccgttctaacg

SEQ ID NO: 379679 - DNA, 586 bp, Homo sapiens
  misc_feature: GZ8MTXP01A9NTU.45.58.F03.1.454.CMB.2.raw
  modified_base (202)..(202): a, c, t, g, unknown or other
  modified_base (242)..(242): a, c, t, g, unknown or other
  modified_base (249)..(249): a, c, t, g, unknown or other
  modified_base (256)..(258): a, c, t, g, unknown or other
  modified_base (260)..(261): a, c, t, g, unknown or other
  modified_base (273)..(273): a, c, t, g, unknown or other
  modified_base (275)..(276): a, c, t, g, unknown or other
  modified_base (280)..(280): a, c, t, g, unknown or other
  modified_base (284)..(284): a, c, t, g, unknown or other
  modified_base (293)..(293): a, c, t, g, unknown or other
  modified_base (304)..(304): a, c, t, g, unknown or other
  modified_base (330)..(330): a, c, t, g, unknown or other
  modified_base (528)..(528): a, c, t, g, unknown or other
  modified_base (579)..(579): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgagggganaccggccacccctctcctgcgagggccagtcagtatgtancacattnctgacannncnncagctaccaacncnntctntgtntatctaccnggccatggtcnccagcgtaggtcaaggcaggtcggtntaggggactagtacgttccactccgtacaacccagtccgaggccgggccttgacctagttacgtaggtaagttagttttaggtaacttttattacctgtacgagactagtaataacgtcacgtcgtaccgttacgtacggtttacggggccggggaaccaaggtcgtaggaacgtataaaccgaaacttacgggggtnttgggactcgcgttacccttagttctacgttctactcttcccgtaacccgngtaaccg

SEQ ID NO: 379680 - DNA, 745 bp, Homo sapiens
  misc_feature: GZ8MTXP01CQZMS.45.58.F03.1.454.CMB.2.raw
  modified_base (201)..(201): a, c, t, g, unknown or other
  modified_base (216)..(216): a, c, t, g, unknown or other
  modified_base (261)..(261): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctccagataccatggagaaatagtgatgacgcagtctccagtcaccctgtctgtgtctccgaggggganccggccacctctccngcagggccagtcagtatgttagcactaacttgcctaggtaccaanacgacgacctcgcccaggcctacccaaactccctacacttctcgttggtagtaccttccgtaacccgacgggtaccccacggttcgggttacgacccccgaaggtaccgtagggtttaaccgaaagggggtcctaagggttcccgggggtacgttacgggggaactaacggtaacggttttccaaccgttcctaccgtaacccgtaacgttacccggacgggtaccggggtccctaacggtccgtacggttaccgtaggtaaacgggttagttttaacgggttacttttacgttacgttacgttacgaacggtctaaaggttaactaaacggggttcacggttaccggtaccgttacgtacggtttccggggaccgggggtacaacggtcgtaggtacgaacgtaaccgtaaaacgttcgtacggttgtaccgtcgttacgccttacgttctacgtcttactacttcccgttaaccgcgttaac

SEQ ID NO: 379681 - DNA, 543 bp, Homo sapiens
  misc_feature: GZ8MTXP02JGND3.45.58.F03.1.454.CMB.2.raw
  modified_base (261)..(261): a, c, t, g, unknown or other
  modified_base (302)..(302): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgaggggagacggccaccctctcctgcagggccagtcagtatgttagcacaattagcctggtaccaanagagacctgcccaggcctacccaaactcctcatctctggtntatctacgaggcccagtggtcgtcccagacaggttcaaggggcaggtcgggtctggggacagtagttcactctcaccatcagcgcctgcagtctgaagtattttggtactttattactgtcagctagtataatcacgtggaccgtactacgtttcgggaccgggggtacaagcgtaggagactacgaaaacgacgtcggtaggctcgaccaccatctgtcttcacttccttcccgactacg

SEQ ID NO: 379682 - DNA, 563 bp, Homo sapiens
  misc_feature: GZ8MTXP02JL96X.45.58.F03.1.454.CMB.2.raw
  modified_base (405)..(405): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccaggggagacggccaccctctcctgcagggccagtcagtatgttagcaccaacttagcctggtaccaacagagacctgcccaggcctcccaaactcctacatctctggtgtatcctaccagggccacgtgggtctccccagacaggttcaagggcaggtcgggtctggggacagtagttcactctcaccatcagcggctgcagtctgaagtntttaggtacttttatactgtcagtctagttataatcacgttcggtaccgttacgtaccgtttggggacccgggggtaccaaggcgtaggagacgtacgaaaacgacgtggtaggtctcgacctaccatcgtcgttcttcacttcccttcccgactacg

SEQ ID NO: 379683 - DNA, 522 bp, Homo sapiens
  misc_feature: GZ8MTXP02IS2HR.45.58.F03.1.454.CMB.2.raw
  modified_base (200)..(200): a, c, t, g, unknown or other
  modified_base (300)..(300): a, c, t, g, unknown or other
  modified_base (396)..(396): a, c, t, g, unknown or other
tcagacgcgatcgacacgaccggtgctcgatttagtctgatcgagaagggaaaggggaggaactgctcagttaggacccagacggaaccatggaggccccagcgcggcttctcttcctcctgctactctggctcccagataccactggagaaatagtgatgacgcagtctccagtcaccctgtctgtgtctccagggganacggccaccctctcctgcagggccagtcagtatgttagcaccaacttagcctggtaccaacagagacctgcccaggctcccaaactcctcatctctggtntatctaccagggccactggtcgtcccagacaggttcaaggggcagtgggtctgggacagagttcactctcaccatcagcgcctgcagtctgaagtnttttggactttattactgtcagctagtataatctactggcgtacacgtttggaccgggggtaccaagctaggagatacaaacgaactgtacggctcgcaccatctgtcttcattccttcccgctac

SEQ ID NO: 379684 - DNA, 520 bp, Homo sapiens
  misc_feature: GZ8MTXP02IH0BN.45.58.F03.1.454.CMB.2.raw
  modified_base (303)..(303): a, c, t, g, unknown or other
  modified_base (363)..(363): a, c, t, g, unknown or other
tcagacgcgatcgacacgaccggtgctcgatttagtctgatcgagaagggaaaggggaggaactgctcagttaggacccagacggaaccatggaggccccagcgcggcttctcttcctcctgctactctggctcccagataccactggagaaatagtgatgacgcagtctccagtcaccctgtctgtgtctccaggggagacggccaccctctcctgcagggccagtcagtatgttagcaccaacttagccctggtacccaacagagacctgcccaggctcccaaactcctcatcctctggtntatctaccagggccactggtgtcccagacaggttcaaggggcagtgggtctggggacagngttcactctcacatcagcgcctgcagtctgaagtattttggacttttattactgtacagcagtataaatcatggcgtacacgtttggaccggggtaccaaggctggagatacgaaaacgaactgtaggctgcacatctgtcttcattcctccactac

SEQ ID NO: 379685 - DNA, 525 bp, Homo sapiens
  misc_feature: GZ8MTXP02HIXUX.45.58.F03.1.454.CMB.2.raw
  modified_base (201)..(201): a, c, t, g, unknown or other
  modified_base (301)..(301): a, c, t, g, unknown or other
  modified_base (322)..(322): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccagggganacggccaccctctcctgcagggccagtcagtatgttagcacaattagcctggtaccaacagagacctgcccaggcctacccaaactcctcatctctggtntatctaccagggccactggtntcccagacaggttcaaggggcaggtcgggtctggggacagagttcactctcacatcagcgcctgcagtctgaagtatttgtactttattactgtcagcagtataatcactggaccgtactacgtttcgggaccggggaccgaacgcgtggagatacaaaacgaactcgtggctcgcacatctgtcttcactccttcccgctac

SEQ ID NO: 379686 - DNA, 543 bp, Homo sapiens
  misc_feature: GZ8MTXP02HT4JS.45.58.F03.1.454.CMB.2.raw
  modified_base (201)..(201): a, c, t, g, unknown or other
  modified_base (305)..(305): a, c, t, g, unknown or other
  modified_base (359)..(359): a, c, t, g, unknown or other
  modified_base (393)..(393): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccagggganacggccaccctctcctgcagggccagtcagtatgttagcaccaacttagcctggtaccaacagagacctgcccaggcctaccccaaactcctacatctctggtntatctacagggccatggtctcccagacaggtcaagggcagtggtctgggacagngttcactctcaccatcagcgctgcagtctgaatntttgactttatactgtcagctagtataatctatgacgtactacgtttcggaccggggtacaggctagggagtacgtacgaaaacgtaactggtacggactcgacctacctatccgttgtacctttacactttcccttcccgtaccttacg

SEQ ID NO: 379687 - DNA, 548 bp, Homo sapiens
  misc_feature: GZ8MTXP02FRNH2.45.58.F03.1.454.CMB.2.raw
  modified_base (201)..(201): a, c, t, g, unknown or other
  modified_base (302)..(302): a, c, t, g, unknown or other
  modified_base (397)..(397): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccagggganacggccaccctctcctgcagggccagtcagtatgttagcaccaacttgcctggtaccaacagagacctgcccaggcctacccaaactcctcatctctggtntatctaccgagggcccacgtggtcgtcccagaccgtaggttcaaggggcaggtgggtctggggacagagttcactctcaccatcagcggcctgcngtctgaagtatttggtactttattactgtcagtctagtataatctactcggtaccgtactacgtttcgggaccggggacaagcgtaggagaatacgaaacgaatcggtagcgtcgaccacctatcgtcgttcttcacttcctcccgctacg

SEQ ID NO: 379688 - DNA, 639 bp, Homo sapiens
  misc_feature: GZ8MTXP02HM1EZ.45.58.F03.1.454.CMB.2.raw
  modified_base (260)..(260): a, c, t, g, unknown or other
  modified_base (299)..(299): a, c, t, g, unknown or other
tcagacgcgatcgacacgaccggtgctcgatttagtctgatcgagaagggaaaggggaggaactgctcagttaggacccagacggaaccatggaggccccagcgcggcttctcttcctcctgctactctggctcccagataccactggagaaatagtgatgacgcagtctccagtcaccctgtctgtgtctccaggggagacggccaccctctcctgcagggccagtcagtatgttagcaccaattagcctggtaccaanagagacctgcccaggctcccaaactcctcatctctggtntatctaccagggccatggtgtccccagacctaggtactacggaggagacgggtcggtcggacggactaggtacttactccttccaccaacgtactacgacgggccgtccgtcgtaccgtacgttacgtaaggtaagttttaggttttacgtttaacttttaacttacgttcgttacacgtaagtaagtttaaatacttactacggtaccggtacctaacgtttcgggtttacgggggacccgggtaacgacgttcggtaagggactaacgaaacgaaaccgtaacggttggcggtacgtcgacctaactcgttcgttcttctactccttccctccgtacc

SEQ ID NO: 379689 - DNA, 525 bp, Homo sapiens
  misc_feature: GZ8MTXP02ILV4V.45.58.F03.1.454.CMB.2.raw
  modified_base (262)..(262): a, c, t, g, unknown or other
  modified_base (303)..(303): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgaggggagacggccaccctctcctgcagggccagtcagtatgttagcaccaattagcctggtaccaanagagacctgcccaggcctacccaaactcctcatctctggtntatctaccagggccatggtctcccagacaggtcaagggcaggtcggtctgggacagagttcactctcaccatccagcgctgcagtctagaagtatttgtactttattactgtcagcatataatctatgtacgtacgtcgtttgggaccggggactaagcgtagagatacgaaacgactgtacggactcgactacatctcgtcttctactccttcccgactac

SEQ ID NO: 379690 - DNA, 547 bp, Homo sapiens
  misc_feature: GZ8MTXP02I7F28.45.58.F03.1.454.CMB.2.raw
  modified_base (202)..(202): a, c, t, g, unknown or other
  modified_base (253)..(253): a, c, t, g, unknown or other
  modified_base (255)..(255): a, c, t, g, unknown or other
  modified_base (258)..(258): a, c, t, g, unknown or other
  modified_base (284)..(284): a, c, t, g, unknown or other
  modified_base (474)..(474): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgagggganacggccaccctctcctgcagggccagtcagtatgttagcacatgctgacangnacngccagctccaactcctcatctctgtntatcctacgaggccagtggtctacccagactaggtcaagggcaggtcgggtctggggacagtagttccactctcacatcagcgctgctagtctagaagttatttgtactttatactgtacgagtactagtataactctacgtcggaccttaacgttacgtttcggggaccggggaacaggtcgtaggganacgtaacaaacgaactggtacggctacgactacctagtccgtacgttcttacacttcccttacccgacttacg

SEQ ID NO: 379691 - DNA, 546 bp, Homo sapiens
  misc_feature: GZ8MTXP02JVDCY.45.58.F03.1.454.CMB.2.raw
  modified_base (303)..(303): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccaggggagacggccaccctctcctgcagggccagtcagtatgttagcaccaacttagcctggtaccaacagagacctgcccaggcctacccaaactcctcatctctggtntatctaccaggccacgtggtcgtcccagacaggttcaagggcaggtcgggtctggggacaggagttcactctcacatcgagcggcctgcagtctgaagtatttagtactttattactgtcagcagtataatctactggtccgtactacgtttcgggaccggggtacgaaggtcgtaggagacgtacgaaacgactaggtcggtactcgactacatcgtcgttcttcactccttcccgtctacg

SEQ ID NO: 379692 - DNA, 578 bp, Homo sapiens
  misc_feature: GZ8MTXP02GZ3XB.45.58.F03.1.454.CMB.2.raw
  modified_base (201)..(201): a, c, t, g, unknown or other
  modified_base (255)..(256): a, c, t, g, unknown or other
  modified_base (288)..(288): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccagggganaccggccaccctctcctgcagggccagtcagtatgttagcacattgcctgacannagactgccagctccaactcctcatctctggtntatcctaccgaggccagtggtctcccagacaggttacaagggctaggtcgggtctggggacaggtacgttccacttcctcacccatccgagtccggctgctagtctagtaagtagtttggtactttacgttactagtactagcgtaagtattaatactacgtcggtaccgttacgtacgttttcgggacccgggggtactaacggtcgtaggaacgacgtaacgaaaacgtagtacgtacggtacgtacgacctactactcgttcgtcttactacttccttcccgactac

SEQ ID NO: 379693 - DNA, 542 bp, Homo sapiens
  misc_feature: GZ8MTXP02FMK6Q.45.58.F03.1.454.CMB.2.raw
  modified_base (201)..(201): a, c, t, g, unknown or other
  modified_base (302)..(302): a, c, t, g, unknown or other
  modified_base (355)..(355): a, c, t, g, unknown or other
  modified_base (374)..(374): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccagggganacggccaccctctcctgcagggccagtcagtatgttagcaccaacttagcctggtaccaacagagacctgcccaggctacccaaactcctcatctctggtntatctaccagggccacgtggtctcccagacaggttcaagggcaggtcgggtcnggggacagtagttcactcncacatcagcggcctgcagtctgaagtatttggtactttattactgtcagctagtataatcactggaccgtactacgtttcggaccggggtacaaggcgtaggagactacgaaaacgaactggtacgtctcgacactacgtctcgttacttctactccgttccccactc

SEQ ID NO: 379694 - DNA, 547 bp, Homo sapiens
  misc_feature: GZ8MTXP02J2TT6.45.58.F03.1.454.CMB.2.raw
  modified_base (202)..(202): a, c, t, g, unknown or other
  modified_base (239)..(239): a, c, t, g, unknown or other
  modified_base (259)..(259): a, c, t, g, unknown or other
  modified_base (299)..(299): a, c, t, g, unknown or other
  modified_base (373)..(373): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgagggganacggccaccctctcctgcagggccagtcagtatgtancacattagcctggtaccaangagacctgcccaggcctacccaaactcctcatctctggtntactctaccgagggcccacgtggtctcccagacaggttcaagggcaggtcgggtctggggacagagttcactcncaccatcgagcggcctgcagtctagaagtatttgactttatactgtacagcagtatatcatggaccgttatacgtttcggggaccgggggtacaaggtccgtaggacgactacgaaaaccgtatggtacgctcgcctaacctatccgtgttccttctactcccttcccgctacg

SEQ ID NO: 379695 - DNA, 559 bp, Homo sapiens
  misc_feature: GZ8MTXP02FT072.45.58.F03.1.454.CMB.2.raw
  modified_base (203)..(203): a, c, t, g, unknown or other
  modified_base (241)..(241): a, c, t, g, unknown or other
  modified_base (292)..(292): a, c, t, g, unknown or other
  modified_base (303)..(303): a, c, t, g, unknown or other
tcagacgcgatcgacacgaccggtgctcgatttagtctgatcgagaaggggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgagggganacggccaccctctcctgcagggccagtcagtatgttancaccaattgcctggtaaccaacagagacctgcccaggcctcccaaactccncatctctggtntatctacagggccacgtggtcgtcccagactaggttcaagggcagtcggtctgggacagtgttcactcacacctatcagcggcctggcgtctgaagtagtttggtactttatactgtacagactagtataatctacgtgtaccgttacgtacgtttacgggaccgggggtaactaggtcgtaggagtacgtacgaaaacgtacgtggtacgtactacgacctaccatcgtgtcttactactccttacccgctactc

SEQ ID NO: 379696 - DNA, 554 bp, Homo sapiens
  misc_feature: GZ8MTXP02JJOXM.45.58.F03.1.454.CMB.2.raw
  modified_base (260)..(260): a, c, t, g, unknown or other
  modified_base (300)..(300): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgaggggagacggccaccctctcctgcagggccagtcagtatgtagcaccattagcctggtaccaanagagacctgcccaggcctcccaaactcctcatctctggtntatctaccgagggcccacgtggtcgtccccagactagggttcaaggggcaggtcggggtctggggacaggtgttcactctcacatcagcgcctgcagtctgaagtagttttaggtactttattactgtcagctagtataatctactcggtaccgttactacgtttcgggaccggggaccgagcgtaggagatacaaaacgacgtacggtggactcgaccaccgtatcgtacgttcttcacttccttcccgctac

SEQ ID NO: 379697 - DNA, 602 bp, Homo sapiens
  misc_feature: GZ8MTXP02F3H4L.45.58.F03.1.454.CMB.2.raw
  modified_base (202)..(202): a, c, t, g, unknown or other
  modified_base (240)..(240): a, c, t, g, unknown or other
  modified_base (263)..(263): a, c, t, g, unknown or other
  modified_base (266)..(266): a, c, t, g, unknown or other
  modified_base (303)..(303): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgagggganacggccaccctctcctgcagggccagtcagtatgttancaccaacttagcctggtaccaanagnacctgcccaggcctacccaaactcctcatctctggtntatctaccagggcccatggtctcccagacgtaggttcaagggcaggtcgggtctggggacagtagttccaactctcaccatccagcggcctgcagtctgaaatgttttgtactttattactgtcagtctaagtaataatctacgtcggtacccgttaacgtaaccgttttcgggggacccgggggtaacgtaaacggtccggttagggaagtaacgtaaccgaaaacgtaacgttcggtagggtactcggaccaacctactaacgttcgttaccttacgtacttccttccccgacttac

SEQ ID NO: 379698 - DNA, 582 bp, Homo sapiens
  misc_feature: GZ8MTXP02IQ4DG.45.58.F03.1.454.CMB.2.raw
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgaggggagacggccaccctctcctgcagggccagtcagtatgttagcacaattagcctggtaccaacagacgacctgcccaggcctcccaaactcctcactctctggtgtactctaccagggcccagtggtcgtcccagacaggttcaaggggcaggtgggtctagggacagagttcactctcacatcgagcgactgcagtctgaagtattttggaacttttagtactgtcagtctagttaataatctacgtggtaccgtacttacgtttcggggacccggggacctaaggccgttagggaagacgttacgaaaacggtacgttggtacgggacttcggacctaccgtattcgttcgttactttcacgttccctttaacccgcttacc

SEQ ID NO: 379699 - DNA, 520 bp, Homo sapiens
  misc_feature: GZ8MTXP02FO3G7.45.58.F03.1.454.CMB.2.raw
  modified_base (199)..(199): a, c, t, g, unknown or other
  modified_base (442)..(442): a, c, t, g, unknown or other
tcagacgcgatcgacacgaccggtgctcgatttagtctgatcgagaagggaaggggaggaactgctcagttaggacccagacggaaccatggaggccccagcgcggcttctcttcctcctgctactctggctcccagataccactggagaaatagtgatgacgcagtctccagtcaccctgtctgtgtctccagggganacggccaccctctcctgcagggccagtcagtatgttagcaccaacttagccctggtaccaacagagacctgcccaggctccccaaaactcctcatctctggtgtatctaccaggggccactggtgtcccagacaggtttcaaggggcagtggggtctggggacagagttcactctcaccatcagcggcctgcagtctgaagatttggacttattactgtcagcagtataatcactggccgtanaccttttggccgggggtaccaagctgggagatacaaaacgactagtggctgcaccatctgtcttcatctcccgcctac

SEQ ID NO: 379700 - DNA, 572 bp, Homo sapiens
  misc_feature: GZ8MTXP02I1OFY.45.58.F03.1.454.CMB.2.raw
  modified_base (200)..(200): a, c, t, g, unknown or other
tcagacgcgatcgacacgaccggtgctcgatttagtctgatcgagaagggaaaggggaggaactgctcagttaggacccagacggaaccatggaggccccagcgcggcttctcttcctcctgctactctggctcccagataccactggagaaatagtgatgacgcagtctccagtcaccctgtctgtgtctccagggganacggccaccctctcctgcagggccagtcagtatgttagcaccaattgcctggtaccaacagagacctgcccaggcctcccaaatccctcatctctggtgtactctaccagggcccactggtctccccaggaccagggttccaaaggggccaggtcggggtctggggacaggtagttccacttctcaccatcagcggcctgcagtctgaagtattttggacttttagtactgtcagtctagtataatctatggaccgttactacgtttgggaccggggtaccaagccgtaggagtactacaaaacggtactggtacggctacggacctacccgatccgttgttaccttcactttcccttcccccgtacttacg

SEQ ID NO: 379701 - DNA, 611 bp, Homo sapiens
  misc_feature: GZ8MTXP02FLSZY.45.58.F03.1.454.CMB.2.raw
  modified_base (202)..(202): a, c, t, g, unknown or other
  modified_base (240)..(240): a, c, t, g, unknown or other
  modified_base (256)..(256): a, c, t, g, unknown or other
  modified_base (299)..(299): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgagggganacggccaccctctcctgcagggccagtcagtatgttancacattgcctgaccanagagacctgcccaggcctacccaaactcctacactctctggtntactcctaccgagggccacgtggtcgtcccagactaggttcgaagggtcaggtcgggtcgtggggacaggtacgttccacgttcctcaacctatccgagcggcctgcagtctagtaagtagtttagtactttattactgtacagtctaagtataacgtctaacgtcggtacccgtaacgttaccggttttacggggacccgggggtaaccgaaggtccgtagggaacgtaacgtaacgaaaacgtaacgtggtacggcgtacgaccgtaccgtacttcgtacgttcttacctcgttcccgtaccctcttacg

SEQ ID NO: 379702 - DNA, 510 bp, Homo sapiens
  misc_feature: GZ8MTXP02FO5F6.45.58.F03.1.454.CMB.2.raw
  modified_base (200)..(200): a, c, t, g, unknown or other
  modified_base (299)..(299): a, c, t, g, unknown or other
  modified_base (434)..(434): a, c, t, g, unknown or other
tcagacgcgatcgacacgaccggtgctcgatttagtctgatcgagaagggaaaggggaggaactgctcagttaggacccagacggaaccatggaggccccagcgcggcttctcttcctcctgctactctggctcccagataccactggagaaatagtgatgacgcagtctccagtcaccctgtctgtgtctccagggganacggccaccctctcctgcagggccagtcagtatgttagcacaacttagcctggtaccaacagagacctgcccaggctcccaaactcctcatctctggtntatctaccagggccactggtgtcccagacaggttcaagggcagtggtctggggacagagttcactctcaccatcgagcggcctgcagtctgaagatttggacttattactgtcagcagtataatcactgccgtanacgtttggccggggtacaagctaggagatacaaacgaactgtaggctgacaccatctgtcttcatcttcccgctac

SEQ ID NO: 379703 - DNA, 578 bp, Homo sapiens
  misc_feature: GZ8MTXP02IBGHE.45.58.F03.1.454.CMB.2.raw
  modified_base (201)..(201): a, c, t, g, unknown or other
  modified_base (239)..(239): a, c, t, g, unknown or other
  modified_base (253)..(253): a, c, t, g, unknown or other
  modified_base (257)..(257): a, c, t, g, unknown or other
  modified_base (289)..(289): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccagggganaccggccaccctctcctgcagggccagtcagtatgtancacattgctgacanaganactgccaggctccaaactcctcatctctggtntactcctaccgagggccagttggtctcccagacgaggttcaaggggcaggtcgggtctggggacaggtagttcactctcaccatcagcgctgcagctagagtatttgtactttagttactgtcagtcaagttataactcgtactcggtaccgttacgtaccggtttcggggacccgggggtaactaacggcgttagggagtaactaccgaaaacgtaactggttaggacttcggaccctaacgtacttcgtacgttcctttacgtacgttcccgtttacccgacttacg

SEQ ID NO: 379704 - DNA, 552 bp, Homo sapiens
  misc_feature: GZ8MTXP02ITPXC.45.58.F03.1.454.CMB.2.raw
  modified_base (261)..(261): a, c, t, g, unknown or other
  modified_base (302)..(302): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgaggggagacggccaccctctcctgcagggccagtcagtatgtagcaccaattagcctggtaccaanagagacctgcccaggcctacccaactcctacatctctggtntatcgtaccgagggccagtggtctccccagactagggttcaaggggctaggtcggggtctggggacaggtagttccactctcaccatccgagcggcctgcagtcgtagtaagttatttaggtactttattacttgtcagctagtatatcactcggtcgtactcgtttcgggaccgggacagcgtaggagatacgaaacgtacgtggtagctcgaccaccgtatcgtcgtacttctacttcctcccgctac

SEQ ID NO: 379705 - DNA, 628 bp, Homo sapiens
  misc_feature: GZ8MTXP02HPXRJ.45.58.F03.1.454.CMB.2.raw
  modified_base (262)..(262): a, c, t, g, unknown or other
  modified_base (304)..(304): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgaggggagacggccaccctctcctgcagggccagtcagtatgttagcaccaattagcctggtaccaanagagacctgacccaggcctacccaaactcctcatctctggtntatctaccgagggccacgtggtctcccgagactaggttcaaggggcaggtcgggtctaggggacaggtacgttcacgtctacacatccgagccggctgctagtctagaagtgttttaggtactttattactgtacagtacgtaagtaacttaaattactacgtacgggtaccgttaacgtaccgttttcgggggacccgggggtaccaaacggtccgttaggtaacgaacgttaaccgaaaacggtacgtaggttacggcgtacgacctaacccgtattccgtcgttacctttccaactttccctttacccggtacctttaacg

SEQ ID NO: 379706 - DNA, 502 bp, Homo sapiens
  misc_feature: GZ8MTXP02F2GMZ.45.58.F03.1.454.CMB.2.raw
  modified_base (202)..(202): a, c, t, g, unknown or other
  modified_base (239)..(239): a, c, t, g, unknown or other
  modified_base (252)..(254): a, c, t, g, unknown or other
  modified_base (256)..(257): a, c, t, g, unknown or other
  modified_base (259)..(259): a, c, t, g, unknown or other
  modified_base (262)..(262): a, c, t, g, unknown or other
  modified_base (266)..(266): a, c, t, g, unknown or other
  modified_base (268)..(269): a, c, t, g, unknown or other
  modified_base (271)..(272): a, c, t, g, unknown or other
  modified_base (274)..(274): a, c, t, g, unknown or other
  modified_base (276)..(276): a, c, t, g, unknown or other
  modified_base (280)..(280): a, c, t, g, unknown or other
  modified_base (287)..(287): a, c, t, g, unknown or other
  modified_base (291)..(291): a, c, t, g, unknown or other
  modified_base (294)..(294): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgagggganacggccaccctctcctgcagggccagtcagtatgtancacatgctgacannncnncngcncaancnntnngnancacnggcatgnccanacngtcaaggcagtggtctgggacagagttcactctcacatcgagcgcctgcagtctagaatatttgtaactttattactgtcagctaagtaataaatcacgtcggtaccgttaactacgtttcggggaccggggtacgaaagcgtaggaagaataacaaaacgtaactggtggctcgacacctaatcgtctcttcacttcctcccactac

SEQ ID NO: 379707 - DNA, 564 bp, Homo sapiens
  misc_feature: GZ8MTXP02JS6EI.45.58.F03.1.454.CMB.2.raw
  modified_base (256)..(256): a, c, t, g, unknown or other
  modified_base (260)..(260): a, c, t, g, unknown or other
  modified_base (283)..(283): a, c, t, g, unknown or other
  modified_base (293)..(293): a, c, t, g, unknown or other
  modified_base (314)..(314): a, c, t, g, unknown or other
  modified_base (345)..(345): a, c, t, g, unknown or other
  modified_base (351)..(351): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccaggggagacggccaccctctcctgcagggccagtcagtatgtagcacaattgcctggaccanaganactgcccagctacccaactcctnatctctggtntatctaccagggccactggtntcccagaccaggttcaagggcagtcgggtcngggacngtagttcactctcaccatccagccggcctgcagtctagaagtatttggtactttattactgtcagactagtataactcgtactcgggtccgttacgtacgttttcgggacccgggggtaacaacggcgtagggagtacgtacgaaaacggaaacgtggtcggtactcgacacctactcgttcgttacttactacgttcccttacccgcctacg

SEQ ID NO: 379708 - DNA, 614 bp, Homo sapiens
  misc_feature: GZ8MTXP02F3F1X.45.58.F03.1.454.CMB.2.raw
  modified_base (240)..(240): a, c, t, g, unknown or other
  modified_base (260)..(260): a, c, t, g, unknown or other
  modified_base (304)..(304): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgaggggagacggccaccctctcctgcagggccagtcagtatgttancaccattgcctggtaccaanagacgacctgcccaggcctacccaaactcctacatcctctggtntatcctaccgaggccacgtggtctcccagactaggttcaaggggctaggtcggggtctggggacagtagttccacgttcctcaccctagtccagccgggcctgccgtagtactaggtaagttagttttaggtactttattacttagttacagtcgtaagtataaactctacgtcggtaccgttacgtacggtttcgggaccgggggtaactaaggtcgtagggtaacgtacgtaacgtaaaacggtacgtacggtacggctacgaccaaccgtatcgttacgtctttacgacttcccgtcccgacttacg

SEQ ID NO: 379709 - DNA, 532 bp, Homo sapiens
  misc_feature: GZ8MTXP02HXUWM.45.58.F03.1.454.CMB.2.raw
  modified_base (200)..(200): a, c, t, g, unknown or other
  modified_base (260)..(260): a, c, t, g, unknown or other
tcagacgcgatcgacacgaccggtgctcgatttagtctgatcgagaagggaaaggggaggaactgctcagttaggacccagacggaaccatggaggccccagcgcggcttctcttcctcctgctactctggctcccagataccactggagaaatagtgatgacgcagtctccagtcaccctgtctgtgtctccagggganacggccaccctctcctgcagggccagtcagtatgtagcaccaattagcctggtacccaanagagacctgcccaggcctcccaaactcctcatctctggtgtatctaccagggcccactggtgtcccagacaggttcaaaggggcaggtcgggtctggggacaggagttcactctcacatcagcggcctgcagtctgaagtattttggtacttttattactgtctagcagttataatcactggccgtactacgtttgggccggggtacaagcgtggagagtacaaacgactaggtcggctcgacaccatctcgtcttcactccttcccgctac

SEQ ID NO: 379710 - DNA, 573 bp, Homo sapiens
  misc_feature: GZ8MTXP02I4ARA.45.58.F03.1.454.CMB.2.raw
  modified_base (202)..(202): a, c, t, g, unknown or other
  modified_base (301)..(301): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgagggganacggccaccctctcctgcagggccagtcagtatgttagcaccattagcctggtaccacagagacctgcccaggcctacccaaactcctcatctctggtntatctaccagggcccagtggtcgtcccagaccaggttcaaggggcaggtcgggctggggacagagttcactctacactatcgagcggcctgcagtctgaagtagtttgtacttttagttactgtacagactagttataatctacgtggtaccgtactcgtttacgggaccgggggtaccgaacggcgtagggaagacgttaacgaaaacggtacgtaggtacggccgtagacctaccatcctagttcttctacttcccttccgtccctaacg

SEQ ID NO: 379711 - DNA, 633 bp, Homo sapiens
  misc_feature: GZ8MTXP02GWK8Q.45.58.F03.1.454.CMB.2.raw
  modified_base (201)..(201): a, c, t, g, unknown or other
  modified_base (239)..(239): a, c, t, g, unknown or other
  modified_base (260)..(260): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccagggganacggccaccctctcctgcagggccagtcagtatgttancaccattagcctggtaccaanagagacctgcccaggcctacccaaactcctcatctctggtctatctaccagggccacgtggtctcccagactaggttcaaggggtcaggtcggggtctaggggacaggacgttccacgttctcacatcgacgcggcctgcagtctagaagtatttggtactttattactgtcagctaagtataaagtctaacgtcggaccgttaacgtacgttttcggggacccgggggtactaaacggtccgtagggtaacgaacgttaccgaaaacggtaccgttaggttacggggaccttacgggtaccaacccgtacgtttaaccgttcggtttccctttaaccgaccgtttaccccttttccccggaaccctttaccg

SEQ ID NO: 379712 - DNA, 619 bp, Homo sapiens
  misc_feature: GZ8MTXP02H1EW3.45.58.F03.1.454.CMB.2.raw
  modified_base (240)..(240): a, c, t, g, unknown or other
  modified_base (263)..(263): a, c, t, g, unknown or other
  modified_base (306)..(306): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgaggggagaccggccacctctcctgcagggccagtcagtatgttancaaccaattagcctagtaccaanagacgacctgcccaggcctacccaaactcctcactctctggtntattcctaccgaggggccacgttggtcgtaccccagtaacgtagggttaccgaaaggggctagggtcggggtccgtaggggaccaaggtacgtttccaccttctacaacctatccgacgccggcctagcctagtcgtagaagttagttttaggttacttttattacgtgtactagactaagttataactactacgttcgtaccgttacgtacgtttcggggaccggggtacagcgtagagaagtacgaaaacgtaacgtgtacggactcgacctactacttcgtcttaccttctactttccgtacccgtctac

SEQ ID NO: 379713 - DNA, 697 bp, Homo sapiens
  misc_feature: GZ8MTXP02G5DA4.45.58.F03.1.454.CMB.2.raw
  modified_base (265)..(265): a, c, t, g, unknown or other
  modified_base (268)..(268): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgaggggagaccggcccacccctctcctgcgagggccagtcagtatgttagcaccaattgcctggtaccaanagngacctgacccaggcctacccaaactcctcactctcgtgtagtatcctaccgacgggtcccacgtggtctacccagaccgtggttacgaaggggctaggtcggggtcgtaggggactagtcgttaccacttccgtaccaacccgtaagttcccgaacggggtcccgggtaccccttggaccgtacgttccggttaggtaaaggtttacgtttttacgggtttaactttttacgttacgttacggttacgtacgtacgttaaaggttattaaacgttaccgttacgtaccggtaccgttaaccgttacggttttaccgggggacccggggtaaccaaggtcgtaggtacgaacgtaacgaaaacgtacgtggtacgtcgtacgtaccacctatccgttacgttccttactcgtcccttacccgtactaccg

SEQ ID NO: 379714 - DNA, 525 bp, Homo sapiens
  misc_feature: GZ8MTXP02FUVVJ.45.58.F03.1.454.CMB.2.raw
  modified_base (201)..(201): a, c, t, g, unknown or other
  modified_base (239)..(239): a, c, t, g, unknown or other
  modified_base (358)..(358): a, c, t, g, unknown or other
  modified_base (366)..(366): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgaggganacggccaccctctcctgcagggccagtcagtatgttancaccaacttagcctggtaccaacagagacctgcccaggcctacccaaactcctcatctctggtgtatctaccgagggccacgtggtcgtcccagacgaggttcaagggcaggtgggtcngggacagngttcactctcacatcagcggcctgcagtctagaagtatttaggtactttagttactgtcagcagtataatcactgaccgtactcgtttggaccggggtacagcgtaggagatacaaacgtactgtggctcgcacatctgtctctactcctcccgctacg

SEQ ID NO: 379715 - DNA, 588 bp, Homo sapiens
  misc_feature: GZ8MTXP02H9OHJ.45.58.F03.1.454.CMB.2.raw
  modified_base (242)..(242): a, c, t, g, unknown or other
  modified_base (260)..(260): a, c, t, g, unknown or other
  modified_base (263)..(263): a, c, t, g, unknown or other
  modified_base (265)..(265): a, c, t, g, unknown or other
  modified_base (283)..(283): a, c, t, g, unknown or other
  modified_base (292)..(292): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgaggggagaccggcccacccctctcctgcagggccagtcagtatgtancaccaattgcctgaccangancngccagcctcccaatcctnatctctgtntatctacaggccagtggtctacccagactaggttcaaggggctaggtcgggtctggggacagtacgttccactctacacatccgagccgctgactagtctagtaagttagtttagtacttttattacgtgtacagtactagtataatctacgtcggtaccgttacgttaccggtttacgggggacccggggtaacgacggtacggtaggtaacgtaactacgaaaacgtaacgtggtacggactcgacctaaccgtacgttcgtcgttaccttactacgttcccttcccgactacg

SEQ ID NO: 379716 - DNA, 763 bp, Homo sapiens
  misc_feature: GZ8MTXP02HPA3V.45.58.F03.1.454.CMB.2.raw
  modified_base (264)..(264): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgaggggagaccggccaccctctcctgcagggccagtcagtatgttagcaccaattagcctaggtaccaanagacgacctgcccaggcctaccccaaacctcctacactcctcgtggttcgtactccgtaccgacgggccctacgtcgggtcgtaccccagtacgtaggttacgaaaggggtcgtaggttcggggtaccgtaggggactaggttacgtttaccaacgttcccgttaaccaacctacgttaccgacgggcccggtccgtacggtaccgtacgttaccgttaggtaaaacggtttacgttttttaggggttaaacctttttaagtttacgttacgtttaccgaagtaccgttaaaggtttaaacttaaacttacccgtaacgtttaccgggttaacccgttaacggtttaaccgggttttaccgggggacccgggggtaaacctaacggggtccgtagggtaaacgtaacgtaaccgtaaaaccggtaggtacggtcggacgttacgacgtaacctagttccgtcgttacctttactaccgttccctttacccgtacttacg

SEQ ID NO: 379717 - DNA, 614 bp, Homo sapiens
  misc_feature: GZ8MTXP02GE7BX.45.58.F03.1.454.CMB.2.raw
  modified_base (202)..(202): a, c, t, g, unknown or other
  modified_base (215)..(215): a, c, t, g, unknown or other
  modified_base (240)..(240): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (277)..(278): a, c, t, g, unknown or other
  modified_base (282)..(282): a, c, t, g, unknown or other
  modified_base (287)..(287): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgagggganaccggccaccctntcctgcagggccagtcagtatgtancacattagctgacanagnacngccagctaccaactcnntctntggtntactcaccgaggccagtggtctcccagacgaggttacaaggggctaggtcgggtactaggggacagtgtcctactcctacacagtcgacgccggtcctgactagtcgtagtaagttagttttagttactttatttaccgtagttacgacgtacgttaagttaactaaacttacgtaccgtacggtaccgttacgttaccggttttaccgggggacccggggtaccgtaacggtacgtacgggaagtaactaacgtaaacgtacggtacggtcgtcgtacgacctacgtacttcgtcgttctttacctaccttccgttacccgctacg

SEQ ID NO: 379718 - DNA, 657 bp, Homo sapiens
  misc_feature: GZ8MTXP02GKYA7.45.58.F03.1.454.CMB.2.raw
  modified_base (202)..(202): a, c, t, g, unknown or other
  modified_base (262)..(262): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgagggganacggccacctctcctgcagggccagtcagtatgttagcacaacttagcctggtaaccaanagagacctgcccaggcctacccaaactcctcatctctgtgtatcctaccgagggcccacgtgggtcgtccccaaggtaccgtaggttacgaaggggccagggttcgggtcgtaggggacaggtcgttcactctcgacatcgacgcggcctgcctagtctagtaagtgttttagtactttattacttggtactagactaagttaataactactaacgtcggtaccgttaattacggttttcgggggaacccggggttaccaaaggtccgtagggaacgtaacgtaacgaaaacggttaacgtcggtcggtaccgtacggaccctaaacccgttacgtttccggtttaccgtttaccgtttacccgtaccgtttaccccgttaccccgtacttaacg

SEQ ID NO: 379719 - DNA, 729 bp, Homo sapiens
  misc_feature: GZ8MTXP02H4KZU.45.58.F03.1.454.CMB.2.raw
  modified_base (233)..(233): a, c, t, g, unknown or other
  modified_base (238)..(238): a, c, t, g, unknown or other
  modified_base (256)..(256): a, c, t, g, unknown or other
  modified_base (260)..(260): a, c, t, g, unknown or other
  modified_base (286)..(286): a, c, t, g, unknown or other
  modified_base (296)..(296): a, c, t, g, unknown or other
tcagacgcgatcgacacgaccggtgctcgatttagtctgatcgagaagggaaaggggaggaactgctcagttaggacccagacggaaccatggaggccccagcgcggcttctcttcctcctgctactctggctcccagataccatggagaaatagtgatgacgcagtctccagtcaccctgtctgtgtctccgaggggagaccggccaccctctcctgcagggccagtcagtntgtancaccattagcctgaccanaganacctgcccagcctacccaactctacntctcgtggtntatcctaccgacggggcctagtcggtctaccccgagaccgtagggttaccgaaaggggtctagggttccggggtactcggggaactaggtacgtttccaacctcgtaccaacctacgtcgaacggtcccgggccttacgggtacgtacgtaccgttaggtaaagttagtttttacgggttaaacttttttaacgtttacttacggttactaacgtacgtaaagttaaataaactttacgtaacgttaccgggtaccgttaaccggttacggtttttaccgggggacccggggggttaacccgaaacgggttaccggaagggtaacggttaaactaacggtaaaaccgtaaccggttagggtacggtaccgtacggaccgtaccgtaacgttccgttacgttaccttcctactttcccttaccccgtacttccg

SEQ ID NO: 379720 - DNA, 607 bp, Homo sapiens
  misc_feature: GZ8MTXP02JMUL3.45.58.F03.1.454.CMB.2.raw
  modified_base (299)..(299): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgaggggagacggccacccctctcctgcagggccagtcagtatgttagcaccaacttagcctaggtaaccaacaagacgacctcgcccaggacctcccaaactccncatctctggtgtactcctaccgacgggccacgtggtcgtcccagacgtacgggttacgaaggggctaggtcggggtcgtaggggacaggtgttcacgtcctccacactcgacggtccggcctgaccgtagttacgtagtaaagttagtttttacggtacttttagttactgtcagtacgtagtaataacgtcgtacgtcggtaccgtacttacggtttcgggacgggacagcgtagacgatacgaaacgtactggtcgacgtacgacgacctatcgtcttaccttacacttcccgtttaccgctaacg

SEQ ID NO: 379721 - DNA, 611 bp, Homo sapiens
  misc_feature: GZ8MTXP02GZEHG.45.58.F03.1.454.CMB.2.raw
  modified_base (240)..(240): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (292)..(292): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgaggggagaccggccaccctctcctgcagggccagtcagtatgtancacatgcctgaccanganacngccagcctacccaaactcctcatctctggtntactctaccgagggcccagtggtcgtccccagacaggttcgaaggggctagggtcgggtctaggggacaggtacgttcacgtctccactagtccgacggcgcctgcagtctagtaagttgtttagtacttttagtacttgtacagtctaagttaataactctaacgtcggtaccgtacgttacgtttcggggacccgggtaaccaaggtccgtagggagtacgtaacgaaacggtacgttggtacggtctacggacctaacccgtattccgttacgtttaccttaccgtacctttccccggtttaccccacgtttaacg

SEQ ID NO: 379722 - DNA, 609 bp, Homo sapiens
  misc_feature: GZ8MTXP02JRK5L.45.58.F03.1.454.CMB.2.raw
  modified_base (264)..(264): a, c, t, g, unknown or other
  modified_base (306)..(306): a, c, t, g, unknown or other
  modified_base (538)..(538): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgaggggagaccggccacccctctcctgcagggccagtcagtatgttagcaccaattagcctggtaccaanagagacctgcccaggcctacccaaactcctacatctctggtntatcctaccgaggggcccacgtcgggtctaccccgaggtaccgtagggttaccgaaaggggctagggtcggggtctaggggacaggtacgttcacttctacacctatccagccggcctgctagtctagtaagtagtttaggtactttagttactagtacgagtctaagtataactctacgtggtaccgttactacggtttcggggacccgggggtaactaggtccgtagganagtaccaaacggtaactggtacggctcggacctaccgatctacgttcttacacttaccttcccgacttacg

SEQ ID NO: 379723 - DNA, 725 bp, Homo sapiens
  misc_feature: GZ8MTXP02FN7DV.45.58.F03.1.454.CMB.2.raw
  modified_base (203)..(203): a, c, t, g, unknown or other
  modified_base (252)..(252): a, c, t, g, unknown or other
  modified_base (255)..(255): a, c, t, g, unknown or other
  modified_base (274)..(274): a, c, t, g, unknown or other
  modified_base (278)..(278): a, c, t, g, unknown or other
  modified_base (282)..(282): a, c, t, g, unknown or other
  modified_base (292)..(292): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggaagaaatagtgatgacgcagtctccagtcaccctgtctgtgtctccgagggganacgccacctctctgcagggccagtcagtatgtagcacaatgctgaccanagnactgccagctaccaatcantctntgtntactctacgngggcctagtcggtcgtacccagtacgtagggttacgaaaggggtctaaggttccggggtactaggggacctaggtacgtttccaacgttccgtaccaaccctagttaccgacgggtccggtacccttaggtaccgtacggttaccgttaagggtaaacggtttagttttacggggttaacttttaacgttacgttacggttaacgaacggtaccgttaaaggtttaaacttaaacgttccgtaacgttacgggttacccgttacgttaccgggttttacgggggaccccgggggtaactaaacggtcggtaagggtacgttaacgtaaccgtaaaacggtacgttcgggtacgtaccgtacgaccgtaaccgtagttaaccgttacgtttaccgttaacgtaccgtttacccgttaccccggtacttaaacgg

SEQ ID NO: 379724 - DNA, 768 bp, Homo sapiens
  misc_feature: GZ8MTXP02HL1JD.45.58.F03.1.454.CMB.2.raw
  modified_base (202)..(202): a, c, t, g, unknown or other
  modified_base (259)..(259): a, c, t, g, unknown or other
  modified_base (301)..(301): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgagggganacggccaccctctcctgcagggccagtcagtatgtagcacaattgcctggtaccaanagacgacctgcccaggcctacccaaactcctcatctctggtntactcctaccgacgggccctacgtggtcgtaccccaaggacgtagggttacgaaaggggtcgtaaggttcggggtccgtaggggaacctaggtacgtttccaacttccgtaccaacctattccgaacgggtcccgggccttaggaccgtacgttaccgttaggtaaacggtttagtttttacgggttaaaccttttttagtttaccgttacgttacgaacgtaccgtaaagtttaaacttaaacgttaccgtaaacggttcgggttaacccggtttaaccgtttaccgggtttttaccgggggaacccgggggtaaacctaacgggtaccggttaagggaacgtaaaaccgtaaacgtaaaaaccggttaacggttgggtacggtaccgttacggaccctaaccgttaaacttccgttcgtttaccgtttaccgaaccttttccccgttaccccgttacctttaacg

SEQ ID NO: 379725 - DNA, 564 bp, Homo sapiens
  misc_feature: GZ8MTXP02FJS6N.45.58.F03.1.454.CMB.2.raw
  modified_base (202)..(202): a, c, t, g, unknown or other
  modified_base (214)..(214): a, c, t, g, unknown or other
  modified_base (240)..(240): a, c, t, g, unknown or other
  modified_base (262)..(262): a, c, t, g, unknown or other
  modified_base (304)..(304): a, c, t, g, unknown or other
  modified_base (329)..(329): a, c, t, g, unknown or other
  modified_base (515)..(515): a, c, t, g, unknown or other
  modified_base (560)..(560): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgagggganacggccaccctntcctgcagggccagtcagtatgttancacaacttagcctggtaccaanagagacctgcccaggcctacccaaactcctcatcctctggtntatcctaccgagggccacgtggtcncccagacaggttcaaggggcaggtcgggtctggggactaggtacgttcaacttctccactatccgagccggcctgcagtctagaagtattttggtactttattactgtcagctagtataatcactggtaccgtataccgtttgggaccggggtacaagcgtaggagacgtaacgaaacgaactggnggtctcgaccaacgtctcgtcgttccttactcttccttacccccnctac

SEQ ID NO: 379726 - DNA, 614 bp, Homo sapiens
  misc_feature: GZ8MTXP02G1P63.45.58.F03.1.454.CMB.2.raw
  modified_base (202)..(202): a, c, t, g, unknown or other
  modified_base (264)..(264): a, c, t, g, unknown or other
  modified_base (304)..(304): a, c, t, g, unknown or other
  modified_base (326)..(326): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgagggganacggccaccctctcctgcagggccagtcagtatgttagcaccaacttagcctaggtaccaanagagacctgcccaggctcccaaactcctacatctctggtntatctaccgaggccacgtggtntcccagactaggttacaagggcaggtcgggtctggggacagtagttcactctccacatcagcgcctgcagtctagaagtatttggtactttattactgtcagctagtataatcaacgtcggaccgttacgtacgttttcggggaccgggggtacctaaaggccttaggggagtaacgttaaccgaaaacggtaaaccgttaggttacggaccgttacggacctaacctaacgttccttacggttccctttacctaaccggtttcccttaccccggtacctttaaccgg

SEQ ID NO: 379727 - DNA, 536 bp, Homo sapiens
  misc_feature: GZ8MTXP02F8QPP.45.58.F03.1.454.CMB.2.raw
  modified_base (153)..(153): a, c, t, g, unknown or other
  modified_base (238)..(238): a, c, t, g, unknown or other
  modified_base (243)..(243): a, c, t, g, unknown or other
  modified_base (256)..(258): a, c, t, g, unknown or other
  modified_base (260)..(261): a, c, t, g, unknown or other
  modified_base (263)..(263): a, c, t, g, unknown or other
  modified_base (266)..(266): a, c, t, g, unknown or other
  modified_base (270)..(270): a, c, t, g, unknown or other
  modified_base (272)..(273): a, c, t, g, unknown or other
  modified_base (276)..(277): a, c, t, g, unknown or other
  modified_base (280)..(281): a, c, t, g, unknown or other
  modified_base (286)..(286): a, c, t, g, unknown or other
  modified_base (295)..(295): a, c, t, g, unknown or other
  modified_base (354)..(354): a, c, t, g, unknown or other
  modified_base (382)..(382): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggcctcccagataccactggaanaaatagtgatgacgcagtctccagtccaccctgtctgtgtctccgaggggacaccggcccaccctctcctgcaggccagtcagtntgtancacatgctgacannncnncngcnccancnntcnngtnntcacnggcatgtcnccagacgtagtcaggcaggtcggctaggacagtcttccatctacacatcacgcgctgcngtctagagttatttgactttattacgtntgagatagttaataatctacgtcgtaccgtaacttcggtttacggggaccggggtaacacggtcgtaggaacgtacgtaacgaaaacggtacgttggtacgcgtacgacaccgtattccttcgtaccttacctcgttcccgttcccaccttacg

SEQ ID NO: 379728 - DNA, 657 bp, Homo sapiens
  misc_feature: GZ8MTXP02GZOUC.45.58.F03.1.454.CMB.2.raw
  modified_base (245)..(245): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgaggggacgaccggccacccctctcctgcgacgggccagtcagtatgtacncacctaatcgcctagaccaacagacgacctcgacccagcctacccaactcctacactctcgtggtctactcctacgacggtcccagttcggtcgacccaggacgtacgggttacgaaggggtctagggtcgggtcgagggacaggtacgttccacttcgaccactactcgacggccgcctgctgttacgtagtaagttagtttacgttacttttagttaacttgtacgtagtacgtaaagttaactaataccgttacgtacggttaccggttaaccgttaccgggtttaccggggaccggggtaaccgtaacggtaccggttaggaacgtaacgtaaccgtaaaacggtaacgtcggtacgcgttacgaccgtactactcgttctaccttactccttcccgtacctactacg

SEQ ID NO: 379729 - DNA, 597 bp, Homo sapiens
  misc_feature: GZ8MTXP02GQ0V8.45.58.F03.1.454.CMB.2.raw
  modified_base (202)..(202): a, c, t, g, unknown or other
  modified_base (238)..(238): a, c, t, g, unknown or other
  modified_base (252)..(252): a, c, t, g, unknown or other
  modified_base (254)..(254): a, c, t, g, unknown or other
  modified_base (257)..(257): a, c, t, g, unknown or other
  modified_base (274)..(274): a, c, t, g, unknown or other
  modified_base (284)..(284): a, c, t, g, unknown or other
  modified_base (400)..(400): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgagggganacggccacctctcctgcaggccagtcagtatgttancacatgctgacaangnacngccagccaccaactccnatctctggtntatcctacgacggcctaagtcggtacgtaccccaagtacgtaggttaccgaaaggggtctagggtcggtcgtgggaactaggtacttccacttcgcaacctatcgaggccggtccngactagtctaagtaattgtttagtaactttagttactgtcagtactaagtataattcacgttcgtaccgtacgttaaccgtttcggggaccgggaaccgtaaggtccgtagggtaacgaacgtaaccgtaaaacggtacgttggacggtactacgactaaccgtatccgtacgtcttactctaccttcccgactacg

SEQ ID NO: 379730 - DNA, 684 bp, Homo sapiens
  misc_feature: GZ8MTXP02HWZ83.45.58.F03.1.454.CMB.2.raw
  modified_base (277)..(277): a, c, t, g, unknown or other
  modified_base (444)..(444): a, c, t, g, unknown or other
  modified_base (466)..(466): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctcagtcaccctgtctgtgtctcgaggggacgacggccacctctcctgcgagggccagtcagtatgttacgcaacctaattacgcctaggtaaccaacgagacgaccncgcccgagacctacccaactcctactactctcgttggtactacttccgacgacggcctacggttggtaccgtacccgaaggtaccgtaggttacgaaggggtcgtagggtcggggtacgtacgggactagggtacttcgactcctaccacgtatccgacgccgtacncgcgtagttacgtagtaagttntttacggttacttttattacgtcgttacagtacgtaagttacttaaagtcgtacgttaccggtaccggttacgtttacggggttaccgggggaccggtaacggtacgtacgggtacggtataaacggttaaccgaaaacgtaggtcggttacgggactacggaccctaactcgtttcgtttaccgtcctttaccgtctttccccggtacctacttacg

SEQ ID NO: 379731 - DNA, 710 bp, Homo sapiens
  misc_feature: GZ8MTXP02JMSW0.45.58.F03.1.454.CMB.2.raw
  modified_base (270)..(270): a, c, t, g, unknown or other
  modified_base (316)..(316): a, c, t, g, unknown or other
  modified_base (326)..(326): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggcctccagataccactggaagaaatagtgatgacgcagtctccagtccaccctgtctgtgtctccgaggggacgaccggcccaccctctcctgccagggccagtcagtatgttagcaactaattcgccgtagtaccaanagacgacctcgacccaggcctacccaaactcctacatctcgtggtntatcctacgnggtcccagtggtctacccagacgtcggtacgaagggctaggtcgggtcgaggacaggtacgtcactcgtacacgagtcagccgctagactagtctaggtaaatttgtttacggtaacttttactacgttcgtacgaacgtacgttaaattaataaccgtacgttacgtccgggtaaccgtttaccgttaaccggggtttccgggggaaacccgggggttaacaaacgggttccggtaaaggggtaacgtaaaccggttaaaccgtaaaaacggtaccggttgggtaaaccgttccgggtaacgaaccctaaccggttaacttccgtttacggtttaccccttacggttaccccgttaccccttttcccccggattttaacccgg

SEQ ID NO: 379732 - DNA, 685 bp, Homo sapiens
  misc_feature: GZ8MTXP02IGALO.45.58.F03.1.454.CMB.2.raw
  modified_base (306)..(306): a, c, t, g, unknown or other
  modified_base (316)..(316): a, c, t, g, unknown or other
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggaagaaatagtgatgacgcagtctccagtcaccctgtctgtgtcctccgaggggacgaccggcccaccctctcctgccagggccagtcagtatgttagcaccattgcctaggaccaagagagacctgcccagcctcccaaactcctacatctctggtntactctacgnggccagtggtctcccagacgaggttcaaggcaggtcggtactgggactaggtcttcgaacgttcctacacctagtccaggtccggcctgcgtagttccgtagtagttacgttttgtacttttacttagttcgtacgtagtcgttaaagtaacttaaacgttaccgtacgttccggtacccggttaaccgtttaaccgggttttccgggggaacccgggggtaccgtaaaacggtcggttaacgggtaagtaacggttaaaccgtaaaacggaacggttcgggttaacggtccgttacggtacccaacgttactccggtttactttaaccgtttcctaaccgtttccccgttccccgtaccccgtttaag

SEQ ID NO: 379733 - DNA, 753 bp, Homo sapiens
  misc_feature: GZ8MTXP02FMPCP.45.58.F03.1.454.CMB.2.raw
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgaggggagaccggccacccctctcctgcagggccagtcagtatgttagcaaccaattagcctaggtaaccaacgagagacctgcccaggcctaccccaaaactcctactactctctggttactactcctaccgaggggcctagtcggtcgtaccccgagtaaccggtagggttaccgaaaggggtccgtagggttccgggggtacgtaggggaacctaggtaacggtttccaacttccgtaccgaaacccctaattacgaacggccggggtaccttcggggtacctaacgttaccgttaaggtaaaggtttaactttttaaggggtaacttttacgtttaaacttcggttactaacggtcttaaacggtaattaaacgtacctaacggttaccggtacccggtttaaacgtacgggtttttaccgggggaccgggggtaacctaaggtcgttaaggagtaacgtaaacgtaaaacggtaaccgttaggtaccgggtctacggtaccctaacgtacttcccgttattacccgttactacttccccgttccgtaccttacg

SEQ ID NO: 379734 - DNA, 709 bp, Homo sapiens
  misc_feature: GZ8MTXP02FNCJF.45.58.F03.1.454.CMB.2.raw
  modified_base (203)..(203): a, c, t, g, unknown or other
  modified_base (241)..(241): a, c, t, g, unknown or other
  modified_base (305)..(305): a, c, t, g, unknown or other
tcagacgcgatcgacacgaccggtgctcgatttagtctgatcgagaaggggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgagggganacggccaccctctcctgcagggccagtcagtatgttancacaattagcctggtaaccaacagagacctgcccaggcctcccaaaactcctcactctgtggtntactctaaccgaggggcccaacgttgggtcgtaccccaggtaaccgtaagggttacgaaaggggctagggttcggggtcgtacggggactaaggacggtttccaacttcctccgaaacctaagttcccaagggccggtacctgcgtacgtactagaaagttaagttttaggtaactttatttacttacggttacaagtactaagttaaattaaactactaacgttacgggtacccgttaacgtaacccggtttttacgggggaacccgggggtaaccgtaaacggtccggtaagggtaacggaaacgttaaccggaaaacggtaaacgtacggttacggacgttacggacctaaccgtactaacgttacgttacgttactaacgtttcctttacccgaccttac

SEQ ID NO: 379735 - DNA, 650 bp, Homo sapiens
  misc_feature: GZ8MTXP02HCOSL.45.58.F03.1.454.CMB.2.raw
  modified_base (324)..(324): a, c, t, g, unknown or other
tcagacgcgatcgacacgaccggtgctcgatttagtctgatcgagaaggggaaagggggaggaactgctcagttaggacccagacggaaccatggaggccccagcgcggcttctcttcctcctgctactctggctccagataccatggagaatagtgatgacgcagtctccagtcacctgtctgtgtctccgaggggacaccgccacctctcctagcaggccagtcagtatgtacgactacctaattcgcccgtaggtaaccaaacgagacgacctcgacccgtacggaccttaccccaaactcctactactacctcgtggttntactccgtacgacgggcctcgtcggttcgaccctagtacgcggttagaaggtctaggtaccgggtctaggacgagtactccgaactccgtaccactacgtacgacgtccggtccacggtctaacgttcgaaggttaagttgtttacgttacgtttaacttacgttaccggaattacgtaactagttaactttaaaccgcgtacgtacgttaccgtacgttacgggtaccggaacgggtactagacgtacgtacgtaacgtaacgacgtacgtcggtacgacgacgtacctacgtactcgtacgtctacgtcctacctaccgactcg

SEQ ID NO: 379736 - DNA, 578 bp, Homo sapiens
  misc_feature: GZ8MTXP01A53SA.19.72.G06.1.454.CMB.2.raw
  modified_base (303)..(303): a, c, t, g, unknown or other
  modified_base (330)..(330): a, c, t, g, unknown or other
  modified_base (340)..(340): a, c, t, g, unknown or other
  modified_base (362)..(362): a, c, t, g, unknown or other
tcagtactctcgtgcacgaccggtgctcgatttagctacgactgcaagggaaagggggggtcgcaagaggcagcgctctcgggacgtctccaccatggcctgggctctgctgctcctcactctcctcactcaggacacagggtcctgggcccagtctgccctgactcagcctgcctcgtgtctgagtctcttggacagtcgatcaccatctcctcactgggaccgtgtgatgttggacttatacccttgtctcctggtaccaacaactaccccggacaaacgcccccaaactcctgactttangagctcatagcggcctgaggggtttcngagcgcttcnctggctcgagggctgaacaacncggcctacgtgacgatctcgtgggctcgaggctggaggacgaggctgacttattatgctgcggcagtacgcgaaggaagtagcgaacgtaggtggggtgtcgggcgggcggggaacggggttaccggaaaggggttcggacccggttccggttcggggttccacgggccccgaacgggccgtcccggcccccgttcggtccttaaccgtttccccg

SEQ ID NO: 379737 - DNA, 571 bp, Homo sapiens
  misc_feature: GZ8MTXP01CFSJ7.19.72.G06.1.454.CMB.2.raw
  modified_base (306)..(306): a, c, t, g, unknown or other
  modified_base (341)..(341): a, c, t, g, unknown or other
  modified_base (379)..(379): a, c, t, g, unknown or other
  modified_base (469)..(469): a, c, t, g, unknown or other
tcagtactctcgtgcacgaccggtgctcgatttagctacgactgcaagggaaagggggggtcgcaagaggcagcgctctcgggacgtctccaccatggcctgggctctgctgctcctcactctcctcactcaggacacagggtcctgggcccagtctgccctgactcagcctgcctccgtgtctgagtctcttggacagtcgatcaccatctcctccactgggaccgtcgtgatgttggacttatacccttgtctcctggtaccaacaactaccccggacaaacgcccccaaactcctgtatttangaggctcataacgcggtccctcgtagggggtttcnggagcgtcttctctcggctcgagggcctgaaacaaccncggcctaccgtgacgatctcgtcgggcctcgaggctggaggacgaggctgacttattattgctgcgcagtacgacgaaggaagtgcacgngtggggtgtcggcgggaacgggagggacgtagggcgtacccggtcgttacgggcaccggcccgacggcctccggcccccgttaggtcccttaaccgttcccg

SEQ ID NO: 379738 - DNA, 499 bp, Homo sapiens
  misc_feature: GZ8MTXP01AF31D.19.72.G06.1.454.CMB.2.raw
  modified_base (492)..(492): a, c, t, g, unknown or other
tcagtactctcgtgcacgaccggtgctcgatttagctacgactgcaagggaaagggggggtcacaagaggcagcgctctcgggacgtctccaccatggcctgggctctgctgctcctcactctcctcactcaggacacagggtcctgggcccagtctgccctgactcattctgcctccgtgtctggtctcctggacagtcgtcaccatctcctgcactggaaccagcagtgatgttagaaattctaacttgtctctggtacaacatcacccaaataaagcccccaaatcatcatttatgatgccactaagcgccctcgaggggtttctaatcgcttcctctggctccaagtctggcaacacggcctccctgacaatctctgggctcaggctgaggacgaggctgattactactgctgctcatatgcaggtctatctcttatgtctcggaactgggacaaggtcacgttcttagtcagcccaagcccacctcncgtaacc

SEQ ID NO: 379739 - DNA, 569 bp, Homo sapiens
  misc_feature: GZ8MTXP01AYTGF.19.72.G06.1.454.CMB.2.raw
  modified_base (301)..(301): a, c, t, g, unknown or other
  modified_base (331)..(331): a, c, t, g, unknown or other
  modified_base (342)..(342): a, c, t, g, unknown or other
  modified_base (370)..(370): a, c, t, g, unknown or other
  modified_base (560)..(560): a, c, t, g, unknown or other
tcagtactctcgtgcacgaccggtgctcgatttagctacgactgcaagggaaaggggggggtcgcaagaggcagcgctctcgggacgtctccaccatggcctgggctctgctgctcctcactctcctcactcaggacacagggtcctgggcccagtctgccctgactcagcctgcctccgtgtctgagtctcttggacagtcgatcaccatctcctcactgggaccgtgtgatgttggacttatacccttgtctctggtaccaacactaccccggcaaacgcccccaaactcctgatttangagctcataacgcgccctgagggggtttcngagcgtcttcncgtcggcctcgagggctagaaaccaacnccggcctacctgacatctcgtcgggcctcgaggcgtggacggacgaggctgaacttattagtgcgtgcggctactacggacgaaggtaagtacgcgtaacgagtgggtggtcggcggggaacgggagggaccgaagggttcgaccggtcgttgggttcacggcccgaggccgtccgccccgttcggtccnccgttcccg

SEQ ID NO: 379740 - DNA, 569 bp, Homo sapiens
  misc_feature: GZ8MTXP01CV895.19.72.G06.1.454.CMB.2.raw
  modified_base (273)..(273): a, c, t, g, unknown or other
  modified_base (298)..(298): a, c, t, g, unknown or other
  modified_base (330)..(330): a, c, t, g, unknown or other
  modified_base (343)..(343): a, c, t, g, unknown or other
  modified_base (383)..(383): a, c, t, g, unknown or other
  modified_base (389)..(389): a, c, t, g, unknown or other
tcagtactctcgtgcacgaccggtgctcgatttagctacgactgcaagggaaagggggggtcgcaagaggcagcgctctcgggacgtctccaccatggcctgggctctgctgctcctcactctcctcactcaggacacagggtcctgggcccagtctgccctgactcagcctgcctccgtgtctgagtctcttggacagtcgatcaccatctcctcactgggaccgtgtgatgtggacttatacccttgtctctggtaccaacataccccggnaaacgcccccaaatcctagatttangagctcataacgcggccctcgtaggggtttcnggacgcgtcttcnctcggcctcgagggctgaaacaacgcggccctactgacgntcgtcngggctcgaggctggaggacgaggctagactattatgctgcggcagtacgacgaaggaatagcaacgagtggggtagtggcgggaacggaaggggaccgtaagggttcgtaacccggtcgttaggggttccacggaacccgaacgggcctccggcccccgttcgggtcccttaacgttccg

SEQ ID NO: 379741 - DNA, 620 bp, Homo sapiens
  misc_feature: GZ8MTXP01BI3FR.19.72.G06.1.454.CMB.2.raw
  modified_base (300)..(300): a, c, t, g, unknown or other
  modified_base (335)..(335): a, c, t, g, unknown or other
  modified_base (375)..(375): a, c, t, g, unknown or other
tcagtactctcgtgcacgaccggtgctcgatttagctacgactgcaagggaaagggggggtcgcaagaggcagcgctctcgggacgtctccaccatggcctgggctctgctgctcctcactctcctcactcaggacacagggtcctgggcccagtctgccctgactcagcctgcctcgtgtctgagtctcttggacagtcgatcaccatctcctcacgtgggaccgtgtgatggttggacttactaccttgtctcctgtaccaacaactaccccgcaaacgccccaaatcctagatttangagctacataacgcggtccctcgtagggggtttcnggagtcgtcttctctcggctcgagggctacgaaaccaacnccggccctacctagactatctcgtggctcgaggctggacggacgaggctagtattacactgctgctctagtactgactacggttctattcttcttacgtcgttaccgttaccgggaaacgttacgggaacccgtaaacggttcccgtaaacccggtccgttaacgggttacccaacccggtaaccccgtaaaaccgggccccctaaaaccccggtcttaccggtaacccgttaacccgttccccg

SEQ ID NO: 379742 - DNA, 534 bp, Homo sapiens
  misc_feature: GZ8MTXP01ESW8W.19.72.G06.1.454.CMB.2.raw
  modified_base (302)..(302): a, c, t, g, unknown or other
  modified_base (333)..(333): a, c, t, g, unknown or other
  modified_base (366)..(366): a, c, t, g, unknown or other
  modified_base (464)..(464): a, c, t, g, unknown or other
  modified_base (492)..(492): a, c, t, g, unknown or other
  modified_base (527)..(527): a, c, t, g, unknown or other
tcagtactctcgtgcacgaccggtgctcgatttagctacgactgcaagggaaaggggggggtcgcaagaggcagcgctctcgggacgtctccaccatggcctgggctctgctgctcctcactctcctcactcaggacacagggtcctgggcccagtctgccctgactcagcctgcctcgtgtctgagtctcttggacagtcgatcaccatctcctccatgggaccgtcgtgatgttggacttatacccttgtctctggtaccaacaactaccccggcaaacgcccccaaactcctgatttangaggctcataagcggccctcgaggggtttcngagcgtcttctctcggctcgaggctgaaacacncggcctactgacgatctcgtgggctcgaggctgaggacgaggctagacttattatgctgcgcagtacgacaaggagtagcacagtgggtgtggcgggnggaacgggacgaagggttcgaccgtcgngggttccacgcccgaggcctcgccccgttggtccncgttccg

SEQ ID NO: 379743 - DNA, 568 bp, Homo sapiens
  misc_feature: GZ8MTXP01AXHLJ.19.72.G06.1.454.CMB.2.raw
  modified_base (277)..(277): a, c, t, g, unknown or other
  modified_base (301)..(301): a, c, t, g, unknown or other
  modified_base (330)..(330): a, c, t, g, unknown or other
  modified_base (453)..(453): a, c, t, g, unknown or other
  modified_base (460)..(460): a, c, t, g, unknown or other
  modified_base (484)..(484): a, c, t, g, unknown or other
  modified_base (492)..(492): a, c, t, g, unknown or other
  modified_base (542)..(542): a, c, t, g, unknown or other
  modified_base (560)..(560): a, c, t, g, unknown or other
tcagtactctcgtgcacgaccggtgctcgatttagctacgactgcaagggaaagggggggtcgcaagaggcagcgctctcgggacgtctccaccatggcctgggctctgctgctcctcactctcctcactcaggacacagggtcctgggcccagtctgccctgactcagcctgcctccgtgtctgagtctcttggacagtcgatcaccatctcctcactgggaccgtgtgatgttggacttatacccttgtctctggtaccaacaactaccccgganaaacgcccccaaatcctgatttangagctcatacgcgccctgtaggggtttcngagcgcttctcgtcggcctcgaggggcctaggaaaccaaccgccggccctaaccgtaggaccgtattcgtcgtcgggcctaccgaggctggacggacgaggctagacttattatgctgcggtnagtacgngaaggaagtgcacgagtggggtgngggcgggnggaagggaccaagggttcgaccgggtcgttgggttcacggcccaggtccnccggccccgttcggtccncgtttccg

SEQ ID NO: 379744 - DNA, 549 bp, Homo sapiens
  misc_feature: GZ8MTXP01E0FHW.19.72.G06.1.454.CMB.2.raw
  modified_base (304)..(304): a, c, t, g, unknown or other
  modified_base (310)..(310): a, c, t, g, unknown or other
  modified_base (334)..(334): a, c, t, g, unknown or other
tcagtactctcgtgcacgaccggtgctcgatttagctacgactgcaaggggaaaggggggggtcgcaagaggcagcgctctcgggacgtctccaccatggcctgggctctgctgctcctcactctcctcactcaggacacagggtcctgggcccagtctgccctgactcagcctgcctccgtgtctgagtctcttggacagtcgatcaccatctcctcactgggaccgtgtgatgttggacttatacccttgtctctggtaccaacaactaccccggacaaacgcccccaaactcctgatttangagctnatacgcgccctcgagggggtttcngagcgtcttctcgtcggcctcgagggctagaaaccaacgcggccctacgtcgacgatctcgtgggctccgaggcgtggaggacgagctgactattatgctgcggcagtacgacgaaggaagtagcacgagtgggtgcggcgggaacgggagggaccgaggttcgaccggtcgcgggttcacgaacccgaggcctccgccccgttcgtccgctccg

SEQ ID NO: 379745 - DNA, 570 bp, Homo sapiens
  misc_feature: GZ8MTXP01C7IZ2.19.72.G06.1.454.CMB.2.raw
  modified_base (359)..(359): a, c, t, g, unknown or other
tcagtactctcgtgcacgaccggtgctcgatttagctacgactgcaagggaaaggggggggtcgcaagaggcagcgctctcgggacgtctccaccatggcctgggctctgctgctcctcactctcctcactcaggacacagggtcctgggcccagtctgccctgactcagcctgcctccgtgtctgagtctcttggacagtcgatcaccatctcctccactgggaccgtgtgatgttgggacttatacccttgtctcctgtaccaacatacccgcaaacgccccaaactcatcatttatgatgccactaacgcggccctcgtagggttctaatcgcttctctcggctcagtctgacacncgcctccctgacatctctgggctcgaggctgaggacgaggctgtattactactgctcgctcatatcgactacggtcgttattcctctttagtgttccgttcgggtaaaccgttcgggggaaaccctaacgggttcctaacccggttccttaacgggttccaaccggccccaaaacggccccaaaacccctcgttcgttccaacctttcccg

SEQ ID NO: 379746 - DNA, 673 bp, Homo sapiens
  misc_feature: GZ8MTXP01DT72B.19.72.G06.1.454.CMB.2.raw
  modified_base (312)..(312): a, c, t, g, unknown or other
tcagtactctcgtgcacgaccggtgctcgatttagctacgactgcaagggaaaggggggggtcgcaagaggcagcgctctcgggacgtctccaccatggcctgggctctgctgctcctcactctcctcactcaggacacagggtcctgggcccagtctgccctgactcagcctgcctcgtgtctgacgtctcgttggacagtcgatcacctatctcctcgacgtcgggaccgtgtgagttgttaggactttatcccttgtcctcgtacgtaccaacaactacccgacaaacgaccccaaatctagtattagngacgtctcgaacgtaacgccggtaccttacggttaggggttttcacggtacgtccgtcttcgtcgtacccggctacggaggtcctacggaaaacccaacggtcccggtaccctaaccgtcggaccgtacgtccgtcgtcgggcctaccgagtcgagacggacgagtctacgtattattacgtgcgtacggcgtactaaggtaccgagaaaggtaacgtacgacgtaagtggtggggtagccgggacgggaacgggaacggaccgtaaggggttccgtaacccgggttcgttacgggcccaacgggccccgtacgggtcccctcccggtcccccggttaggttccccttaaccgtttccccg

SEQ ID NO: 379747 - DNA, 652 bp, Homo sapiens
  misc_feature: GZ8MTXP01BJZLA.19.72.G06.1.454.CMB.2.raw
  modified_base (302)..(302): a, c, t, g, unknown or other
tcagtactctcgtgcacgaccggtgctcgatttagctacgactgcaagggaaaggggggggtcgcaagaggcagcgctctcgggacgtctccaccatggcctgggctctgctgctcctcactctcctcactcaggacacagggtcctgggcccagtctgccctgactcagcctgcctcgtgtctgagtctcttggacagtcgatcaccatctcctcacgtgggaccgtgtgatgttggacttataccttgtctctgtaccaacaactaccccggacaaacgccccaaactcctagtatttangagctacataacggccggtccctgtaggggtttctgagtccgtcttctcgtcggcctcgagggctacgaaaccaacgcggcctaccgtgacgtattcgtcgtcgggcctaccgaggcgtagggacggacggaggtctagtaacttagttagtcgacgtacggacggtactaacgtacggacgtaacgggaaagtacggactaacggtaggttgggggtgtcgggccggggaacgggaaacgggaccggtaaagggttccggtaacccggttcggttacggggttccaccggaacccggtaaggtcccgtacccggtcccccgttcgggttcccttaacccgtttccccgg

SEQ ID NO: 379748 - DNA, 582 bp, Homo sapiens
  misc_feature: GZ8MTXP01DE9F1.19.72.G06.1.454.CMB.2.raw
  modified_base (211)..(211): a, c, t, g, unknown or other
  modified_base (247)..(247): a, c, t, g, unknown or other
  modified_base (297)..(297): a, c, t, g, unknown or other
  modified_base (327)..(327): a, c, t, g, unknown or other
tcagtactctcgtgcacgaccggtgctcgatttagctacgactgcaaggggaaaggggggggtcgcaagaggcagcgctctcgggacgtctccaccatggcctgggctctgctgctcctcactctcctcactcaggacacagggtcctgggcccagtctgccctgactcagcctgccctccgtgtctgagtctcttggacagtcatcaccntctcctcacgtgggaccgtgtgattggttggacttntacccttgtctctgtacaacactacccgcaaacgccccaatcctgattangacgctcataacgcgtcctgtggggtttcngagcgtcttctctcggcctcgaggctacgaaacaacgcggcctacgtcgacgtatcgtcgtcggctccgaggctaggaggacgagtctagtaacttattactcgctcggcgtactagtaaccgacgaaggaacgtcgactaacgagttcgggtggtcggcgggaacgggaggacgtaagggttcgacccggttcggacggttcgaccggaacccgtacggccgtcccggccccgttcggtccttaaccgttcccg

SEQ ID NO: 379749 - DNA, 653 bp, Homo sapiens
  misc_feature: GZ8MTXP01D3D2A.19.72.G06.1.454.CMB.2.raw
  modified_base (211)..(211): a, c, t, g, unknown or other
  modified_base (346)..(346): a, c, t, g, unknown or other
  modified_base (451)..(451): a, c, t, g, unknown or other
  modified_base (470)..(470): a, c, t, g, unknown or other
tcagtactctcgtgcacgaccggtgctcgatttagctacgactgcaagggaaagggggggtcgcaagaggcagcgctctcgggacgtctccaccatggcctgggctctgctgctcctcactctcctcactcaggacacagggtcctgggcccagtctgccctgactcagcctgcctcgtgtctgagtctcttggacagtcgatcaccatcncctccagtgggaccgtgtgattgtggacttactaccctgtctcctggtaaccaacaactccccggcaaacgccccctaaatcctagatttagcgaggtctacgactaacgccggtccctagtacgggggttttcncgacgtccgtcttcgtccgtacggcctaccgagggtctacggaaaccaacctcgggccctaaccgtcgacgatccgtcgtgggccttcgaggtctagaggaacgnggcctgaactgttacttgntacgcgggactagtaccgacgaggtaaacgcgtacgaacgtgtggggttcgtcgggcgggaacgggtaacggggaaccgtaaacgggttcggtaaacccggttcggttacggggttacccgaccggaacccgaaacgggtccgtcccggtcccccgttaccgggttccaaccccgtttcccgg

SEQ ID NO: 379750 - DNA, 621 bp, Homo sapiens
  misc_feature: GZ8MTXP01AQVY3.19.72.G06.1.454.CMB.2.raw
  modified_base (301)..(301): a, c, t, g, unknown or other
  modified_base (330)..(330): a, c, t, g, unknown or other
  modified_base (342)..(342): a, c, t, g, unknown or other
  modified_base (384)..(384): a, c, t, g, unknown or other
tcagtactctcgtgcacgaccggtgctcgatttagctacgactgcaagggaaagggggggtcgcaagaggcagcgctctcgggacgtctccaccatggcctgggctctgctgctcctcactctcctcactcaggacacagggtcctgggcccagtctgccctgactcagcctgcctcgtgtctgagtctcttggacagtcgatcaccatcctcctcacgtgggaccgtgtgattggttggacttactaccttgtctctggtaccaacactaccccgacaaacgccccaaatcctgtattangagctacatacgcgtcctgtagggtttcngagtcgtcttcncgtcggctcgaggtctagaaccaacgcggcctacgtagacgntcgtcgtcgggcctcgaggcgtaggacgggacgaggtctagtacgttattacttcgaccgtgaccggtacaacgtaacgacgaaaggaacgttacgacgtaacgtaggttcggggtagtcgggccggggaacgggaacgggaaccgtaaacgggttcgtaaccccggtcggttcggggttccaaccgggtcccgaacggtccgtacccgccccgttacgggtccttaaccgttcccg

SEQ ID NO: 379751 - DNA, 589 bp, Homo sapiens
  misc_feature: GZ8MTXP01BBHKG.19.72.G06.1.454.CMB.2.raw
  modified_base (314)..(314): a, c, t, g, unknown or other
  modified_base (355)..(355): a, c, t, g, unknown or other
  modified_base (367)..(367): a, c, t, g, unknown or other
  modified_base (401)..(401): a, c, t, g, unknown or other
  modified_base (411)..(411): a, c, t, g, unknown or other
  modified_base (421)..(421): a, c, t, g, unknown or other
  modified_base (429)..(429): a, c, t, g, unknown or other
  modified_base (444)..(444): a, c, t, g, unknown or other
tcagtactctcgtgcacgaccggtgctcgatttagctacgactgcaaggggaaaggggggggtcgcaagaggcagcgctctcgggacgtctccaccatggcctgggctctgctgctcctcactctcctcactcaggacacagggtcctgggcccagtctgccctgactcagcctgcctcgtgtctgagtctcttggacagtcgatcaccatcctcctccacgtgggaccgtgtgagtggttggactttatacccttgtctccgtaggtaccaacaacgtaccccggacaaaccgcccccaaactccttattagngacggctacaagtaacgccggtaccttcggtaggggtttcnggacgctcttcncgtcggcctcgaggctagaccaaacgcgcctacngacatctcgnggctcgagcnggagacgngtctagtacttattntgctgcgatacgtacgacgaaggaagtgacgagtaggtgggtcggtggcggggacgggaacgggaccgaaggggtccgaccggtacgggtcggacgcggacccgaaggcccgtccgccccggtgttacccgtcttcccgttcccg

SEQ ID NO: 379752 - DNA, 509 bp, Homo sapiens
  misc_feature: GZ8MTXP02H9SNY.19.72.G06.1.454.CMB.2.raw
  modified_base (427)..(427): a, c, t, g, unknown or other
tcagtactctcgtgcacgaccggtgctcgatttagctacgactgcaagggaaaggggggtcacaagaggcagcgctctcgggacgtctccaccatggcctgggctctgctgctcctcactctcctcactcaggacacagggtcctgggcccagtctgccctgactcattctgcctccgtgtctgggtctcctggacagtcggtcaccatctcctgcactggaaccagcagtgatgttgaaattctaaccttgtctcctggtaccaacatcacccaaataaacgccccaaactcatcatttatgatgccactaagccggccctcaggggtttctaatcgcttcctctggctcaagtctgcaacacggcctccctgacaatctctgggcctcaggctgagacgagctgattacgtactgctgctcatangcaggtctatcttctattgtcttcggactcgggaccaggtccaccgtctaggtcacgccaacggccaacccgtactcgtacc

SEQ ID NO: 379753 - DNA, 531 bp, Homo sapiens
  misc_feature: GZ8MTXP02IXPL2.19.72.G06.1.454.CMB.2.raw
  modified_base (277)..(277): a, c, t, g, unknown or other
  modified_base (303)..(303): a, c, t, g, unknown or other
  modified_base (331)..(331): a, c, t, g, unknown or other
  modified_base (364)..(364): a, c, t, g, unknown or other
tcagtactctcgtgcacgaccggtgctcgatttagctacgactgcaagggaaaggggggtcgcaagaggcagcgctctcgggacgtctccaccatggcctgggctctgctgctcctcactctcctcactcaggacacagggtcctgggcccagtctgccctgactcagcctgcctccgtgtctgagtctcttggacagtcgatcaccatctcctccactgggaccgtcgtgatgttggacttatacccttgtctcctggtaccaacaataccccggnaaacgcccccaaaactcctgatttangagctcataagcggcctcaggggtttcngagcgtcttctctcggctccagggctgacaacncggcctactgacgatctctgggctccgaggctgaggcgaggctgactattatgctgcgcatacgcaaggaagtacgacacgagtgggtgtggcggcggagggaccaagggtcgaccgttcgacgggtcaacggcccgaaggcctcgccccctggtaccaccgttccg

SEQ ID NO: 379754 - DNA, 598 bp, Homo sapiens
  misc_feature: GZ8MTXP02JR9JU.19.72.G06.1.454.CMB.2.raw
tcagtactctcgtgcacgaccggtgctcgatttagctacgactgcaagggaaaggggggtcgcaagaggcagcgctctcgggacgtctccaccatggcctgggctctgctgctcctcactctcctcactcaggacacagggtcctgggcccagtctgccctgactcagcctgcctccgtgtctgagtctcttggacagtcgatcaccatctcctcactgggaccgtgtgatgttggacttatacccttgtctctggtaccaacactaccccggcaaacgcccccaaatcctgatttatgagctacataagccggccctcgtaggggtttctggagtcgtcttctctggcctccgagggctgaacaacgccggcctacgtgacgtatcgtcgtgggcctccgaggctaggacggaccgaggctacggtaacttagttattcgctgccgtacaacgttaccggcgaaagggaaagtacgacaacgtaggtggggtgtcggaccggggacgggacggggacgaaacggggtcggacccggttccgaggggtccacggcccgaacggtccgtcccggtcccccgtcggtacctacgttcccg

SEQ ID NO: 379755 - DNA, 529 bp, Homo sapiens
  misc_feature: GZ8MTXP02HJYEO.19.72.G06.1.454.CMB.2.raw
  modified_base (401)..(401): a, c, t, g, unknown or other
  modified_base (428)..(428): a, c, t, g, unknown or other
tcagtactctcgtgcacgaccggtgctcgatttagctacgactgcaagggaaagggggggtcgcaagaggcagcgctctcgggacgtctccaccatggcctgggctctgctgctcctcactctcctcactcaggacacagggtcctgggcccagtctgccctgactcagcctgcctccgtgtctgagtctcttggacagtcgatcaccatctcctccactgggaccgtgtgatgttggacttatacccttgtctcctggtaccaacaataccccggcaaacgcccccaaactccctgatttatgagctcataagcgccctgaggggtttcaatcgcttctctggccctcagtctggcaacacggcctccctgacatctctgggctccaggcctgaggacgngctgattacacttgctgcttcattagngcgagtcgtatctctttatgttcgttacggaacttcgggaaccaagggtccaaccggtcctaggtcacgcccgaagcccaacccgactcgcctactctccg

SEQ ID NO: 379756 - DNA, 537 bp, Homo sapiens
  misc_feature: GZ8MTXP02JORWU.19.72.G06.1.454.CMB.2.raw
  modified_base (301)..(301): a, c, t, g, unknown or other
  modified_base (378)..(378): a, c, t, g, unknown or other
tcagtactctcgtgcacgaccggtgctcgatttagctacgactgcaagggaaagggggtcgcaagaggcagcgctctcgggacgtctccaccatggcctgggctctgctgctcctcactctcctcactcaggacacagggtcctgggcccagtctgccctgactcagcctgcctccgtgtctgagtctcttggacagtcgatcaccatctcctccactgggaccgtcgtgatgttgggacttatacccttgtctcctggtaccaacaataccccggcaaacgcccccaaatcctgatttangagctcataagcggcctcaggggtttctgagcgcttctctcggctccagggctgacaacacggcctactgacgatcnctgggctcaggctgaggacgaggctgactatattgctgcgcatacgcaggaatgacacgattgggggtgtcggcgggacggacgggaccgaaggtcgacccggttcgcggggtacacggaacccgaaggccgtcccggcccccgtcggtcctaccgtcg

SEQ ID NO: 379757 - DNA, 556 bp, Homo sapiens
  misc_feature: GZ8MTXP02HRWWN.19.72.G06.1.454.CMB.2.raw
  modified_base (231)..(231): a, c, t, g, unknown or other
  modified_base (304)..(304): a, c, t, g, unknown or other
  modified_base (332)..(332): a, c, t, g, unknown or other
  modified_base (335)..(335): a, c, t, g, unknown or other
  modified_base (363)..(363): a, c, t, g, unknown or other
  modified_base (377)..(377): a, c, t, g, unknown or other
tcagtactctcgtgcacgaccggtgctcgatttagctacgactgcaagggaaagggggggtcgcaagaggcagcgctctcgggacgtctccaccatggcctgggctctgctgctcctcactctcctcactcaggacacagggtcctgggcccagtctgccctgactcagcctgcctccgtgtctgagtctcttggacagtcgatcaccatctcctccacgtgggaccgtgngatggttggacttatcccttgtctcctggtaccaacaactaccccgacaaacgcccccaaatcctagatttangagctcataagccgccctgagggtttcngancgtcttctctggctcgaggctgacaacncggcctactgacgntcgtcgtcggctccgaggctggaggacgagctagtactattagtgctgcgctagtacgacgaggaagtagacacgaggttggggtgtcgggcgggacgggaagggaccgaagggtcggaacccgtcggtcgggtacacgaaccccgaaggccgtccgcccccgtcggtctaccgtcccg

SEQ ID NO: 379758 - DNA, 530 bp, Homo sapiens
  misc_feature: GZ8MTXP02FPHRR.19.72.G06.1.454.CMB.2.raw
  modified_base (226)..(226): a, c, t, g, unknown or other
  modified_base (265)..(265): a, c, t, g, unknown or other
  modified_base (300)..(300): a, c, t, g, unknown or other
  modified_base (386)..(386): a, c, t, g, unknown or other
  modified_base (432)..(432): a, c, t, g, unknown or other
  modified_base (438)..(438): a, c, t, g, unknown or other
  modified_base (448)..(448): a, c, t, g, unknown or other
tcagtactctcgtgcacgaccggtgctcgatttagctacgactgcaagggaaagggggggtcacaagaggcagcgctctcgggacgtctccaccatggcctgggctctgctgctcctcactctcctcactcaggacacagggtcctgggcccagtctgccctgactcattctgcctccgtgtctgggtctcctggacagtcggtcacatctcctgcactggaaccngcagtgatgttagaaattctaacttgtctctgtaccaanatcaaccaaataaacgccccaaactcatcatttangtatgccactaagccgcctgtagggtttcaatcgtcttcctactcgactccaagtctagggcaacgcggcctcctagacatctcgnggtctccgagctgacgacgagctagattaacgtctgctgctcaatntgacgnggtctacttntattagtcgtcgttacggacgtacggactacgtacctaccgtacgtacgaaccgacgacccgacgacccaacctacgtctac

SEQ ID NO: 379759 - DNA, 617 bp, Homo sapiens
  misc_feature: GZ8MTXP02HF1O4.19.72.G06.1.454.CMB.2.raw
  modified_base (304)..(304): a, c, t, g, unknown or other
  modified_base (311)..(311): a, c, t, g, unknown or other
  modified_base (512)..(512): a, c, t, g, unknown or other
  modified_base (586)..(586): a, c, t, g, unknown or other
tcagtactctcgtgcacgaccggtgctcgatttagctacgactgcaagggaaagggggggtcgcaagaggcagcgctctcgggacgtctccaccatggcctgggctctgctgctcctcactctcctcactcaggacacagggtcctgggcccagtctgccctgactcagcctgcctccgtgtctgagtctcttggacagtcatcacatctcctcagtggaccgtgtgatgttggacttatacccttgtctcctagtaaccaacaactaccccggacaaaaccgcccccaaatcctagtatttangagctanaataacgcgtcctgtagggtttctgacgtcgtcttctcgtcggcctcgaggctagaccaacgccgcctacgtacgaccgtatcgtcgtacgggccttcccgaaggtcctaggaacgggaacgacggtcctagtaaacttagttacttcgacgttcgaccgtactagacgacgaaagggaacagacaaacgtggtggggttnagggccgggacgggaagggacccgaaaggtccggtaaccgtccggtaggggaccaacggaaccgttaacggccnccggtacccccgtcggtaccttacgtccccg

SEQ ID NO: 379760 - DNA, 541 bp, Homo sapiens
  misc_feature: GZ8MTXP02IHR9L.19.72.G06.1.454.CMB.2.raw
  modified_base (373)..(373): a, c, t, g, unknown or other
  modified_base (501)..(501): a, c, t, g, unknown or other
tcagtactctcgtgcacgaccggtgctcgatttagctacgactgcaagggaaagggggggtcgcaagaggcagcgctctcgggacgtctccaccatggcctgggctctgctgctcctcactctcctcactcaggacacagggtcctgggcccagtctgccctgactcagcctgcctccgtgtctgagtctcttggacagtcgatcaccatctcctccactgggaccgtcgtgatgttggacttatacccttgtctcctggtaccaacaataccccggcaaacgcccccaaactcctgactttatgaggctcataacgcggcccctcgaggggtttctgagcgtcttctctcggcctccaggggctgaccaacncggccctaccgtgaccgatctcgtcgggcctccgaggctaggaggcgaggctagacttatatgctgcgcatacgcaaggagtagcacagtgggtgtgcggacggaagggccaaagggtcgaccgtcgngggtcacggcccgaaggcctcgccccctcggtcacttccg

SEQ ID NO: 379761 - DNA, 567 bp, Homo sapiens
  misc_feature: GZ8MTXP02GYEG6.19.72.G06.1.454.CMB.2.raw
  modified_base (301)..(301): a, c, t, g, unknown or other
  modified_base (332)..(332): a, c, t, g, unknown or other
  modified_base (368)..(368): a, c, t, g, unknown or other
tcagtactctcgtgcacgaccggtgctcgatttagctacgactgcaagggaaagggggggtcgcaagaggcagcgctctcgggacgtctccaccatggcctgggctctgctgctcctcactctcctcactcaggacacagggtcctgggcccagtctgccctgactcagcctgcctccgtgtctgagtctcttggacagtcgatcaccatctcctccactgggaccgtgtgatgttggacttatacccttgtctctgtaccaacaactaccccggcaaacgcccccaaactcctgatttangagctacataacgcggccctgaggggtttcngagcgtcttctctcggctccgagggctagaccaacncgcctaactgacgatctcgtggcctcgagctggaggacgagctagacttattatgctgcgcagtacgacgaaggaagtagacacagtgggtgtggcgggacgggaggggaaccgtaagggtcggaacccggttccgtcgggtacaacggaacccgaaacggtcccgtaccggcccccgtcggtaccctaccgttcccgg

SEQ ID NO: 379762 - DNA, 564 bp, Homo sapiens
  misc_feature: GZ8MTXP02FFJ5G.19.72.G06.1.454.CMB.2.raw
  modified_base (330)..(330): a, c, t, g, unknown or other
  modified_base (365)..(365): a, c, t, g, unknown or other
  modified_base (533)..(533): a, c, t, g, unknown or other
  modified_base (555)..(555): a, c, t, g, unknown or other
tcagtactctcgtgcacgaccggtgctcgatttagctacgactgcaagggaaagggggggtcgcaagaggcagcgctctcgggacgtctccaccatggcctgggctctgctgctcctcactctcctcactcaggacacagggtcctgggcccagtctgccctgactcagcctgctccgtgtctgagtctcttggacagtcgatcaccatctcctccactgggaccgtcgtgatgttggacttataccctgtctcctgtaccaacaactaccccggcaaacgcccccaaatccctgatttatgagctcatacgcggccctgaggggtttcnggacgcgcttctctcggctccgagggctgaccacnccggcctacctgacgatctctgggctcgaggctgaggacgagctgactattattgctgcgcatacgacaaggacgtagcaacgtgtaggggtgtggacgggcggaacggggaccgaaacgggttcgaacccggttccggtcgggtaccaacggccccgaaaggtcccnccggtcccccgtcgggtacccnctttccccg

SEQ ID NO: 379763 - DNA, 637 bp, Homo sapiens
  misc_feature: GZ8MTXP02I634G.19.72.G06.1.454.CMB.2.raw
  modified_base (311)..(311): a, c, t, g, unknown or other
  modified_base (344)..(344): a, c, t, g, unknown or other
  modified_base (461)..(461): a, c, t, g, unknown or other
  modified_base (473)..(473): a, c, t, g, unknown or other
tcagtactctcgtgcacgaccggtgctcgatttagctacgactgcaagggaaaggggggggtcgcaagaggcagcgctctcgggacgtctccaccatggcctgggctctgctgctcctcactctcctcactcaggacacagggtcctgggcccaatctgccctgactcagcctgcctccgtgtctgagtctcttggacagtcgatcaccatctcctcacgtgggaccgtgtgatggttggacttactacccttgtctcctggtaccaacaacgtaccccggacaaacgcccccaaactcctagtatttagngagctacataacgccgtcctcgtaggggtttcnggacgcgtcttcgtctcggcctcgaggtctagaaccgaaccgccgggccttaccgtgaccgtactcttacggcgggtcctccgaggtctgggaacggacgtaggctagtacttaacncgtcgctgcctntaagtgtcgatacggttcttacttccttatttacgtcgttcggttaccggtaaacgggtaccgggtaacctaacgggttaccctaccggttaccgtaacggtaccaccggaaccccgtaaaaccggaccccaaaacccgttctaccggtacctacctttccccg

SEQ ID NO: 379764 - DNA, 729 bp, Homo sapiens
  misc_feature: GZ8MTXP02HJPLA.19.72.G06.1.454.CMB.2.raw
  modified_base (312)..(312): a, c, t, g, unknown or other
  modified_base (346)..(346): a, c, t, g, unknown or other
tcagtactctcgtgcacgaccggtgctcgatttagctacgactgcaagggaaagggggggtcgcaagaggcagcgctctcgggacgtctccaccatggcctgggctctgctgctcctcactctcctcactcaggacacagggtcctgggcccagtctgccctgactcagcctgcctccgtgtctgagtctcttggacagtcgatcaccatcctcctccacgtgggaccgtcgtgatggttggacttatacccttgtctccgtagtaccaacaactaccccggacaaaccgcccccaaactcctagtatttangagctacataacgccggtccctcgtagggtttcnggacgccgtcttcgtcgtacggcctcgacgggtctacgaaccaaccgccggtccctaaccgtcgaccgtacttccgtccgtcggggccttacccgaggtcgacgggaacgggacggacggtcctaggtaacctttaagttacgttcggtacgttcgaccggacttaacgtaccggacgtaagggtaacgacggaccgtaagtagggttggggtagggtcggaccgggggtaacgggggaacggggaaacccggttaaacggggttccggtaacccccgggtttccgggtaacgggggttacccaacccgggtaacccccggtaaagggtcccccgtccccggtacccccccggtcggttacccttaaccccggtttcccccgg

SEQ ID NO: 379765 - DNA, 557 bp, Homo sapiens
  misc_feature: GZ8MTXP02H6JR8.19.72.G06.1.454.CMB.2.raw
  modified_base (280)..(280): a, c, t, g, unknown or other
  modified_base (305)..(305): a, c, t, g, unknown or other
  modified_base (344)..(344): a, c, t, g, unknown or other
  modified_base (366)..(366): a, c, t, g, unknown or other
  modified_base (378)..(378): a, c, t, g, unknown or other
tcagtactctcgtgcacgaccggtgctcgatttagctacgactgcaagggaaaggggggtcgcaagaggcagcgctctcgggacgtctccaccatggcctgggctctgctgctcctcactctcctcactcaggacacagggtcctgggcccagtctgccctgactcagcctgccctccgtgtctgagtctcttggacagtcgatcaccatctcctccactgggaccgtcgtgatgttggacttatacccttgtctcctggtaaccaacaactaccccggnaaacgcccccaaatcctagatttangagctcataacgcgccctgaggggtttctgagcgcttcnctcggctccgaggctgacaacncgcctactgacntctcgtggcctcaggctggacgacgaggctagactatatgctgccgctagtacgcgtaaaggagtacgacgacaggttcgggtagtcggcgggacgggacgggacctaaaggggtccgaccgttccgacggggtcacggaacccgaaggccgttccgcccccgtcggtactaccgtccg

SEQ ID NO: 379766 - DNA, 619 bp, Homo sapiens
  misc_feature: GZ8MTXP02HI0OJ.19.72.G06.1.454.CMB.2.raw
  modified_base (301)..(301): a, c, t, g, unknown or other
  modified_base (333)..(333): a, c, t, g, unknown or other
  modified_base (336)..(336): a, c, t, g, unknown or other
  modified_base (385)..(385): a, c, t, g, unknown or other
  modified_base (403)..(403): a, c, t, g, unknown or other
tcagtactctcgtgcacgaccggtgctcgatttagctacgactgcaagggaaagggggggtcgcaagaggcagcgctctcgggacgtctccaccatggcctgggctctgctgctcctcactctcctcactcaggacacagggtcctgggcccagtctgccctgactcagcctgcctccgtgtctgagtctcttggacagtcgatcacatctcctcacgtgggacgtcgtgatgtggacttataccttgtctctgtaccaacaactacccggacaaacgcccccaaactcctagtactttancgagtctacagtaagccgtcctgtagggttcngancgtcttctgcgctcgaggctgacaacgcgcctacgcgacgactcgtcgngggtactccgacggtcgnggaggtacgagtcgtacgtaactttagttacttgccttaggccgtacgaacgtacggaccgtaaagggaacgtacggaccaaggtacgtggggtacgggtcggaccggggacgggaacggggaccgtaaacggggtccgtaacccggtcggtcgggtaccacgggtcccgaaacggggcccttcccgacccccgttcggacccgttaccgttcccg

SEQ ID NO: 379767 - DNA, 674 bp, Homo sapiens
  misc_feature: GZ8MTXP02HID7J.19.72.G06.1.454.CMB.2.raw
tcagtactctcgtgcacgaccggtgctcgatttagctacgactgcaagggaaagggggggtcgcaagaggcagcgctctcgggacgtctccaccatggcctgggctctgctgctcctcactctcctcactcaggacacagggtcctgggcccagtctgccctgactcagcctgcctccgtgtctgagtctcttggacagtcgatcaccatcctcctccactgggaccgtgtgatggttaggacttataccccttgtctctggtaccaacaactaccccggacaaaccgccccccaaactccctagtaatttagtcgacggtctacaactaacggccggtccccttcggtacggggtttttcaggtacgccgttctttccgtccgtccgggtccttccggagggtcctacgaaccaacgccggtccctaaccgtgaccgtattccgacgttcgggccctcgaacggtctgggaacggacgacgggtctacggtactttacgttagtcgtcgtcggcacgtagttaccggacgaacgggaagtcgaccacgtagggtggggttgcggggaccggacggggaacgggtacccgaaaggggttccgtaacccgggttcgacgggtacgacgaacccggaggtccgtccggtcccccgtcggacccgttctttccccgg

SEQ ID NO: 379768 - DNA, 611 bp, Homo sapiens
  misc_feature: GZ8MTXP02GI3XE.19.72.G06.1.454.CMB.2.raw
  modified_base (448)..(448): a, c, t, g, unknown or other
  modified_base (456)..(456): a, c, t, g, unknown or other
tcagtactctcgtgcacgaccggtgctcgatttagctacgactgcaagggaaagggggggtcgcaagaggcagcgctctcgggacgtctccaccatggcctgggctctgctgctcctcactctcctcactcaggacacagggtcctgggcccagtctgccctgactcagcctgcctccgtgtctgagtctcttggacagtcgatcaccatcctcctccacgtgggaccgtcgtgatggttggacttatacccttgtctcctggtaccaacaactaccccggcaaacgcccccaaactccctgatttatgaggctcataagcggccccttgaggggtttctaggacgcggtccttcgtcctcgggcctccgaggggtctcggaaccaacgcccgggcctaacccgtgaccgatcgtcgtgggcctcgaggctggagacgaggctgactnttattcgngtgcgcagtacgacgaggaagtagacacaaggtggggtgtaggcgggacggggaacggggacccgtaaggggtccgaacccggttcggtacggggtcgaaacgggccccgtaaacgggccgttccgccccccggtacggttcccacgtttccccg

SEQ ID NO: 379769 - DNA, 630 bp, Homo sapiens
  misc_feature: GZ8MTXP02GR79R.19.72.G06.1.454.CMB.2.raw
  modified_base (285)..(285): a, c, t, g, unknown or other
  modified_base (316)..(316): a, c, t, g, unknown or other
  modified_base (359)..(359): a, c, t, g, unknown or other
  modified_base (427)..(427): a, c, t, g, unknown or other
tcagtactctcgtgcacgaccggtgctcgatttagctacgactgcaagggaaagggggggtcgcaagaggcagcgctctcgggacgtctccaccatggcctgggctctgctgctcctcactctcctcactcaggacacagggtcctgggcccagtctgccctgactcagcctgcctccgtgtctgagtctcttggacagtcgatccaccatctcctcacgtgggaccgtcgtgattggttggactttactacccttgtcctcctgtaccaacaactaccccgganaaaccgcccccaaaactcctagtactttagngaggtctacaataacggccggtacccctggtaacggggtttcnggacgtcgtccttcgtcgtcggtcctaccgagggctacgaacctaacgccggtcctactacgaccgtntccttcggtcgggacctccgagtccgtagggacggacgtacggcgtagtaacttagttacttgctgcgagtacacggagaaaggacgtcgacagtggtcgggtagcgacggggcggaacgggaccgtaaacgggttccgaccggttccggcggtaccgacggaacccgaacgccgtaccgcccccgtacggtcctacgtcccg

SEQ ID NO: 379770 - DNA, 656 bp, Homo sapiens
  misc_feature: GZ8MTXP02IXCLR.19.72.G06.1.454.CMB.2.raw
  modified_base (289)..(289): a, c, t, g, unknown or other
  modified_base (322)..(322): a, c, t, g, unknown or other
  modified_base (357)..(357): a, c, t, g, unknown or other
  modified_base (405)..(405): a, c, t, g, unknown or other
  modified_base (452)..(452): a, c, t, g, unknown or other
  modified_base (490)..(490): a, c, t, g, unknown or other
tcagtactctcgtgcacgaccggtgctcgatttagctacgactgcaagggaaagggggggtcgcaagaggcagcgctctcgggacgtctccaccatggcctgggctctgctgctcctcactctcctcactcaggacacagggtcctgggcccagtctgccctgactcagcctgcctccgtgtctgacgtctcttggacagtcgaatcaccatcctcctccagtgggacccgtgtgattggttggacttatacccgttgtctccgtgtaacccaacaacgtaccccgganaaaaccgccccctaaactcctagtaatttacgngacgtctacataacggccggtcctgtagggtttcngagtctcgttctcgtgcctcgagctagacaacgccggcctacgtgacntcgtcgtcgctccgaggtctggacggacgagtctacgattataggtnacgttggcactagacccgagtaaggtaacgagaaccgngtagggttacggggtcggacggggacggggtaaccggggaaacgggtaaccggtaacggggttcccgacccgggttccggtacggggtaacccgaacccgggtaacccggtacggtaccccggttcccccggtaccccggttcggtaaccccgtccggtttacccg

SEQ ID NO: 379771 - DNA, 602 bp, Homo sapiens
  misc_feature: GZ8MTXP02GGFA3.19.72.G06.1.454.CMB.2.raw
  modified_base (304)..(304): a, c, t, g, unknown or other
  modified_base (311)..(311): a, c, t, g, unknown or other
  modified_base (334)..(334): a, c, t, g, unknown or other
  modified_base (339)..(339): a, c, t, g, unknown or other
  modified_base (345)..(345): a, c, t, g, unknown or other
  modified_base (413)..(413): a, c, t, g, unknown or other
  modified_base (493)..(493): a, c, t, g, unknown or other
tcagtactctcgtgcacgaccggtgctcgatttagctacgactgcaagggaaagggggggtcgcaagaggcagcgctctcgggacgtctccaccatggcctgggctctgctgctcctcactctcctcactcaggacacagggtcctgggcccagtctgccctgactcagcctgcctccgtgtctgagtctcttggacagtcgatcaccatcctcctccacgtgggaccgtcgtgattggtggacttataccctgtctcctagtaccaacaactaccccggcaaacgccccaaactccttattangagctanatacgccgcctcgtagggtttcngagcncttacncgtggccctcgagggctagacaaccacggcctaacctgaaccgtatccgtcgtcgggctccgaggtcngagggacagggtactaggtaacttagttagtctccgtgccgagaactacggacaaagggaagtacgacgagagttggggngtcgggacgggtacgggacgggaaccgagggtccggtaccgtcggttacgggaaccaccgggacccgaaggtcctccggaccccctggtaccaccgttccgttaccccg

SEQ ID NO: 379772 - DNA, 641 bp, Homo sapiens
  misc_feature: GZ8MTXP02FZABH.19.72.G06.1.454.CMB.2.raw
  modified_base (242)..(242): a, c, t, g, unknown or other
  modified_base (344)..(344): a, c, t, g, unknown or other
  modified_base (421)..(421): a, c, t, g, unknown or other
  modified_base (494)..(494): a, c, t, g, unknown or other
  modified_base (526)..(526): a, c, t, g, unknown or other
  modified_base (535)..(535): a, c, t, g, unknown or other
tcagtactctcgtgcacgaccggtgctcgatttagctacgactgcaagggaaagggggggtcgcaagaggcagcgctctcgggacgtctccaccatggcctgggctctgctgctcctcactctcctcactcaggacacagggtcctgggcccagtctgccctgactcagcctgcctccgtgtctgagtctcttggacagtcgatcaccatctcctcactgggaccgtgtgatgttggacttntacctgtctctgtaccaacaactacccggcaaacgccccctaaaactcctgtaactttatgaacggctacagtaaacgccggtcccttgtacggggtttccngtacgccgtcttctcgtacggccttccgaacgggctacgaccgaaacgccgggaccttaacgacggaccgtacttcncggttcgggtacctcccgaaagtccgtaggaacgggacgtaggcctagtacgttaattacttgcgttagccgnacgtaccgagtaagggtaacaggacacgtagngggttacgngggcgggacgggaggacgtaaacggggtctaacggtccgtacgggaccaaacggcccggtaaacgtccggtacccgccccggttacggtaccgtacctttccccgg

SEQ ID NO: 379773 - DNA, 615 bp, Homo sapiens
  misc_feature: GZ8MTXP02FOFCL.19.72.G06.1.454.CMB.2.raw
  modified_base (303)..(303): a, c, t, g, unknown or other
  modified_base (327)..(327): a, c, t, g, unknown or other
  modified_base (336)..(336): a, c, t, g, unknown or other
tcagtactctcgtgcacgaccggtgctcgatttagctacgactgcaagggaaagggggggtcgcaagaggcagcgctctcgggacgtctccaccatggcctgggctctgctgctcctcactctcctcactcaggacacagggtcctgggcccagtctgccctgactcagcctgcctccgtgtctgagtctcttggacagtcgatcaccatctcctccactgggaccgtcgtgatgttggacttatacccttgtctcctgtaccaacaataccccggcaaacgcccccaaactcctagatttangaggctcataacgcggcccctcgnggggtttcnggagcgctttccgtcgtggcctccgagggtctcgacaaccgtcgggccctactcgaaccggactcgtaccgtcgggtctcccaggctaggacggacggtaggacctggtaactagttatcgcttgacgctacgtacgtacgaaggaaacgtaacgtacgacgtaacgtcgggtgttcgggacggacggggacggggtaacgaaacgggtcggtaaccggtcccgtagggtccgacgaaccgaaacggtctaccggtacccccgtcggtcgacctttccg

SEQ ID NO: 379774 - DNA, 526 bp, Homo sapiens
  misc_feature: GZ8MTXP01D3IKR.17.87.H10.1.454.CMB.2.raw
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcgcagtgatggttgggggttataaccttgtctcctggtaccaacaccacccagacaaagcccccaaactcatccttatgaggcactaagcgccctcagggtttctaatcgcttcgctcggctcacgtctggcagcacgcctccctgacaatctctgggctccaggctgaggacgagctgattatactgctggctcatattcaagtcgttgtactactattgtagttttggcggagttcacgaaggtcgaccgttccgttggttcaacgtcccgaagtctccgcccctcggttcctaacccg

SEQ ID NO: 379775 - DNA, 511 bp, Homo sapiens
  misc_feature: GZ8MTXP01EUZXL.17.87.H10.1.454.CMB.2.raw
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcgcagtgatgttgggggttataaccttgtctcctggtaccaacaccacccagacaaagcccccaaactcatccttatgagggcactaagcggccctcaggggtttcaatcgcttcgctggctcacgtctggcagcacggcctccctgacaatctctgggctccagctgaggacgaggctgattattactgctggctcatattcaagtcgtgtcactatgtattttgggcggtaggcacgaggtgaccgttcgttgttcaagccaagctcgcccctcggttctaacc

SEQ ID NO: 379776 - DNA, 515 bp, Homo sapiens
  misc_feature: GZ8MTXP01BRV1N.17.87.H10.1.454.CMB.2.raw
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcgcagtgatgttgggggttatacttgtctctggtaccaacacacccagacaaagcccccaaactcatcctttatgagggcactaagcggccctcagggggtttctaatcgcttcgctcggctcacgtctgcagcacggcctccctgacatctctgggctcagctgaggacgagctgattatactgctggctcatattcaagtcgtgtcactatgtattttgggcggtaggttcaccgaggtcgaccgttcgttggttcaagcccaaggcctcgcccctcggttcctcccg

SEQ ID NO: 379777 - DNA, 523 bp, Homo sapiens
  misc_feature: GZ8MTXP01EUKSE.17.87.H10.1.454.CMB.2.raw
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctggtctcctggtcagtcgatcaccatctcctgcactggaagcggcagtgatggttggggttatacttgtctctggtaccaacaccaccagacaaacgcccccaaactcatccttatgagggcactaagccggccctcgaggggtttctaatcgcttcgctcggctcacgtctggcagcacggccctccctgacatctctgggctcaggctgaggacgaggctgattatactgctggctcatattcaagtcgtgtctactatgttagttttgggcggtaggcacgaaggtcgaccgttccgttggttccaagccaacggctcgcccctcggttctaacccg

SEQ ID NO: 379778 - DNA, 514 bp, Homo sapiens
  misc_feature: GZ8MTXP01BJUG6.17.87.H10.1.454.CMB.2.raw
  modified_base (503)..(503): a, c, t, g, unknown or other
  modified_base (509)..(509): a, c, t, g, unknown or other
tcagcgtagactagcacgaccggtgctcgatttagcagtactgcgttgggtttgggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcgtgatgttgggggttataaccttgtatcctggtaccaacaccacccagacaaagcccccaaactcatcctttatgagggcactaagcggccctcaggggtttctaatcgcttcgctggccttccacgtctggcaagccaacggccctccctgacaatctctgggctccaggctgaggacgaggctgattattactgctgctcatattcaagtccgtgtcactatgatttttggcggaaggcacaaggttgaccgtccagttcagccagctgccccncggtcncgtcc

SEQ ID NO: 379779 - DNA, 509 bp, Homo sapiens
  misc_feature: GZ8MTXP01AFUVA.17.87.H10.1.454.CMB.2.raw
tcagcgtagactagcacgaccggtgctcgatttagcagtactgcgttgggtttgggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctctggtaccaacaccacccagacaaagcccccaaatcatcctttatgagggcactaagcggccctcaggggtttctaatcgcttcgctggctcacgtctggcagcacggcctccctgacatctctgggctccagctgaggacgaggctgattatactgctggctcatattcaagtctgtcactatgtattttggcggtagcaccaaggtgaccgttcttagggttcaagcccaaggctcgcccctcggttcaacc

SEQ ID NO: 379780 - DNA, 527 bp, Homo sapiens
  misc_feature: GZ8MTXP01ED1KO.17.87.H10.1.454.CMB.2.raw
  modified_base (298)..(298): a, c, t, g, unknown or other
  modified_base (365)..(365): a, c, t, g, unknown or other
tcagcgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataacttgtctctgtaccaacaccaccagacaacgccccaaatcatccttangaggcactaagcgcctcgagggtttctaatcgctcgctcggctcacgtctggcagcacggcctcccngacatctcgtggctcgagctgaggacgagctgattatactgctggctcatatactaagtcgtgtactactatgttagttttgggcggtagacgaacgaacggtcgtaccgttccgttacggttccaacgccctaaggcctcgccccttccgttcgtaacccg

SEQ ID NO: 379781 - DNA, 530 bp, Homo sapiens
  misc_feature: GZ8MTXP01EENOL.17.87.H10.1.454.CMB.2.raw
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctggtctcctggtcagtcgatcaccatctcctgcactggaagcgcagtgatgttggggtatactgtctctgtaccacacaccagacaaagcccccaaatcatccttatgaggcactaagcgccctcagggtttctaatcgcttcgctcggctcacgtctggcagcaccggcctccctgacaatctctcgggctccgagctgaggacgagctagtattatactgctggctctatattacgaagttcgtagtctacttatgtattttgggcggtagcaacgttaaggtcgaccgttaccgttggttccaacgacccgaacggtcctccgccccgtccggttaacctcccg

SEQ ID NO: 379782 - DNA, 542 bp, Homo sapiens
  misc_feature: GZ8MTXP01DV6YH.17.87.H10.1.454.CMB.2.raw
  modified_base (368)..(368): a, c, t, g, unknown or other
  modified_base (514)..(514): a, c, t, g, unknown or other
  modified_base (525)..(525): a, c, t, g, unknown or other
tcagcgtagactagcacgaccggtgctcgatttagcagtactgcgttgggtttggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctctgtacaacaccaccagaacaacgacccccaaactcactccttatgaggcaactaagccgcctcgtagggttactaagtcgtctcgcgtcggcctacgtcgtcgtgaccganccgacggtccctcccgtagaccaatctcgtcggctcgaggctgaggacgaggctagtattaatctgcctggtctctaattctactaagttccgtgtacctattatgttgtttcggaagtcgcacgagtcgaccgttcgttgttacncgaccaagtcnccgcccgtcggcttccg

SEQ ID NO: 379783 - DNA, 528 bp, Homo sapiens
  misc_feature: GZ8MTXP01B5SFZ.17.87.H10.1.454.CMB.2.raw
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccaacaccacccagacaaagcccccaaatcatccctttatgagggcactaagcggccctcaggggtttctaatcgcttcgctcggctcacgtctggcagcacggccctccctgacaatctctgggctccaggctgaggacgaggctgattatactgctggctcattattcaagtcgtgtctacttatgtatttttggcggtaggcacgaggtcgaccgttccgttggttcaagtcccaaggcctcgccccctcggttcctcccg

SEQ ID NO: 379784 - DNA, 531 bp, Homo sapiens
  misc_feature: GZ8MTXP01BVR3W.17.87.H10.1.454.CMB.2.raw
tcagcgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttggggttatacttgtctctgtaccacaccacccagacaaacgcccccaaatcatccttatgagggcactaagccggccctcgaggggtttctaatcgcttcgctcggcctccacgtctggccagcacggccctccctgacatctcgtggctccagctgaggacgagctgattattactgctggctctattattcaagtcgtgtactactattgttagttttgggcggtaggcctacgaggtcgaccgttcgttggttcaacgcccgaaggcctcgcccctcggttctaacccg

SEQ ID NO: 379785 - DNA, 654 bp, Homo sapiens
  misc_feature: GZ8MTXP01E21NN.17.87.H10.1.454.CMB.2.raw
  modified_base (312)..(312): a, c, t, g, unknown or other
  modified_base (364)..(364): a, c, t, g, unknown or other
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcacgtggaagcggcagtgtagttggttagggggttactaaccttgtctcctggtaaccaacaccacccagacaaacgccccaaactcactcttagngacggcacgtaagccgccctgtagggttcatcgtctcgctcggctcacgtcnggcacgccaccggcctaccctgactactcgtcgtcgggctaccgaggtccgaggacgggaccggagggtacctaggttaacttaacgtttaccgtcgtcgtacggtactactaacgttacgttacgtaacgttcgttacgttacgttaacgttacgttacggttacggtttcgggaaccggtaacggaaccgtaaccggttaaccggtacccggtaacccgttaccgttaccggaccgaacccgacccgtaaccgtcccgtccccgttccccgtaaccgttcccgtcccg

SEQ ID NO: 379786 - DNA, 636 bp, Homo sapiens
  misc_feature: GZ8MTXP01CEMBL.17.87.H10.1.454.CMB.2.raw
  modified_base (296)..(296): a, c, t, g, unknown or other
tcagcgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctctgcactggaagcgcagtgagtggttagggggttataccgttgtctcctggtaccaacaccacccagacaaacgccccaaacncatccttatgaggcactaagcgcctcgtagggttctaatcgcttcgctcggctccgacgtcgtgacacgcgccgccctccagacactctcgtcggctccgacggcgtaggacggacggacggtacgtagttaacttacttacgtcgtcgtcgggtcttactaattacgttacgtaacgttcgtacgttactaacttagttacgtttagttttcggggaacggtaacggttaccgtaaaccgggttaacgggttaccgtacccgttaccgttacggttaccggaaccggacccggtaacggtcccgtacccggttcccccgttcgggttccccttaacccg

SEQ ID NO: 379787 - DNA, 532 bp, Homo sapiens
  misc_feature: GZ8MTXP01DVMMN.17.87.H10.1.454.CMB.2.raw
tcagcgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatggttgggggttataaccttgtctcctggtaccaacaccaccagacaaacgccccaaatcatccttatgaggcactaagcggcctcgagggtttcaatcgcttcgctcggctcacgtctggcagcacgccctccctgacatctctggctcagctgagacgagctgattatatgctgctcattatcaagtcgtgtacattatgttagttttggcggtaggcgaaccgaaggtcgtacccgttccgttaggttcaacggcccgaacggtccgtccgttccccgtcggttccgtaacccg

SEQ ID NO: 379788 - DNA, 533 bp, Homo sapiens
  misc_feature: GZ8MTXP01CG5BW.17.87.H10.1.454.CMB.2.raw
  modified_base (334)..(334): a, c, t, g, unknown or other
tcagcgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcacatctctgcactggaagcggcagtgatggttgggggttataaccttgtctctggtaccaacaccaccagacaaacgcccccaaatcatccttatgaggcactaagcggcctcgagggttctaatcgnttcgctcggctcacgtctggcagcacggcctcctgacatctctggctcaggctgaggacgagctgattatactgctggctctatacttcaagttcgtgttacacttagttgtattttgggcggtaggctaacgacggtcgaccgttccgttaggttcgaacgcccgaacggtctccgccccgtaacggttcctaacccg

SEQ ID NO: 379789 - DNA, 520 bp, Homo sapiens
  misc_feature: GZ8MTXP01CSEWG.17.87.H10.1.454.CMB.2.raw
  modified_base (421)..(421): a, c, t, g, unknown or other
tcagcgtagactagcacgaccggtgctcgatttagcagtactgcgttgggtttggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatggttgggggttataaccttgtctctggtaccaacaccacccagacaaagcccccaaatcatccttatgagggcactaagcggccctcaggggtttcaatcgcttcgctcggctcagtctggcagcacggcctccctgacatctctgggctccaggctgaggacgaggctgattattactgctggctntatattcaagtcgtgtcacttatgtagttttggcggtaggctaccgagtcgccgttcgttggttcaagcccgaaggcctcgccccctcggttctaaccg

SEQ ID NO: 379790 - DNA, 509 bp, Homo sapiens
  misc_feature: GZ8MTXP01CUHV6.17.87.H10.1.454.CMB.2.raw
  modified_base (318)..(318): a, c, t, g, unknown or other
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttggggttataaccttgtctctggtaccaacaccacccagacaaagcccccaaactcatccttatgaggcactaagcgcctnagggtttcaatcgcttcgctcggctcagtctgcagcacggcctccctgacaagtctctggctcaggctgaggacgaggctgattatactgctggctcatattcaaagtcgtgtacactatgtagttttggcggtaggcacaggtagaccgttcgttacgttcaacgccaacgctcgcccctcggttcgtcc

SEQ ID NO: 379791 - DNA, 546 bp, Homo sapiens
  misc_feature: GZ8MTXP01DXW94.17.87.H10.1.454.CMB.2.raw
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcgcagtgatgtggggtatactgtctctgtacaacacaccagacaacgccccaaactcatccttatgaggcactaagcggcctcaggggtttctaatcgtcttcgctcggctcacgtctggcagcacggcctccctgacaatctctcggctccaggctgaggacgaggctgattatactgctggctctatacttcaagttcgtgtacacttattgtagttttgggcggtaggttcgaaccgttaaggtacgtacccggttccgttagggttaccaacgaccccgaacgggtcctccggcccccgttccggttccttaacccg

SEQ ID NO: 379792 - DNA, 639 bp, Homo sapiens
  misc_feature: GZ8MTXP01C9NBG.17.87.H10.1.454.CMB.2.raw
  modified_base (300)..(300): a, c, t, g, unknown or other
  modified_base (364)..(364): a, c, t, g, unknown or other
tcagcgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatggttgggggttatacgttgtctctgtaccacaccaccagaacaacgccccaaactcatccttangaggcacgtaacgccggccctcgtagggtttctatcgcttcgctcggcctccacgtctcggacncgccgaccggtcccctccctagacctactcgtcgtcgggctccgaggtcgtaggacgggacgacggtcttagtaatttacttacgtgtccttggtacttactaacttacgtttacgaagttcgttacgtactacgtttagttggtttaacggttttcgggaacgggtacggaccgtaaaccggttaagggttaccggtacccggttaccgttacggttaccgaaccggacccgtaacggtcccgtcccgttccccgttccggttcccttaacccg

SEQ ID NO: 379793 - DNA, 544 bp, Homo sapiens
  misc_feature: GZ8MTXP01EOPOW.17.87.H10.1.454.CMB.2.raw
  modified_base (506)..(506): a, c, t, g, unknown or other
tcagcgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgagtgttgggggttataacttgtctcctggtaccaacaccacccagacaaacgcccccaaactcatccttatgaggcactaagcggccctcgaggggtttctaatcgcttcgctcggctcacgtctggcagcacggccctcctcgactaatctctgggctccgaggctgaggacgaggctgattattactgctgggctcgtatattcaagttcgtgtctactatgttagttttgggcggtaggcaccgaaggtcgacccgttccgttggttcncgacccgaacggcctcgccccctccgggttcctaaccc

SEQ ID NO: 379794 - DNA, 510 bp, Homo sapiens
  misc_feature: GZ8MTXP01CEIU1.17.87.H10.1.454.CMB.2.raw
  modified_base (274)..(274): a, c, t, g, unknown or other
  modified_base (297)..(297): a, c, t, g, unknown or other
  modified_base (410)..(410): a, c, t, g, unknown or other
tcagcgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcgcagtgatgttgggggttataccttgtctctgtaccaacaccaccanacaagcccccaaatcatccttangaggcactaagcggcctcaggggtttcatcgcttcgctcggctccacgtctggcagcgaccggcctccctgacactctctgggctcgaggctggagacgaggctgattatacngctggctcatattcaagtcgtgtcacttatgttagttttggcggtagcaccgaaggtcgacgttcgttgttcaagccaagctcgcccctcggttctcccg

SEQ ID NO: 379795 - DNA, 510 bp, Homo sapiens
  misc_feature: GZ8MTXP01DHQUZ.17.87.H10.1.454.CMB.2.raw
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctggtctcctggtcagtcgatcacatctcctgcactggaagcgcagtgatgttgggggttataaccttgtctcctggtaccaacaccacccagacaaagcccccaaactcatccttatgaggcactaagcggccctcaggggtttctaatcgcttcgctcggctcacgtctggcagcacgccctccctgacaatctctggctccagctgaggacgaggctgattatactgctgctcatatcaagtcgtgtcactatgtattttggcggtagcaccaggtcgaccgttcgttgttcaagcccaaggcctcgccccctggttcctaaccc

SEQ ID NO: 379796 - DNA, 572 bp, Homo sapiens
  misc_feature: GZ8MTXP01A081Y.17.87.H10.1.454.CMB.2.raw
  modified_base (296)..(296): a, c, t, g, unknown or other
  modified_base (312)..(312): a, c, t, g, unknown or other
  modified_base (326)..(326): a, c, t, g, unknown or other
  modified_base (359)..(359): a, c, t, g, unknown or other
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttggggttatacttgtctctgtaccaacaccaccagacaacgcccccaaatcatccttangaggcactagcgcctnagggtttctatcgnttcgctcgctcagtctggcagcacggcctcccngacatctctggctcaggctgaggacgagctgattatactgtctggctactattacttactaagtcgtacgttaccacgttattgttacgtttttgggcgggtaacggacgtaaccgttaacgggtacgtacccggttacccgttacggttacccgaacggtccccgtaaacggtcccgtccggttaccccccgtccggttcccgttaaccccg

SEQ ID NO: 379797 - DNA, 574 bp, Homo sapiens
  misc_feature: GZ8MTXP01D6DDF.17.87.H10.1.454.CMB.2.raw
tcagcgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatggttggggttatacttgtctctgtaccacaccaccagacaacgccccaaatcatcttatgaggcacagcgcctgtaggttctatcgtcttcgctcggcctcacgtctggccagccgaccggccctaccctagacctaatcgtcgtcgggctccgaggcgtggaggacggagtactagtattattactgctggcttactattacgttactaagttcgtgtactacttagttgttacgttttggaacggtagcgtaaccgttaaggtaccgtaccgttaccgttacggttacaaccggacccgaacggtccgtcccgttccccgtccggttcctaacccg

SEQ ID NO: 379798 - DNA, 540 bp, Homo sapiens
  misc_feature: GZ8MTXP01DGXGA.17.87.H10.1.454.CMB.2.raw
tcagcgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctctgcactggaagcgcagtgatgttggggtatacttgctctgtacacacaccagacaaagccccaaatcatccttatgaggcactaagcggccctcgtagggttctaatcgcttcgctggcctcacgtctggacagcacggcctccctgacatctctggctcagctgaggacgagctgattatactgctggctctatacttcaagtcgtcgttactacttatgtagttttggaacggtgacgacccgttaaggtcggtacccgttccgttacgggttactaaccgacccgaacggtcctccggttccccctcgggttcccttaacccg

SEQ ID NO: 379799 - DNA, 532 bp, Homo sapiens
  misc_feature: GZ8MTXP01A1FHC.17.87.H10.1.454.CMB.2.raw
  modified_base (300)..(300): a, c, t, g, unknown or other
  modified_base (371)..(371): a, c, t, g, unknown or other
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatggttggggttataccttgtctctggtaccaacaccaccagacaaacgcccccaaatcatccttangaggcactaagcggccctgtaggggtttctaatcgcttcgctcggctcacgtctggcagcacggcctcccngacaatctctgggctcaggctgaggacgagctgtattattactgtctggctctatattcaagtcgtgtcacttatgtagttttgggcggaggcacgaaggtcgtaccgttaccgttcggttctaacgcccgaacggcctcgccccgtcgttccgtaacccg

SEQ ID NO: 379800 - DNA, 655 bp, Homo sapiens
  misc_feature: GZ8MTXP01DS5MK.17.87.H10.1.454.CMB.2.raw
  modified_base (329)..(329): a, c, t, g, unknown or other
  modified_base (432)..(432): a, c, t, g, unknown or other
tcagcgtagactagcacgaccggtgctcgatttagcagtactgcgttgggtttggggggggtcacaagaggcagcgctctcgggacgtctccaccatggcctgggctctgctgctcctcactctcctcactcaggacacgagggtcctgggcccagtctgccctgactcagcctgcctcgtgtctgggtctccgtggtcagtcatcaccatctctgcacgtggaagcggctaggtgtagttgggttagggggttaactaccgttgtctccgtacggtaacccaacacccaaccacgaaccaaaccgaccccaaactcacttaccttagngacggacaacgtaacgccggtaccctggttaacgggtttactaagttccgtcttcggctcggcctacgtacgtcgcgaaccacgccgacccggtccctccganaactactcgtcgtcgactcggacgtcgtacggacggacgagtctagtacttactcgtgtccttgggtcctattaattacgttaacgtaacgttcggtacgttacttacgttaggttagtttacggtttcggggaaggtaacgttacgtaacggttacggtacgtccgttacgttcgttcgaaccgtccgaacggtccgtacccgccgttccgttaacttcccg

SEQ ID NO: 379801 - DNA, 573 bp, Homo sapiens
  misc_feature: GZ8MTXP01BSXMC.17.87.H10.1.454.CMB.2.raw
  modified_base (278)..(278): a, c, t, g, unknown or other
  modified_base (294)..(294): a, c, t, g, unknown or other
  modified_base (347)..(347): a, c, t, g, unknown or other
tcagcgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcgcagtgagtggttggggttatacttgtctctgtaccacacaccagacaacnccccaatcatccttangaggcactaagcgcctgtagggttcatcgctcgctcggcctcacgtctggacngcaccggtccctccctagactatcgtcgtcggctccgaggccgtaggacgggacgaggctagtattattactgtcgtcggcttctattattcgtaagtcgttgtactacgttagttagttacgttttgggcggtacggccgtaaacggttagggttaccgtacccgttccgttaggttaccgaacgacccgtaacggccttccggccccttcggttccttaacccg

SEQ ID NO: 379802 - DNA, 559 bp, Homo sapiens
  misc_feature: GZ8MTXP01CSCDZ.17.87.H10.1.454.CMB.2.raw
  modified_base (385)..(385): a, c, t, g, unknown or other
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttggggttataacctgtctcctggtacaacaccacccagacaaacgcccccaaatcatcctttatgaggcactaagccggtcctcgtaggggttcctaatcgcttcgctcggctcagtctggcagcacggtcctcccgtagacaactcnctgggctcgaggctgaggagagtctgattatactgctggctctatatcgaagtcgtgttcactatgttagttttggcggtacgcgtaacccgttaagggtaccggccgttaccgttacgggttccaacggtaccccgaacggtcctccggttcccctccgggttcttaaccccg

SEQ ID NO: 379803 - DNA, 521 bp, Homo sapiens
  misc_feature: GZ8MTXP01A7SFP.17.87.H10.1.454.CMB.2.raw
  modified_base (372)..(372): a, c, t, g, unknown or other
  modified_base (419)..(419): a, c, t, g, unknown or other
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatggttgggggttataaccttgtctcctggtaccaacaccacccagacaaagcccccaaatcatccttatgaggcactaagcgccctcgagggtttcaatcgcttcgctcggcctcacgtctggcagcacgccctcccngacaatctctcgggctccgaggctggaggacggaggctgattatacngctggctcatattcaagtcctgtcactatgtattttgggcggtggcaccgaggtcgaccgttccgttaggttcaagcccaaggctcgcccctcggctaaccc

SEQ ID NO: 379804 - DNA, 530 bp, Homo sapiens
  misc_feature: GZ8MTXP01EWPUR.17.87.H10.1.454.CMB.2.raw
  modified_base (512)..(512): a, c, t, g, unknown or other
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctcgtgtctgggtctcctggtcagtcgatcaccatctcctgcactggaagcggcagtgatggttggggttataccttgtctctggtaccaacaccaccagacaaacgcccccaaatcatccttatgaggcactaagcgtccctcgtagggtttcatcgcttcgctccggctcagtctggcacgcaccggcctccctgactaatctcgtcggctcgaggctggaggacgagctgtattattactgctggctctattacgttacaagtcgtgtactacttattgttagttttgggcggtaggctacgaggtcgtaccgttcgttgttcaacgccaacgcnccgccctcgttctaaccg

SEQ ID NO: 379805 - DNA, 543 bp, Homo sapiens
  misc_feature: GZ8MTXP01D24D0.17.87.H10.1.454.CMB.2.raw
  modified_base (358)..(358): a, c, t, g, unknown or other
tcagcgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctctgcactggaagcgcagtgatggttggggttatacttgctctgtaccacacaccagaacaacgcccccaatcatccttatgaggcactaagccggccctcgtagggtttcatcgcttcgctcgctcagtctgcagcacgcctccngacatcgtctcggctcgagcgtgaggacgaggtctagtattatactgtctggtcttactattactacgtaagttccgtgttacctattagttcgttagttttgggcggtagccgtacgaggtcgtacccgttcgttggttccgaacgacccgaacggtcctccgttccccgtcgttcctaacccg

SEQ ID NO: 379806 - DNA, 547 bp, Homo sapiens
  misc_feature: GZ8MTXP01B921B.17.87.H10.1.454.CMB.2.raw
  modified_base (299)..(299): a, c, t, g, unknown or other
  modified_base (423)..(423): a, c, t, g, unknown or other
  modified_base (428)..(428): a, c, t, g, unknown or other
tcagcgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatggttgggggttataacttgtctctgtaccaacacaccagacaaacgccccaaatcatccttangaggcactaagcggccctgtagggttctaatcgcttcgctcggctcacgtctggcacgcacggcctccctgacactctctgggctccaggctgaggacgaggctagattattactgctggtctnatatntaagtcgtgtctactatgtattttgggcggtgttcgaccgagggtacgtaccggttaccgttagggttccaacggacccgaacggtcccgtccgttccccgtccggttcgttaaccccg

SEQ ID NO: 379807 - DNA, 659 bp, Homo sapiens
  misc_feature: GZ8MTXP01ARR9G.17.87.H10.1.454.CMB.2.raw
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctcgtgtctgggtctcctggtcagtcgatcaccatctctgcactggaagcggcgtgagtgttggggttatacttgtatctggtacacaccaccagacaaagccccaaactcatccttatgaggcactaagcgcctcgagggtttctaatcgcttcgctggccctccacgtcgtcggcaagccgaaccggccctccccgttgacctaatccgtcgttcgggccttccgacggccgtggaacgggacggtaaacggcgttaggtaatttacttaacgtgtcgttcggtcgtactaagttacttacgtaaacggttcgtggttacctaaccgttagttagttaggttttttacgggcgggtaacggtacccgttaaccggtaaacgggttaccggtacccgtaccccgacgggttcccgacggaacccccggtaaacggtcccgtcccggtcccccccgttccgggttaacccttccgtttcccccgg

SEQ ID NO: 379808 - DNA, 519 bp, Homo sapiens
  misc_feature: GZ8MTXP01E4W1N.17.87.H10.1.454.CMB.2.raw
  modified_base (457)..(457): a, c, t, g, unknown or other
tcagcgtagactagcacgaccggtgctcgatttagcagtactgcgttgggtttgggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcggtgatgttgggggttataaccttgtatctggtaccaacaccaccagacaaagccccaaactcatccttatgaggcactaagcggccctcagggggtttctaatcgcttcgctggcctccacgtctggcaagcaacggcctccctgacaatctctggggctccaggctgaggacgaggctgattaattactgctgctcatattcaagtcgtgtcactatgattttggcgnggcaccgaaaggttgaaccgtccaggttcaggcccaagggctgcccccttcggtcaacttcc

SEQ ID NO: 379809 - DNA, 654 bp, Homo sapiens
  misc_feature: GZ8MTXP01A1O8I.17.87.H10.1.454.CMB.2.raw
  modified_base (230)..(230): a, c, t, g, unknown or other
  modified_base (300)..(300): a, c, t, g, unknown or other
  modified_base (355)..(355): a, c, t, g, unknown or other
tcagcgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcacgcctgcctccgtgtctgggtctcctggtcagtcgatcaccatctctgcacgtggaagcgnagtgagttgggttggggttatacttgtctctgaccacaccaccagaacaacgccccaaatcactcttagngacggacacaagccgtcctcgtaggtttcatcgtcttcgctccggctcgacgtcncgacacgcccgaccggtccctccgtacgactaactcgttccgtcggtccgtaccgacgggtacgtaggaacgggtaccggaaggtccgttaggtaactttacgttacgttcgtccgttcgggtacttacgttaacttacgttaacgtaacggttcggttacgttaactacgttaagttacggttacggttttggggaacgggttaacggacgtaaaccggttaacggtaccgtacccggttccgttacggttaccgaacgccgtaacgtcccgtccgttccccgtcgttccgtaacccg

SEQ ID NO: 379810 - DNA, 581 bp, Homo sapiens
  misc_feature: GZ8MTXP01AICK0.17.87.H10.1.454.CMB.2.raw
  modified_base (292)..(292): a, c, t, g, unknown or other
  modified_base (425)..(425): a, c, t, g, unknown or other
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatggttggggttatactgtctctgtaccacaccaccagacaacgccccaatcatcttangaggcactagcgcctgagggtttcatcgtctcgctcggctcgacgtctgcacgcaccggccctcctcgaacactctcgtgggcctccgaggcctaggaggacggaggtctagtattattactgtctcggtctntaattacgttactaagttcgtgttacctacgttattggtttagttttgggcggtaacggacggtaaccgaacgggttaccgaccgttccggttacggttcccgaacggaccccgtaacggtcccgtcccggccccgttccggttaaccgttccccg

SEQ ID NO: 379811 - DNA, 575 bp, Homo sapiens
  misc_feature: GZ8MTXP01BN598.17.87.H10.1.454.CMB.2.raw
  modified_base (272)..(272): a, c, t, g, unknown or other
  modified_base (288)..(288): a, c, t, g, unknown or other
  modified_base (355)..(355): a, c, t, g, unknown or other
tcagcgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctccgtgtctggtctcctggtcagtcgatcaccatctcctgcactggaagcgcagtgatggttggggtatactgtctctgacacacaccagacaacnccccaatcatccttangaggcactagcgcctcgtagggtttcaatcgcttcgctcggcctcacgtctggcagcacggcctccngacacgtctcgtcgctccgaggctagacggacgaggtctagattagtactgctggtcttcatttacgttacaagttcgtagtactacttattggtttacgttttggggaacggttacggaccgtaaaccgaacgggttacgtaccccgttacgttacgggttccaacggtaccccgaacggtcccgtacccgttaccccgttccgggttcccttaacccg

SEQ ID NO: 379812 - DNA, 649 bp, Homo sapiens
  misc_feature: GZ8MTXP01A6KD1.17.87.H10.1.454.CMB.2.raw
  modified_base (206)..(206): a, c, t, g, unknown or other
  modified_base (224)..(224): a, c, t, g, unknown or other
  modified_base (291)..(291): a, c, t, g, unknown or other
tcagcgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctcgtgtctggtctcctggtcagtcatcacntctctgcacgtggagcgnagtgtagtgggttgggtatacttgtctctagaccaacaccaccagacaacgccccaatcatcttagngaggcagagccgcctgtaggttcatcgcttcgctacggcctcgagtcgcggaacacgccgaccgtccctaccccgtagaacctaacttccgttacggtcgggtccgttaccggacggtcgtacggaacgggaacggtacggtcttaggttacttacttacgtgtctcgggtctactattacgttacgtaacgttccggttgttacctaacgttagttaggtttacggttttaggggccgggtaacgttacccgtaaccgggttaaggtacccggtacccggttaccggaccggttaccgaaccggtacccgtaaccggtcccgtccccggttacccccgttcggttcccttaaccccg

SEQ ID NO: 379813 - DNA, 568 bp, Homo sapiens
  misc_feature: GZ8MTXP01A0I3V.17.87.H10.1.454.CMB.2.raw
  modified_base (292)..(292): a, c, t, g, unknown or other
  modified_base (406)..(406): a, c, t, g, unknown or other
tcagcgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatggttggggttatactgtctctgtacacacaccagacaacgccccaatcatccttangaggcataagccgcctgagggtttacatcgcttcgctcggcctcacgtctcggacacgcaccggccctcccgtagactaatctcgtcgggctccgaggctggaggacgacggtntagtattatcgtgtctcgtctatatacgttacgtacgtcgtacgtactacgttagttaggttacggtttcgggcggtacgaccgtaacggttacggtccgtaccgttcgttacggttcgaacgaccgaacggtcccgtcccggttccccgtcgttccgtccg

SEQ ID NO: 379814 - DNA, 600 bp, Homo sapiens
  misc_feature: GZ8MTXP01ANAZD.17.87.H10.1.454.CMB.2.raw
  modified_base (335)..(335): a, c, t, g, unknown or other
tcagcgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgcctgactcagcctgcctccgtgtctgggtctcctggtcagtcgatcaccatctcctgcactggaagcgcagtgatggttggggttatacttgtctcctggtaccaacaccacccagaacaaacgccccaatcatccttatgaggcactaagcgcctgagggtttcaatcgcttcgntcggctcacgtctggccagccaccgggccctaccctgactactctcgtcgggctcgaggcgtggaggaccgaggtctagtaattatacgtgtcgtgggtctctaattacgttactaacgttcgttgtacttaacgttagttaggttagtttttcgggcgggtaacggccgtaacccggttaagggtacggtacccgttccggttcggttaccgaacgggccccaacggtcctccggttcccccgttccggttaacccgtccccgg

SEQ ID NO: 379815 - DNA, 659 bp, Homo sapiens
  misc_feature: GZ8MTXP01CBPS1.17.87.H10.1.454.CMB.2.raw
  modified_base (516)..(516): a, c, t, g, unknown or other
tcagcgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcatcaccatctcctgcacgtggaagcgcagtgagttggttggggttatacttgtctctgtacacaccaccagacaacgccccaatcatccttagcgacgggcaacgtacgccggtccctacggtacgggtttctaacgtccgtcgttcgtcgtccggcctccgtacgtcgtcggaccacgtccgaccggtcccctacccgtacgaacctaactccgtcgtcgggtcctaccggaggccgtaggaggacggtacgggtctagtacttatacgtcgtcgtcggtacttactacttacgttacgtaacgttccggttnttacctacgttagttgtttaagttttcgggaaccggtacggaccgtaaccgttaacgggttacggtacccgttaccggttcggaccgtaacggaccccgtaacggtcccgttccccgttaccccgttccgttccgtttccccg

SEQ ID NO: 379816 - DNA, 614 bp, Homo sapiens
  misc_feature: GZ8MTXP01AB6TM.17.87.H10.1.454.CMB.2.raw
  modified_base (292)..(292): a, c, t, g, unknown or other
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctctgcactggaagcgcagtgatggttggggtatactgtctcgtgtaccacacaccagacaaacgccccaaatcatccttangaggcacgaacgcggcctgtagggtttcatcgctcgctcggcctcgacgtctagcacgcacggccctctcgactaactctcgtcgggctccgaggccgtaggacggaccgaggtacttcggtaatttacttaacgtcgtactcgggtactaccgtaattaacttaccgtaaagttccgtagttacctacttaagttcgttaacgttttgggaacgggaacgttcgaaacggttacggtaccggtacccgttaccggttacggaccgtaaccggtacccgaacgggtcctcccggttacccccgttcggttcccttaaccccg

SEQ ID NO: 379817 - DNA, 704 bp, Homo sapiens
  misc_feature: GZ8MTXP01CAK3P.17.87.H10.1.454.CMB.2.raw
  modified_base (301)..(301): a, c, t, g, unknown or other
tcagcgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgagttgttggggttataacttgcctctggtaccaacacacccagacaacgacccccaatcatccttangaggcactaagccggcctcgtagggtttctatcgcttcgctcggcctcagtctggactacgcaccggtccctcccgtagaccaattcgtccgtgggccctacgacgggcgtaggacgggaacgggtacgggtaccttagggttaactttaacgttaaccgttcgtaccgtttcggggtaccgtttaccttaaacgtttaactttaaccgttaaacggttccgtttacggtttaccctaacgttttacggtttaacggtttagttttttcgggggaaccgggtacgggttcccgaaaccggttaaccggggttaacgtaccccggttaccggttacggttacccgtaaccggtaccccggaacggtcccgtacccggttcccccgtccgggttcccttccccgg

SEQ ID NO: 379818 - DNA, 584 bp, Homo sapiens
  misc_feature: GZ8MTXP01CW64Q.17.87.H10.1.454.CMB.2.raw
  modified_base (228)..(228): a, c, t, g, unknown or other
  modified_base (297)..(297): a, c, t, g, unknown or other
tcagcgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctcgtgtctggtctcctggtcagtcgatcacatctcctgcacgtggaagcggnagtgattggttggggttatacgttgtctcgtgtaccaacaccaccagaacaacgccccaatcatcttangaggcacgtagccgcctcgtaggttctatcgcttcgctcggctcagtctgacacgcaccggtccctacccgtagaactacttcgtcgtcgggtcctaccggaggtccgaggacggacgaggtctagtaattactctcgtctgtactatattacttacgagtcgtgtactgtagttgttacggtttggaacggtagaccgtaacgttacggtaccgtaccgttcgttacgttaccgaaccgtacccgaacggtcccgtcccgttccccgttcggttaacctttccccg

SEQ ID NO: 379819 - DNA, 588 bp, Homo sapiens
  misc_feature: GZ8MTXP01CCMKZ.17.87.H10.1.454.CMB.2.raw
  modified_base (295)..(295): a, c, t, g, unknown or other
tcagcgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctctgcactggaagcgcagtgagtggttggggttatactgtctctgaccacaccaccagacaaacgccccaaatcatcctttangaggcacgtaagccggcctgtacgggtttctaatcgtctcgctcgcctcacgtctggccagcgacgtccctccctgacactctcgtcgctcgagcgtggaggacgaggctagtattacttactgtcgtcgctactattacttacgtaacgtcgttagttactacttagttagttagttttcggggaacggtacggttaccgtaacccgttaaggtaccggtaccggttaccgttacggttaccgaacggacccgaacggtcccgtcccgttccccgtcggttcccttaacccg

SEQ ID NO: 379820 - DNA, 577 bp, Homo sapiens
  misc_feature: GZ8MTXP01CE0UD.17.87.H10.1.454.CMB.2.raw
  modified_base (292)..(292): a, c, t, g, unknown or other
  modified_base (438)..(438): a, c, t, g, unknown or other
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcgcagtgatggttggggtatactgtctctgtaccaacaccaccagacaacgccccaaatcatcttangaggcacgtaagcgcctagtagggttctatcgcttcgctccggctcgacgtctgggccacgccacccggtccctaccctagaacctaacgtccttcgtcgggtcctccgaggccgtaggaggaccggaggctagtattacttacgngtctggctactatatcaagtcgtgtactattagtgttagtttgggcggtacgcgtaaccgttacggtcgtaccgttaccgttggttaccgaacgacccgaacgtcccgtaccgttccccgttaacggttccttaacccg

SEQ ID NO: 379821 - DNA, 572 bp, Homo sapiens
  misc_feature: GZ8MTXP01DR2CV.17.87.H10.1.454.CMB.2.raw
  modified_base (295)..(295): a, c, t, g, unknown or other
  modified_base (388)..(388): a, c, t, g, unknown or other
tcagcgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctcgtgtctggtctcctggtcagtcgatcacatctctgcactggaagcgcagtgagtggttggggttatacttgtctctgtaccaacaccaccagaacaacgccccaaactcatccttangaggcaactagccgtcctcgtagggtttactagtcgcttcgctcggcctcacgtctggacagcacggccctccagacactctcgtcggctcgngctggagacgagtcgtgtattatactgctcggtctactaattacttacgtaagttcgttagtactacttagttaggttagttttcgggaacggtaggaccacggttaaggtccgtacccgttacgttcggttacgaaccgtacccgaacggtcccgtcccgttccccgtcgttccttaaccccg

SEQ ID NO: 379822 - DNA, 561 bp, Homo sapiens
  misc_feature: GZ8MTXP01EWRNM.17.87.H10.1.454.CMB.2.raw
tcagcgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatggttgggggttataaccttgtctcctggtaccaacaccaccagacaaacgcccccaaactcatccttatgaggcactaagcgccctcgaggggtttcatcgcttcgctcggctcacgtctcggcagcacggccctccctgacaactctctggcctccgaggctggaggacgaggtctagattatactgctggctcatattacagtcgtgtactatatcgtagttttgggcggacgttcaacgttaacggtcgtaacccggttccgttacggttaccaacggacccgaacgggtcctccggttcccccgtccgggttctaaccccg

SEQ ID NO: 379823 - DNA, 556 bp, Homo sapiens
  misc_feature: GZ8MTXP01AOAXE.17.87.H10.1.454.CMB.2.raw
  modified_base (297)..(297): a, c, t, g, unknown or other
tcagcgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcgcagtgatgttggggttatactgtctctgtaccaacaccacccagacaaacgcccccaaatcatccttangaggcactaagccggcctcgaggggtttcatcgcttcgctcggctcgacgtctggcagcacggccctcctgacaatctcgtcgggctccgaggcgtgaggacgagctgattatactgctggctactatacttacaagttcgtgtacctacttagttagttagttttgggcggtacggactaacccgttaaagggtcgtaaccgttccgttacggttccaacgccgaacggtcctccggccccgtcggttaaccgtcccg

SEQ ID NO: 379824 - DNA, 575 bp, Homo sapiens
  misc_feature: GZ8MTXP01AMJDP.17.87.H10.1.454.CMB.2.raw
  modified_base (362)..(362): a, c, t, g, unknown or other
tcagcgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatggttgggggttataaccttgtctcctggtaccaacaccacccagacaaacgcccccaaatcatccttatgaggcacgtaagccggccctcgaggggtttctaagtcgcttcgctcggctcacgtcnggcagccgacggccctcctagacatctcgtggctccgaggctgaggacgaggctagtattacttactgtctggtctctattacttactaagtcgtgtactacttagttgttagttttgggcggtacggcgaaccgaaggtcgtacccggttccgttacggttccgaacggacccgtaacggtcctccggcccccgttcggttccgttaacccg

SEQ ID NO: 379825 - DNA, 641 bp, Homo sapiens
  misc_feature: GZ8MTXP01B1JLA.17.87.H10.1.454.CMB.2.raw
  modified_base (293)..(293): a, c, t, g, unknown or other
tcagcgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctcgtgtctggtctcctggtcagtcgatcaccatctcctgcacgtggaagcgcagtgatggttggggttatacttgtctctgtaccacaccaccagacaacgccccaatcatccttangaggcacgtaacgccgtcctagtagggtttctaatcgcttcgctcggcctcgagtctggaccagccgaccggccctcccgtagaacctaacttccgtcgtcgggtcctaccggacggcgtaggaaggaccggaggtctaggtaacttacgttacgtcgtcgttcgggtcttactacttacgttacgtaacgttcggtacgttactacgttaagttcgttaagttttcgggaacggttacgaccgtaacggttaacgggttaccgtacccggttccgttacggttaccgaaccgaccccggtaacggtcccgtaccccggttcccccgttcgggttaacccttccccgg

SEQ ID NO: 379826 - DNA, 686 bp, Homo sapiens
  misc_feature: GZ8MTXP01AQTSA.17.87.H10.1.454.CMB.2.raw
tcagcgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggtcagtcgatcaccatctcctgcacgtggaagcggcagtgtagttgggttgggggttataccgttgtctctaggtaccaacaccaccacgaacaaacgacccccaaactctactcctttagtgacggcacgtaacggccggtacccgtcgtaggggtttctaagtccgtcttcgcgtcggcctccgacgtcgtggacacgccaccgggtccctcccgacgactactcgtacgcgggctaccgaggctaggaggaacggaggtcttagtattacgtactcgacgtcggtacttctaattaacgttacgtacgttcgttacgttacgtaacgttagtttaggtttacgtttttcggggaacgggtaacggttaccgtaaccggttaacgggttaccggtaaccggttacccggttacgggttacccgaaccggtacccggtaaccggtcccgttaccccgggttccccccttaacgggttccctttaaccccgg

SEQ ID NO: 379827 - DNA, 707 bp, Homo sapiens
  misc_feature: GZ8MTXP01DY9IL.17.87.H10.1.454.CMB.2.raw
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctcgtgtctggtctcctggtcagtcgatcaccatctctgcactggaagcggcagtgagtggttggggttatacttgtctctagtaccaacaccaccagaacaaacgccccaaactcacttaccttatggacggaccaacgtaacggccggtccctacgttagggggtttactaacgttccgtcgttcgcgtcggcctccgacgtctcgggacctagccgaccgggtccccttacccgtacgactaacttcgtccgtcgggccttccgacggtcgtagggaagggaccggtagggtacctaggttaattaacgttacgtcgtcgttcggggtacttacgtaactttaacgtttaccgtaacggttcgttacggttacttaacgttagtttagggttagtttttaggggaacgggtaacggttaccgtaaaccgggttaaacggttaccggtaacccgttaccgttacgggttacccgaaccggaccccgtaacgggtcccgtcccggttaccccgttcggttcccttaaccccg

SEQ ID NO: 379828 - DNA, 609 bp, Homo sapiens
  misc_feature: GZ8MTXP01D0JQF.17.87.H10.1.454.CMB.2.raw
  modified_base (458)..(458): a, c, t, g, unknown or other
  modified_base (509)..(509): a, c, t, g, unknown or other
  modified_base (526)..(526): a, c, t, g, unknown or other
  modified_base (578)..(578): a, c, t, g, unknown or other
tcagcgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctcgtgtctggtctcctggtcagtcgatcaccatctctgcacgtggaagcgcagtgtagttggttaggggttactacgttgtctcgtgtaccaacaccacccagaaccaacgacccccaaatctaactccttatcgaggcaactaggccgtccctagtagggtttactaatcgtcgttcgcgtccggctccgacgtcgtaggacctacggcccgtaccggtcccttacccgtacgaactactcgttacgtccggtctccgaggccgtaggacggacgacggtnttaggtacttactctgtacctggacttactattacgttacgaagttccgtntacgtaattagttgttntttggggaacgtcgacctaacgaggtccgtaccgttcgttcggaccgtaacnccgaacgctcccgacccgttccgttctcccg

SEQ ID NO: 379829 - DNA, 662 bp, Homo sapiens
  misc_feature: GZ8MTXP01ES7NA.17.87.H10.1.454.CMB.2.raw
  modified_base (282)..(282): a, c, t, g, unknown or other
  modified_base (297)..(297): a, c, t, g, unknown or other
tcagcgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctcgtgtctggtctctggtcagtcgatcaccatctcctgcacgtggaagcggcagtgtagtggttaggggttatacgttgtctctgtaccaacaccaccagacaacnccccaatcatcttangaggcacacgccgcctacgtaggttcatcgcttcgctcggctcgacgtctcgcacgccgaccggtccctcccgtagacctaacgtctcggtcggtcctccgacggcgtagggacgggtacggacggtactaggtactttaacgttacgtcgtaccgtcgggtcttacgtaactttacgttaccgttaaacggttcgttacggtaccttaacgtttagttacggttttaggtttttcggggaacgggtaacgggttaccgtaaacccgggttaacgggttaccgtacccggttaccggttcggttacccgtaaccgacccggtaacggtcccgtcccggttccccgttccgttaacccgttccccg

SEQ ID NO: 379830 - DNA, 588 bp, Homo sapiens
  misc_feature: GZ8MTXP01CSTRA.17.87.H10.1.454.CMB.2.raw
  modified_base (227)..(227): a, c, t, g, unknown or other
  modified_base (486)..(486): a, c, t, g, unknown or other
tcagcgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctcgtgtctggtctcctggtcagtcgatcacatctctgcacgtggaagcggnaggtgagttggttaggggttataccttgtctcgtacgtaccaacaccaccagaacaacgccccaaatcattccttatgaggcacgtagccgtcctacgtagggttctactcgtctcgctcgcctcgacgtctggacacgccgaccgtccctaccacgacacttcgtacgtacggctccgacggtcgtacggaagggacgtacggtcttagtacgttattaccgtgtctaggtcttactaattacttcgtaagtccgttntacctattagttagttcgtttgggaacgtagaccgtacgaggtcgtaccgttacgcgttaccgaacgaccgtcgtccgtacccgttcccgtcggttcctccg

SEQ ID NO: 379831 - DNA, 609 bp, Homo sapiens
  misc_feature: GZ8MTXP01CURXO.17.87.H10.1.454.CMB.2.raw
  modified_base (213)..(213): a, c, t, g, unknown or other
  modified_base (393)..(393): a, c, t, g, unknown or other
  modified_base (411)..(411): a, c, t, g, unknown or other
tcagcgtagactagcacgaccggtgctcgatttagcagtactgcgttgggtttggggggggtcacaagaggcagcgctctcgggacgtctccaccatggcctgggctctgctgctcctcactctcctcactcaggacacgagggtcctgggcccagtctgcctgactcagcctgcctcgtgtctggtctcgtggtcagtcgatcactatctcngcacgtaggacgcgactagtgtagttgggttagggttactacgttgtctctacgtaccacacaccagaacaacgaccccaatctacttacttagcgacgacacgtacgcgtcctaggtaggttcatcgtactcgactcggcctacgcgtcgtacggacacgcccgtaccgtccctaccgngaactactcgtcgcgtcncgagcgtagaacggacgcgtatagtaattcgtgtcgtctacgtacctagttacttacgttacgtaagttccgttataccgttaagttggttcgtttacggtttcgggaacgtacgaccgttaacggagtacccgtcgttacggttcgacaaccggtaaccgtcggtaccctccggttcccgtaacgttcgttaacccg

SEQ ID NO: 379832 - DNA, 589 bp, Homo sapiens
  misc_feature: GZ8MTXP01C9PUQ.17.87.H10.1.454.CMB.2.raw
  modified_base (280)..(280): a, c, t, g, unknown or other
  modified_base (347)..(347): a, c, t, g, unknown or other
  modified_base (351)..(351): a, c, t, g, unknown or other
  modified_base (367)..(367): a, c, t, g, unknown or other
  modified_base (374)..(374): a, c, t, g, unknown or other
  modified_base (380)..(380): a, c, t, g, unknown or other
tcagcgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctcgtgtctggtctcctggtcagtcgatcaccatctctgcacgtggaagcggcagtgagttggttagggggttaactaacgttgtctctgtaccaacaccaccanacaaacgccccaactcattccttatcgaggcactagcgcctcgtagggttctatcgctgctcgctcngtcngcagcacgccctccgngacatcncgcgcncgagcgtgacggacgtagctagattaagtctgtctggtacttctaacgttattacgtaacggttcgttagtaccgtaacgttaagtttcggtttagttttaccgggaaccggtaacggttaccgtaaacggttacggttaccgtaccggttaacgttcgttaccgtaacgacccgtaagtccgtcccgttcccgtccgttccgttcccg

SEQ ID NO: 379833 - DNA, 516 bp, Homo sapiens
  misc_feature: GZ8MTXP01ECQ96.17.87.H10.1.454.CMB.2.raw
  modified_base (442)..(442): a, c, t, g, unknown or other
  modified_base (449)..(449): a, c, t, g, unknown or other
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcgcagtgatggttgggggttataaccttgtctctggtaccaacaccacccagacaaacgcccccaaactcatcctttatgagggcactaagcggcctcgtagggtttctaatcgcttcgctcggctcacgtctggacagcacggcctccctgacaatctctaggctcaggctgagacgagctgacttatactgctggctctatatcaagtcgtgtcnctatgtntttggcgtgcacaggtcgaacgttcttaggttcaacgtccaacgtcgcttccccgtcggttcctccg

SEQ ID NO: 379834 - DNA, 585 bp, Homo sapiens
  misc_feature: GZ8MTXP01CXTDH.17.87.H10.1.454.CMB.2.raw
  modified_base (226)..(226): a, c, t, g, unknown or other
  modified_base (298)..(298): a, c, t, g, unknown or other
  modified_base (352)..(352): a, c, t, g, unknown or other
  modified_base (413)..(413): a, c, t, g, unknown or other
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctggtctcctggtcagtcgatcacatctcctgcactggaagcgnagtgattggttgggttactacttgtctcgtgtaaccacaccgaccagacaacgtccccaaatctatccttangaggcactagccgcctagtaggttcaagtcgtcttcgctcgcctcgtagttcgnggaccaacgccgtaaccggtccctccgttagaaccttacgtcttcgcggtcaccgaggcgngagacgacgtacgtagtattactacgtcgtcgtcgtactactattacgtacgtacgtacgtacgtacgtacttagttagttacgttcggtaacggtacgacgtacgttacgtacgtacgttacgttcgttacgaacgaccgtaacgtccgtccgttcccgtccgttcgtccg

SEQ ID NO: 379835 - DNA, 662 bp, Homo sapiens
  misc_feature: GZ8MTXP01B95NT.17.87.H10.1.454.CMB.2.raw
  modified_base (413)..(413): a, c, t, g, unknown or other
tcagcgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctcgtgtctggtctcctggtcagtcgatcaccatctctgcacgtggaagcgcagtgagttggttggggttataccgttgtctacgtgtaccaacaccacccagaaccaaacgaccccctaaatctacttccttagtgacggacacgttaacgccggtccctacggtacgggtttctaacgtcgtcttcgccgttcggcctaccgacgtcgtgaccaacgcgtaccggccctcccgtanactaacgtcgtcgtcgggcctccggtaggcgtagggacgggaaccgtagggtaccgttagtaactttacgttacgttggaaccttcggggtaccttaacgtaactttacgttaccgtaaaggttccgttagttactacgttagttagttaggttttcgggaacggtcggaccgtaacgttacgggtacgtcgttaccgttacgttccgaacgtccgaacggtccctaccggttcccgtcgaacttcccg

SEQ ID NO: 379836 - DNA, 618 bp, Homo sapiens
  misc_feature: GZ8MTXP01DMKH7.17.87.H10.1.454.CMB.2.raw
  modified_base (296)..(296): a, c, t, g, unknown or other
  modified_base (352)..(352): a, c, t, g, unknown or other
tcagcgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctgtcagtcgatcacatctcctgcactggaagcggcagtgatggttggggttaataccttgtcctctgtaccacaccaccagacaacgaccccaatcatcttangagcactacgcgcctgtaggttctatcgtctcgcgtcggcctcgacgtcgtcgacncgccgtaccggtcccctacccgacgaactaactccgttccgcggggtccttcccgagggtcctagggaggaaccggagtcgtagtaattacttactgtccttgtacttactaattacgtacgtaacgttcgtacgtactaacgttagttagtttaggtttcgggaacggtaacgaccgtaacggttaacggtaccgtaaccggttaccgttacggaccgaaccggacccgtaacggtccctcccgttccccgttcgttaacctccg

SEQ ID NO: 379837 - DNA, 619 bp, Homo sapiens
  misc_feature: GZ8MTXP01CMDBP.17.87.H10.1.454.CMB.2.raw
  modified_base (296)..(296): a, c, t, g, unknown or other
  modified_base (341)..(341): a, c, t, g, unknown or other
  modified_base (345)..(345): a, c, t, g, unknown or other
  modified_base (435)..(435): a, c, t, g, unknown or other
tcagcgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctccgtgtctggtctcctggtcagtcatcacatctctgcacgtggaagcggcagtgagttggttaggggttatacttgtctctcgacacaccaccagacaacgccccaatctactcttagngaggacacgtacgcgcctcgtaggttctagtcgctcgctcgctcncgtnggactcgcaccggtccctcctagacacgttctcgtcgggtcctaccgaggcgtaggacgggacgtagggtcttagtaactttaacttcgngtcccttaggactttacgtaaactttaacgttaccgtaaaggttccgttacgttacctacttagttggtttaacgtttgggaaccggtaggaacccgtaccgggaaggttaccgtccggttaccgttacggttacccgaacggccgtaacggcccgttaccgcccccgttcgttaaccttcccg

SEQ ID NO: 379838 - DNA, 578 bp, Homo sapiens
  misc_feature: GZ8MTXP01AN66J.17.87.H10.1.454.CMB.2.raw
  modified_base (301)..(301): a, c, t, g, unknown or other
  modified_base (354)..(354): a, c, t, g, unknown or other
tcagcgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtccagtcgatcaccatctcctgcactggaagcggcagtgatggttggggttataccgttgtctcgtgtaccaacaccaccagacaacgccccaaatcatccttangaggcactaagccgcctcgagggtttcatcgtcttcgctcggctcgacgtcgngcagccgacggccctccctgactatcgtcgtcgggctccgacggctagggacggaccggaggtctggtattacgttactcgtctgggtcctactattacttacgtaagttcggtcgttacctacgttagttgttaaggttttgggaacggacggttacaccggttaaggtccgtacgttccgttaggccaacgcccgaacgtccgtcgcccctcggttcctccg

SEQ ID NO: 379839 - DNA, 626 bp, Homo sapiens
  misc_feature: GZ8MTXP01D12KI.17.87.H10.1.454.CMB.2.raw
  modified_base (277)..(277): a, c, t, g, unknown or other
  modified_base (283)..(283): a, c, t, g, unknown or other
  modified_base (285)..(285): a, c, t, g, unknown or other
tcagcgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctcgtgtctggtctcgtggtcagtcatcacatctcctgcactggaacgcgcagtgagtggttgggttatactgctcagtacacacaccagacaacgccaatnatctangngcacagcgctgtaggtctagctctcgcgtcgctcgacgtcgtacgacacgtccgaccggtccctaccgtagactactccgtcgtcggctacgacggtcgtcggaacgggtacgtacgtacgttagtaacttacgttcgtgtcttcgggtaccttagttaaccgttattaccgtaacgttcgttacgtacttaacgttagttacggtttaaggtttcgggaacccggttaggaccgtaaaccgttacgggttaccgtaccgggttaccgttaggttacccgaacggaacccggtaaccgggttccccgtcccggttaccccgttccgttaaccgttaacccg

SEQ ID NO: 379840 - DNA, 656 bp, Homo sapiens
  misc_feature: GZ8MTXP01EX6B8.17.87.H10.1.454.CMB.2.raw
  modified_base (230)..(230): a, c, t, g, unknown or other
  modified_base (312)..(312): a, c, t, g, unknown or other
  modified_base (391)..(391): a, c, t, g, unknown or other
  modified_base (425)..(425): a, c, t, g, unknown or other
  modified_base (447)..(447): a, c, t, g, unknown or other
tcagcgtagactagcacgaccggtgctcgatttagcagtactgcgttgggtttgggggggggtcacaagaggcagcgctctcgggacgtctccaccatggcctgggctctgctgctcctcactctcctcactcaggacacagggtcctgggcccagtctgccctgactcagcctgcctcgtgtctgggtctccgtggtcagtcgatcaccatctcctgcagtggaagcgnagtgagttgggttaggggttactacttgtctccgtagtaaccacacccaccagaaccaaaccgccccaatctactctttagngacggactacgtaacggcgtccctaggtacgggttttacagttcgcgttcgcgtcggcctcgacgttcgacgcacgccnccggtccctacgacgaactcgtcgtcgtcggtcncggaggtcgtaggacgaacggngtcgtagtaattcgtactgtactggtacttatacttacgtcgtaacggttcgttacgttactacgttagttaggtttacggtttcggggaacggtacggttacgtaaccggttaacggggtcgtaacccggttacggttacggaccgtaaccggtcccggtaaccggtccccgttacccggttccccgttcggttaacccgtttccccg

SEQ ID NO: 379841 - DNA, 539 bp, Homo sapiens
  misc_feature: GZ8MTXP01EGL2G.17.87.H10.1.454.CMB.2.raw
  modified_base (395)..(395): a, c, t, g, unknown or other
tcagcgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcgcagtgatggttgggggttataaccttgtctcctggtaccaacaccacccagacaaagcccccaaatcatcctttatgagggcagtaagccggaccctcgaggggtttctaaatcgcttcgctcggctcacgtctggcagctacggcctccctgacatctctggctcngctgaggtacgaggctgattatactgctggctcattatcaagtcgtgtcattatgtagttttggaacgcggttacaccgaggtcgaaccgttccgttacgggttcaacgccgtaacgccgtcgttcccctcggttcctaacccg

SEQ ID NO: 379842 - DNA, 720 bp, Homo sapiens
  misc_feature: GZ8MTXP01CA43D.17.87.H10.1.454.CMB.2.raw
  modified_base (447)..(447): a, c, t, g, unknown or other
tcagcgtagactagcacgaccggtgctcgatttagcagtactgcgttgggtttgggggggggtcataagaggcagcgctctcgggacgtctccaccatggcctgggctctgctgctcctcactctcctcactcaggacacagggtcctgggcccagtctgccctgactcagcctgcctcgtgtctggtctccgtggtcagtcgatccacctattcctcctgccacgtgggaacgcggactagtggtagttcggggtttaggggttaactaccgttcgtcctccgtacggtaacccaaccacccaacccgaacgaacccaaaccgtacccccctaaagtcctaacgtttcctttaagacggacgggtaccaaccgtaacggcccggtacccgttaggttacggggtttctaacgtccgtcgttcgcgttccggacctaccgacgtcgnggtaccacgcgaccgtccctacctagaactacgtcacggtcgcctaccggaggcgtaggacggacgtacggtcttagtaacttacgttgtcggtactcggtacttaacggtacttaccgttagaaccgttcgttagtaccttaaggtgtttacggttcggtttacgggggcgtaacggttccgtaaacgttacgggtcgacccggttaacggttcgttaccgaacggtacccgtcgtcccgtaccccgttcccgttaacggttccttccccgg

SEQ ID NO: 379843 - DNA, 569 bp, Homo sapiens
  misc_feature: GZ8MTXP01EFCYD.17.87.H10.1.454.CMB.2.raw
  modified_base (227)..(227): a, c, t, g, unknown or other
  modified_base (369)..(369): a, c, t, g, unknown or other
  modified_base (414)..(414): a, c, t, g, unknown or other
  modified_base (426)..(426): a, c, t, g, unknown or other
  modified_base (445)..(445): a, c, t, g, unknown or other
  modified_base (448)..(448): a, c, t, g, unknown or other
tcagcgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctcgtgtctgggtctcctggtcagtcatcaccatctcctgcactggaagcgnagtgattgggttaggggttactaacgttgtctctggtaccaacaccaccagaacaaacgacccccaaatcgtactcctttagcgaggtacagtaacgccggtccctgtaagggtttcaagtcgcttcgctcggctcgagtcncggacagcaccggccttcccagacctagtctcgtcggctcgagcnggacggtaacgnggtctagtattattacgtntcncgtctatatactacgtagtcgtactactactattagttcgttggtcggtacgacgtacgacgtacgtaccgttacgttacgacgaacgacgtaaccgccgtccgttcccgtccgttcgtcg

SEQ ID NO: 379844 - DNA, 534 bp, Homo sapiens
  misc_feature: GZ8MTXP02JG0GP.17.87.H10.1.454.CMB.2.raw
  modified_base (350)..(350): a, c, t, g, unknown or other
  modified_base (442)..(442): a, c, t, g, unknown or other
tcagcgtagactagcacgaccggtgctcgatttagcagtactgcgttgggtttgggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgattggttggggttataaccttgtctctgtaccaacaccaccagacaaacgccccaatcatccttatgaggcacgtagcgcctgagggtttcaatcgtcttcgctcggctccgacgtcgnggcacgccgaccgcctccgtagactactctcgtcgtctacgagcgagaggacgcgacgtagtattactctgctgactctatatacagtcgtntactatagtgtagtttcggacgtcgactacgaggtacgtaccgtcgtaacgtcgaacgacccgtaacggtcctccgtcccgtcggcttcccg

SEQ ID NO: 379845 - DNA, 511 bp, Homo sapiens
  misc_feature: GZ8MTXP02GGO0M.17.87.H10.1.454.CMB.2.raw
tcagcgtagactagcacgaccggtgctcgatttagcagtactgcgttgggtttggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttggggttataaccttgtctctggtaccaacaccacccagacaaacgcccccaaaactcatccttatgaggcactaagcggccctcaggggtttctaatcgcttcgctggctccacgtctggcagcacggcctcctgaccaatctctgggctccaggctgaggacgaggctagattatactgctgctcatattcaagtcgtgtcactatgtagttttggcggtagcacgaaaggtcgaccgtctagtcaagcccaaggctcgcccctcggtctacc

SEQ ID NO: 379846 - DNA, 499 bp, Homo sapiens
  misc_feature: GZ8MTXP02I89WE.17.87.H10.1.454.CMB.2.raw
tcagcgtagactagcacgaccggtgctcgatttagcagtactgcgttgggtttgggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttggggttataacctgtctctggtaccaacaccaccagacaaagcccccaaatcatcctttatgaggcactaagcggccctcaggggtttcaatcgcttcgctggctccacgtctggcagcacggctccctgacaatctctggctccagctgagacgaggctgatattactgctgctcatatcaagtcgtgtcactatgtattttggcggtagcaccaaaggtcaccgtccttagcaagcccaaggctcgccccgtcgtctaccg

SEQ ID NO: 379847 - DNA, 511 bp, Homo sapiens
  misc_feature: GZ8MTXP02HAZG9.17.87.H10.1.454.CMB.2.raw
  modified_base (317)..(317): a, c, t, g, unknown or other
  modified_base (491)..(491): a, c, t, g, unknown or other
tcagcgtagactagcacgaccggtgctcgatttagcagtactgcgttgggtttgggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttggggttataaccttgtctcctggtaccaacaccacccagacaaagcccccaaatcatccttatgaggcactaagcgccctnaggggtttcaatcgcttcgctggctccacgtctggcagcacggcctccctgacaatctctgggctcccgagctgagacgaggctgattatactgctgctcatatcaagtcgtgtcatatgtattttggacggtaggcaccgaaggtcgtaccgtcgtagtcaagcccaaggtcncgtccccgtcggtcctaccg

SEQ ID NO: 379848 - DNA, 526 bp, Homo sapiens
  misc_feature: GZ8MTXP02HREVW.17.87.H10.1.454.CMB.2.raw
  modified_base (320)..(320): a, c, t, g, unknown or other
tcagcgtagactagcacgaccggtgctcgatttagcagtactgcgttgggtttggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttggggttataaccttgtctcctggtaccaacaccacccagacaaacgcccccaaactcatccttatgaggcactaagcggcctnaggggtttctaatcgcttcgctcggctccacgtctggcagcacggcctcctgacaatctctggctccagctgagacgaggctgattatactgctgctcatattcaagtcgtagtcactatgtattttggacggtaggtcaccgtaaaggtcgtaccgtccgtacggtcaacgacccgaaggtcctcgtcccccgtcggtctacccg

SEQ ID NO: 379849 - DNA, 515 bp, Homo sapiens
  misc_feature: GZ8MTXP02GWYN6.17.87.H10.1.454.CMB.2.raw
tcagcgtagactagcacgaccggtgctcgatttagcagtactgcgttgggtttgggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttggggttataaccttgtctcctggtaccaacaccacccagacaaagcccccaaactcatcctttatgaggcactaagcggccctcaggggtttctaatcgcttcgctcggctccacgtctggcagcacggcctccctgacaatctctgggctccagctgagacgaggctgattatactgctgctcatattcaagtcgtgtcactatgtagtttttggcggaggtcacctaaaggtcgaccgtcctaggtcaagcccaaggcctcgccccctcggtctacc

SEQ ID NO: 379850 - DNA, 507 bp, Homo sapiens
  misc_feature: GZ8MTXP02JO57U.17.87.H10.1.454.CMB.2.raw
  modified_base (441)..(441): a, c, t, g, unknown or other
  modified_base (490)..(490): a, c, t, g, unknown or other
tcagcgtagactagcacgaccggtgctcgatttagcagtactgcgttgggtttggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttggggttataaccttgtctcctggtaccaacaccacccagacaaagcccccaaactcatccttatgaggcactaagcggccctcaggggtttctaatcgcttcgctcggctccacgtctggcagcacggcctccctgacatctctgggctcgagctgagacgaggctgattattactgctgctcattattcaagtcgtgtcactntgtatttggcgagtcacgtaagtcgaccgtctagtcaagcccaaggccngccccctcggtctaccg

SEQ ID NO: 379851 - DNA, 629 bp, Homo sapiens
  misc_feature: GZ8MTXP02HA5Z0.17.87.H10.1.454.CMB.2.raw
tcagcgtagactagcacgaccggtgctcgatttagcagtactgcgttgggtttggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatggttggggttataaccttgtctcctggtaccaacaccacccagacaaacgcccccaaatcatccttatgaggcactagccgccctgtagggtttctaatcgtctcgctcggctccacgtctggcagccgacggcctcctgacatctcgtcggctccgagctggacggacgacggctagtacttattacgtcgtctcgcttactattacgttactaaacggttcggttcgttactaacttaagttcggtttaaggtttttcgggacggggtaacggtcccgtaaaacccggtaagggttaccggtacccggttacccgtaacggggttacctaaccgggacccccgtaaagggtccccgtacccggtaccccccgttccgggttaaccttccccgg

SEQ ID NO: 379852 - DNA, 530 bp, Homo sapiens
  misc_feature: GZ8MTXP02HMLVG.17.87.H10.1.454.CMB.2.raw
  modified_base (378)..(378): a, c, t, g, unknown or other
  modified_base (422)..(422): a, c, t, g, unknown or other
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttggggttataacttgtctctggtaccacaccacccagacaaagcccccaaactcatcctttatgaggcactaagcgccctcaggggttctaatcgcttcgctcggctccacgtctgcagcaccgcctccctgacatctcgnggctcagctgaggacgaggctgtattatactgctgctcatatanaagtcgtgtactattatgttagttttcggcggacgccaacgacggtacgacccgttacgtacggtaccaacggacccaacggcctccgcccccgtcggtacctacccg

SEQ ID NO: 379853 - DNA, 597 bp, Homo sapiens
  misc_feature: GZ8MTXP02JUPKB.17.87.H10.1.454.CMB.2.raw
  modified_base (302)..(302): a, c, t, g, unknown or other
  modified_base (371)..(371): a, c, t, g, unknown or other
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcggtgagtggttggggttataaccttgtatcctggtaccacaccaccagacaaacgccccaaactcatccttangaggcactaagcggccctcgtaggggtttctaatcgtcttcgcgtcggccctccacgtctggcacgccnccggccctccctgaccatcctcgtcgggcctccgaggcgtggacgggacgaggcgtgtattattactgctgcttcattacttacgtaagttcgtcgtactacttagtgttagttttcggcgggtacggaccgtaccgtaacggtacggacccggtacccgacgggttacccgacgtaaccccgaacggtacccgttccgacccccgtccggtcctacgtttccccg

SEQ ID NO: 379854 - DNA, 515 bp, Homo sapiens
  misc_feature: GZ8MTXP02I1Z48.17.87.H10.1.454.CMB.2.raw
  modified_base (320)..(320): a, c, t, g, unknown or other
  modified_base (418)..(418): a, c, t, g, unknown or other
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatggttggggttataaccttgtctcctggtaccaacaccaccagacaaagcccccaaactcatccttatgaggcactaagcgccctnaggggtttctaatcgcttcgctcggctccacgtctggcagcacggcctccctgacaatctctgggctccagctgagacgagctgatatactgctgctnatattcaagtcgtgtcactatgtattttggacggtagtcacgaaggtcgaccgtacctaggtcaacgcccgaaggctacgcccccgtcggtctaccg

SEQ ID NO: 379855 - DNA, 528 bp, Homo sapiens
  misc_feature: GZ8MTXP02GVAJV.17.87.H10.1.454.CMB.2.raw
  modified_base (379)..(379): a, c, t, g, unknown or other
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttggggttataacttgtctcctggtaccaacaccacccagacaaagcccccaaactcatcctttatgaggcactaagcggccctcgaggggtttctaatcgcttcgctcggctccacgtctggcagcacgcctcctgacatcnctggctccgagctgagacgaggctgattattactgctgctcattattcaagttcgtgtcacttatgtagttttggcggtagcaccgtaaggtcgaccgttaccgtaggtcaacgacccgaacggtcctccggcccctcggtactacccg

SEQ ID NO: 379856 - DNA, 547 bp, Homo sapiens
  misc_feature: GZ8MTXP02IU79G.17.87.H10.1.454.CMB.2.raw
tcagcgtagactagcacgaccggtgctcgatttagcagtactgcgttgggtttggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatggttggggttataaccttgtctcctggtaccaacaccaccagacaaacgcccccaaatcatccttatgaggcactaagcggccctcgaggggtttctaatcgcttcgctcggctccacgtctggcagcacgcctcctgacaatctctggctccgagctggaggacgaggctagattattactgctgctcattatcaagtcgtgtactactattgtattttcgggacggtacggcgaaccgtaaaggtcgtaccgtaccgtacggtccgaacgcccgaaacggccctaccgccccccgtcggtacccttacccg

SEQ ID NO: 379857 - DNA, 659 bp, Homo sapiens
  misc_feature: GZ8MTXP02H611E.17.87.H10.1.454.CMB.2.raw
  modified_base (295)..(295): a, c, t, g, unknown or other
tcagcgtagactagcacgaccggtgctcgatttagcagtactgcgttgggtttggggggtcacaagaggcagcgctctcgggacgtctccaccatggcctgggctctgctgctcctcactctcctcactcaggacacagggtcctgggcccagtctgccctgactcagcctgcctccgtgtctgggtctctggtcagtcgatcaccatctcctgcactggaagcggcagtgatggttggggtatactgtctctgtaccaacaccaccagacaaacgccccaaactcatcctttangaggcaactaagccggcctcgtaggggtttacaagtcgtacttcgctcggctccacgtctggcagcaccggcctccctagacctactctcgtcggggctcccgaggcgtacggagggaacggtacggtacgtagtaaactttatttaacgtggtccttcggtaccttaccttaatttaactttaccgtaaaacggtttccggttagttaccgtaaactttaacgttggtttaaaggttttttcggggacgggttaacgggtaccgtaacccggtaaaagggttcggtaacccggttaccgttacggttaccgaacggtacccgaaacggtcccgtaccggtcccccgttacggttccttacccg

SEQ ID NO: 379858 - DNA, 513 bp, Homo sapiens
  misc_feature: GZ8MTXP02HBW3U.17.87.H10.1.454.CMB.2.raw
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttggggttataaccttgtctcctgtaccaacaccaccagacaaacgcccccaaatcatccttatgaggcactaagcgcctcgagggtttcaatcgcttcgctcggctccacgtctggcagcacgcctccctgacatctctggctccagctgagacgaggctgattattactgctgctcatatacaagtcgtgtacactatgtattttgggacggacgtcaaccgaaggtcgaccgtccgtagtcaacgccaacggcctccgccccctcggtactccg

SEQ ID NO: 379859 - DNA, 522 bp, Homo sapiens
  misc_feature: GZ8MTXP02GAWMG.17.87.H10.1.454.CMB.2.raw
  modified_base (406)..(406): a, c, t, g, unknown or other
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatggttggggttataaccttgtctcctggtaccaacaccacccagacaaacgcccccaaatcatccttatgaggcactaagccgcctcgaggggtttctaatcgcttcgctcggcctccacgtctggcagccaccggcctccgtgacatctcgtggctccgagctgaggacgnggctagtattatctgctgtctcatattacaagtcgtgtcactatgtagtttggcggtagcgacgtaggtcgtaccgtcgtacggtcaacgccaggcctacgccccgtcggtctccg

SEQ ID NO: 379860 - DNA, 538 bp, Homo sapiens
  misc_feature: GZ8MTXP02G84ST.17.87.H10.1.454.CMB.2.raw
  modified_base (300)..(300): a, c, t, g, unknown or other
  modified_base (423)..(423): a, c, t, g, unknown or other
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcacatctcctgcactggaagcggcagtgatggttggggttataaccttgtctcctggtaccaacaccaccagacaaacgcccccaatcatccttangaggcactagcgcctgtagggttcaatcgcttcgctcggcctccacgtctggcagccgacgccctccctagacaatctcgtggcctcgagctggaggacgaggctagtattatactgctgctnatatacaagtcgtagtctacttagtgttagtttgggcggtacgcacgtaaaggtcgtaccgtcgtacggtcgaaccgacccgaacggtcctccgtcccccgtcggtacctacccg

SEQ ID NO: 379861 - DNA, 562 bp, Homo sapiens
  misc_feature: GZ8MTXP02G7ORH.17.87.H10.1.454.CMB.2.raw
  modified_base (401)..(401): a, c, t, g, unknown or other
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatggttggggttataacttgtctctgtaccaacaccaccagacaaacgcccccaaatcatccttatgaggcactaagccggccctcgtaggggtttcaagtcgtctcgctcggctccacgtctggcagcaccgcctcctgacatctcgtggctcgagcgtgaggacgnggctagtattatactgctgctctattatactaagtcgtgtactactattgttagttttgggacggtacggacctaaccgtaggtacgtacccggttaccgtacgggttaccgaaccggtacccgaacggtccctaccggtccccccgtcggtaccttcccg

SEQ ID NO: 379862 - DNA, 553 bp, Homo sapiens
  misc_feature: GZ8MTXP02GN8C2.17.87.H10.1.454.CMB.2.raw
  modified_base (412)..(412): a, c, t, g, unknown or other
tcagcgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatggttggggttatacttgtctctggtaccaacaccacccagacaaacgcccccaaactcatccttatgaggcactaagcgcctcgtaggggtttctaatcgtcttcgctcggctccacgtctggcagccaccggccctccctgactaactctcgtggcctccgaggcgtgaggacgnggctgtattagtactgctgctctatacttacaagtcgtgtctacttatgttagttttcggacggtacggacaaccgaaggtcgtaccgtaccgtaggtccaacggcccgaacggtcctccgtcccccgtcggtacctcccg

SEQ ID NO: 379863 - DNA, 525 bp, Homo sapiens
  misc_feature: GZ8MTXP02G7MMV.17.87.H10.1.454.CMB.2.raw
  modified_base (290)..(290): a, c, t, g, unknown or other
  modified_base (380)..(380): a, c, t, g, unknown or other
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatggttggggtataaccttgtctctggtaccaacaccaccagacaaacgccccaaancatccttatgaggcactaagcggcctcgagggtttctaatcgtctcgctcggctccacgtctggcagccacggcctccctgacaatctcnggctccgagctgagacgaggctagtattatactgctgctcatatacaagtcgtatcatatgtagtttggacgtagacaccgaaaggtcgaccgtccgtaaggtcaacgacccgaaacggcctccgcccccgtcggtacctacccg

SEQ ID NO: 379864 - DNA, 545 bp, Homo sapiens
  misc_feature: GZ8MTXP02I1681.17.87.H10.1.454.CMB.2.raw
tcagcgtagactagcacgaccggtgctcgatttagcagtactgcgttgggtttggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttggggttataaccttgtctctggtaccaacaccaccagacaaacgcccccaaactcatccttatgaggcactaagcggccctcgtagggtttctaatcgcttcgctcggcctccacgtctggcagccacggccctcctgacatctctggctccagctgagacgaggctgattattactgcttgcttacattagttcaagttcgtgtctacttatgtagtttttcggcggtaggtccgaaccgtaggtacgtacccgtccgtacggtacaacggccccaacggcctccgtcccccgtacggtcctacccg

SEQ ID NO: 379865 - DNA, 546 bp, Homo sapiens
  misc_feature: GZ8MTXP02JYZGI.17.87.H10.1.454.CMB.2.raw
  modified_base (416)..(416): a, c, t, g, unknown or other
  modified_base (423)..(423): a, c, t, g, unknown or other
  modified_base (425)..(425): a, c, t, g, unknown or other
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttggggttataaccttgtctcctggtaccaacaccacccagacaaacgcccccaaactcatccttatgaggcactaagcggccctcaggggtttctaatcgcttcgctggctcacgtctgcagcacggcctccctgacaatctctgggctccaggctggaggacgaggctgattattacngcttgcncntatactacgtcgtgtactactagttagttagtttggtcggacgacgaccgtaacggtacggtaccgtaccgtacgtacgaaccgacccgaccggccgtcccgtccccgtccgtaccgtccg

SEQ ID NO: 379866 - DNA, 515 bp, Homo sapiens
  misc_feature: GZ8MTXP02JWPYW.17.87.H10.1.454.CMB.2.raw
  modified_base (319)..(319): a, c, t, g, unknown or other
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttggggttataaccttgtctcctggtaccaacaccaccagacaaagcccccaaatcatccttatgaggcactaagcggccctnaggggtttcaatcgcttcgctcggctccacgtctggcagcacggcctcctgacatctctggctccagctgagacgaggctgattagttactgctgctcatattcaagtcgtgtcactatgtagttttggcggtaggcaccgtaaaggtcgtaccgtctaggtcaacgcccgaaggtcctcgccccctcggctcccg

SEQ ID NO: 379867 - DNA, 620 bp, Homo sapiens
  misc_feature: GZ8MTXP02JR3X3.17.87.H10.1.454.CMB.2.raw
  modified_base (298)..(298): a, c, t, g, unknown or other
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatggttggggttataacttgtctcctggtaccaacaccaccagacaacgccccaatcatccttangaggcactagcgcctcgtagggtttcaatcgcttcgctcggctccacgtctcggcacgccgaccggtccctcccgtagacctaactctcgtcggggctccgaggctggacgggacgaggctagtacttatacgtgctgctacattacgttacgaacgttcgtcgtactacttaagttggtttagttttacgggacgggtacgtaccgtaaaccggtaagggttaccggtaacccgttaccgttacgggtaacctaaccgggaacccccgtaaacgggtccccgtacccggtacccccccgtttagggtcccctttaacccgg

SEQ ID NO: 379868 - DNA, 506 bp, Homo sapiens
  misc_feature: GZ8MTXP02GBNJJ.17.87.H10.1.454.CMB.2.raw
  modified_base (378)..(378): a, c, t, g, unknown or other
  modified_base (397)..(397): a, c, t, g, unknown or other
  modified_base (401)..(401): a, c, t, g, unknown or other
  modified_base (413)..(413): a, c, t, g, unknown or other
  modified_base (418)..(418): a, c, t, g, unknown or other
  modified_base (433)..(433): a, c, t, g, unknown or other
tcagcgtagactagcacgaccggtgctcgatttagcagtactgcgttgggtttgggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttggggttataaccttgtctcctggtaccaacaccacccagacaaacgcccccaaatcatccttatgaggcactaagcggccctgaggggtttctaatcgcttcgctcggctccagtctggcagcacggcctcctgacaatctntggctccagctgagacggngctntattatactgtntgctntatatacacgtcgtntctatatgtagtttggcgagacacgagtcgtaccgtcgtagtcaacgaccgacgctccgcccgtcgtactacg

SEQ ID NO: 379869 - DNA, 594 bp, Homo sapiens
  misc_feature: GZ8MTXP02JV4WX.17.87.H10.1.454.CMB.2.raw
  modified_base (302)..(302): a, c, t, g, unknown or other
  modified_base (350)..(350): a, c, t, g, unknown or other
  modified_base (442)..(442): a, c, t, g, unknown or other
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttggggtataaccttgtctctggtaccaacaccacccagacaaacgcccccaaactcatcctttangaggcaactaagcggccctcgtaggggtttcaatcgcttcgctcggcnccacgtctggcagcacggcctccctagactaactctcgtcgggctcccgagctggaggacgaggctagattattactgctgctcattattanaacgttcgtagttactacttaagttgttagttttcgggacggtacggaccgtaacccgtagggtaccgtacccgttaccgttaacgggttccaaccggaccccgtaaacggtcccgtaccggtacccccccgttcggttaacccttacccgg

SEQ ID NO: 379870 - DNA, 612 bp, Homo sapiens
  misc_feature: GZ8MTXP02JM21B.17.87.H10.1.454.CMB.2.raw
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgagttggttggggttataaccttgtctcctggtaccaacaccaccagacaaacgcccccaaactcatccttatgaggcactagcgcctcgagggtttcaatcgcttcgctcggctccacgtctggcacgcaccggcctcccgtgacactctcgtgggcctccgaggctggacggacgacggctagtattattactgctagtctactattacttacaacgttcgtacgttactacgttagttagttagtttttcgggacgggtacggtaccgtaaaccggtaaacgggttaccgtaacccggttaccgttaacggtaccgaaccggtaccccgaaaccgggtccgtacccggtaccccccgttcgggtacccttaaccccg

SEQ ID NO: 379871 - DNA, 578 bp, Homo sapiens
  misc_feature: GZ8MTXP02HR0QZ.17.87.H10.1.454.CMB.2.raw
  modified_base (229)..(229): a, c, t, g, unknown or other
  modified_base (298)..(298): a, c, t, g, unknown or other
  modified_base (373)..(373): a, c, t, g, unknown or other
  modified_base (386)..(386): a, c, t, g, unknown or other
  modified_base (419)..(419): a, c, t, g, unknown or other
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggnagtgatggttggggttataccttgtctctgtaccaacaccaccagacaaacgccccaactcatccttangaggcactagccgtcctcgtagggtttcatcgtctcgctggctccacgtctgcagcacgcctcctgactatctcnggcctccgagtcnggaggacgaggctagtaattattactgtccttntcttatattacgttactaacgttcgtacgtactacttagttgtttaggtttcgggacggtacggtaccgtaaacggtaacggttacgtacccggttacgtacggtaccgtaaccgacccgtacggtccctacccgtcccccgttacggttaccctaccg

SEQ ID NO: 379872 - DNA, 545 bp, Homo sapiens
  misc_feature: GZ8MTXP02JEVHK.17.87.H10.1.454.CMB.2.raw
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatggttggggttataaccttgtctcctggtaccaacgaccacccagacaaacgcccccaaatcatccttatgaggcactaagcggccctcgaggggtttctaagtcgcttcgctcggctccacgtctggccagcacggcctccctgacaatctctgggcctccaggctgaggacgaggctgattatactggctagctcattacttacaagtcgtagtcactattgtagttttggcggtacggcaccgaaaggtcgaccgttaccgaggttcgaacgcccgaacggccgtccgcccccgtacggtcctacccg

SEQ ID NO: 379873 - DNA, 551 bp, Homo sapiens
  misc_feature: GZ8MTXP02GPY58.17.87.H10.1.454.CMB.2.raw
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgagtggttggggttataaccttgtctcctggtaccaacaccacccagacaaacgcccccaaatcatcctttatgaggcactaagcgccctgagggtttctaatcgcttcgctcggctccacgtctggcagccacggcctcctgacaatctctgggctccagctgaggacgaggctgtattatactgctgtctctatattacaaacgtcgtgttcaacttattagtagttttggcgggtacggactaaccgaaggtcgacccgtaccgtacggtaccaacgaccccgaacggtccttccgcccccgtcggtacctacccg

SEQ ID NO: 379874 - DNA, 721 bp, Homo sapiens
  misc_feature: GZ8MTXP02H6BVL.17.87.H10.1.454.CMB.2.raw
  modified_base (303)..(303): a, c, t, g, unknown or other
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctctggtcagtcgatcaccatctcctgcactggaagcggcagtgagtggttggggttattaacgttgtctccgtggtaccaacaccaccagacaacgcccccaaatcatccttangaggcagtacgcgcctgtagggtttcaaatcgtcttcgcgtcggcctccgacgtcgtcggcacgccaccgggtccctccccgtagaacctaactccgtcgtccgggctcccgaaggcctaggacggtacgaggtctagtaatttacttaacgtcgtacgttcgtaccttacgtaactttactttaccgtaaagtttcccgggttacgtttacccttaaacgtttacggtttaggttttaacggttttttacgggggaaccgggtaaaccggggttacccgtaaaacccggtaaaggggttacccggttaaaccccggttacccgtttaaacggggttacccgaacccggttaaccccggaaaccgggttaccccgtcccggtacccccccgtttcgggttaacccctttaacccccgg

SEQ ID NO: 379875 - DNA, 593 bp, Homo sapiens
  misc_feature: GZ8MTXP02GWJFW.17.87.H10.1.454.CMB.2.raw
  modified_base (299)..(299): a, c, t, g, unknown or other
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgagttggttggggttataacttgtctctgtaccaacaccaccagacaacgccccaaatcatccttangaggcactagcgcctgagggtttctatcgtcttcgctcgctccacgtcgtacggcacgccgaccggccctcctagacctaatcgtcgtcgggctaccgaggcgtaggacggacgaggtactgtaattacgtactgtctgctactattacttacgaacgttcgtacgttactacgttattagttagttttcgggacggtacggaccaaccggtaaggtaccgtaccggttaccgtacgggtaccaaccggaacccgaacggtcccgtacccggtcccccgtacggtcctaccccg

SEQ ID NO: 379876 - DNA, 521 bp, Homo sapiens
  misc_feature: GZ8MTXP02FQZPN.17.87.H10.1.454.CMB.2.raw
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttggggttataaccttgtctcctggtaccaacaccaccagacaaagcccccaaactcatcctttatgaggcactaagcggccctgaggggtttctaatcgcttcgctcggctccacgtctggcagcacggcctcctgacatctctcggctccgagctggagacgaggctgattattactgctgctcatacttcaagtcgtacgtctactatgtagtttttggcggtaggccgacgaaggtcgtaccgtctaggtcaacgcccgaagcctcgcccctcggtctccg

SEQ ID NO: 379877 - DNA, 583 bp, Homo sapiens
  misc_feature: GZ8MTXP02F5CUJ.17.87.H10.1.454.CMB.2.raw
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttggggttatacttgtctctgtaccaacaccaccagaacaaacgacccccaaactcactccttatgacggcaacgtaagccggccctacgtaggggtttctaactcgcttacgctcggcctccacgtctggcacgcgaccgcctccgtagactaactcgtcgtcgggctccgagacgtgacggtacgaggtctagtattactactggtctgtcctatattacttacgaacgttcgttagtactacgttataggttagttttggacggtagaccaaccggtaaggtcgtaccgtacgtacggtacaacggtacccgaacggtcctccggtccccgtcggtcttacccg

SEQ ID NO: 379878 - DNA, 601 bp, Homo sapiens
  misc_feature: GZ8MTXP02JIBF6.17.87.H10.1.454.CMB.2.raw
  modified_base (302)..(302): a, c, t, g, unknown or other
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcacgtggaagcggcagtgattggttaggggttactaacgttgtctccgtgtaccaacaccaccagacaacgccccaatcatcttangaggcactagcgcctgaggttcatcgtctcgctcgcctccacgtcgtggccagccgaccggccctccgtagaacctactccgtcgtcggtcctccgacggccgtaggaacggacggacggtctagtaactttacttaacgtcgtcgtgtctacgtattacgttactaagttcgtacgtactacttagttagttagttttcgggacggtacggaccgaaccggtaacggtacgtaccgtacgtacggtacgaaccggacccgaacggtcccgtccgtcccccgttcgtaccgtttacccg

SEQ ID NO: 379879 - DNA, 535 bp, Homo sapiens
  misc_feature: GZ8MTXP02IQACY.17.87.H10.1.454.CMB.2.raw
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttggggttataaccttgtctctggtaccaacaccaccagacaaacgcccccaaactcatccttatgaggcactaagcggcccctgaggggtttcaatcgcttcgctggctccacgtctggcacgcacggcctccctgacaatctctgggctccgagcgtgaggacgaggctgtaattatactgctgctcattatactaagtcgtgtctattatgtagttttggcggaggtcacgtaaaggtcgtacccgtacgtacgtcaacgacccgtaacggtcctcgcccccgttcggtactcccg

SEQ ID NO: 379880 - DNA, 535 bp, Homo sapiens
  misc_feature: GZ8MTXP02GN2KZ.17.87.H10.1.454.CMB.2.raw
  modified_base (414)..(414): a, c, t, g, unknown or other
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttggggttataaccttgtctctgtaccaacaccacccagacaaacgcccccaaatcatccttatgaggcactaagcgccctgaggggtttctaatcgctcgctcggctccacgtctggcagcacggcctcctgacatctctggctccgagctgagacgagctagacttatactgcgtnctacatattacaagttcgtgtcacttatgttagttttggcggtaggtcaacgtaaacggtcgaccggtctacggtaccaacggtacccgaaggtccctcgcccccgttcggtccttacccg

SEQ ID NO: 379881 - DNA, 571 bp, Homo sapiens
  misc_feature: GZ8MTXP02I86ED.17.87.H10.1.454.CMB.2.raw
  modified_base (124)..(124): a, c, t, g, unknown or other
  modified_base (295)..(295): a, c, t, g, unknown or other
tcagcgtagactagcacgaccggtgctcgatttagcagtactgcgttgggtttggggggggtcacaagaggcagcgctctcgggacgtctccaccatggcctgggctctgctgctcctcactcncctcactcaggacacagggtcctgggcccagtctgccctgactcagcctgcctccgtgtctgggtctcctggtcagtcgatcaccatctctgcactggaagcgcagtgatggttggggttatacttgtctctgtaccaacaccaccagacaaacgccccaatcatccttangaggcactagcggcctcgagggtttcatcgcttcgctcggctccacgtctggcagccacggtcctcctgactatctcgtggctcgacgtacggacgaggcctaggacttatacttagtaccttggccttcgactactactaaacgtccgtaagttcgtaactacttagaatttttggaacgtttgggcgttaccgaacggtcgaaacggtccgtaacggttccgaggtcccgaaacgggtcccaacggtccccctccgggtccctaccggttcccg

SEQ ID NO: 379882 - DNA, 589 bp, Homo sapiens
  misc_feature: GZ8MTXP02IRLTR.17.87.H10.1.454.CMB.2.raw
  modified_base (402)..(402): a, c, t, g, unknown or other
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcacatctcctgcactggaagcgcagtgatgttggggtataaccttgtctctgtaccaacaccaccagacaaacgcccccaaactcattcttatgaggcactagcgccctcgagggtttctaatcgcttcgctcggcctccacgtctcggcagcacggccctccctagactaatctctcgggctccaggctgaggacgnggtctgtattattacgtgactcgctactattacttacgaacgtcgtagtctaacttagggttattagtttttcgggacggtacggtaccgtaaccggtaaacggttacgtaccccgttaccgttaaggttacccaacggcccccgtaaacggtaccccgttccgacccccgttcggtcccttacccg

SEQ ID NO: 379883 - DNA, 571 bp, Homo sapiens
  misc_feature: GZ8MTXP02GIXG8.17.87.H10.1.454.CMB.2.raw
  modified_base (305)..(305): a, c, t, g, unknown or other
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgattggttggggttataaccttgtctcctggtaccaacaccacccagacaaacgcccccaaatcatcctttangaggcactaagcgcctgagggtttctaatcgctcgctcggcctccacgtctggcagcacggcctcctgacatctcgtggctcgagctggaggacgaggctgtattatactgtctgctactattacttacgtaagtcgttacgtacctaacttagttgtttaagtttttcgggacggtacggaccgtaaccgtaacgggtacgtacccgtacgtacggtaccgaacggacccgaacggtccctaccgtcccccgtcggtcctacccg

SEQ ID NO: 379884 - DNA, 606 bp, Homo sapiens
  misc_feature: GZ8MTXP02JTYAK.17.87.H10.1.454.CMB.2.raw
  modified_base (353)..(353): a, c, t, g, unknown or other
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatggttggggtataacttgtctctgtaccaacaccaccagacaaacgcccccaatcatccttatgaggcactagcgcctgtagggtttcaagtcgcttcgctcggctccgacgtctggcncgccaccgggtcctcccgtagacaactctcgtcgggctcccgagccgtggacggacgacggcttagtacttattacgtcgcgtgcttacattacttacgaagttccgttaggtacctacttagttgtttaagtttttcggggaccgggtaggtacctaaacgtaaggggttacgtaccccggttacgttacggtaccgaacggacccccgtaacggtccctcccggtccccccggttacggtcccttaccccg

SEQ ID NO: 379885 - DNA, 692 bp, Homo sapiens
  misc_feature: GZ8MTXP02I5NVG.17.87.H10.1.454.CMB.2.raw
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcgcagtgatggttggggttataacgttgtctcctggtaccaacaccaccagacaaacgccccaaactcatccttatgacggcaacgtacgccggccctagtacgggtttactaacgtcgtcctcgtctccggcctccgacgtcgtcggcagccgaccggtccctcccgtagacctagtcctcgtcgggtcctccgacggtcgtacggaacggacgacgggtccgttaggttaatttacgttaacgttcggtccgtgtacccttactaactttacgtttaaccgtaaacggttcgttacggttacctaacgttaagtttacggtttaagttttgggaaccggggtacgggtacctaaacccggttaaacgggttaccggtaacccgggttaccgttaacggttaccgaaccggaccccgtaaacggtcccgttacccgtacccccggttccggtaccctttacccccg

SEQ ID NO: 379886 - DNA, 561 bp, Homo sapiens
  misc_feature: GZ8MTXP02IAHON.17.87.H10.1.454.CMB.2.raw
  modified_base (300)..(300): a, c, t, g, unknown or other
  modified_base (351)..(351): a, c, t, g, unknown or other
  modified_base (407)..(407): a, c, t, g, unknown or other
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttggggttataaccttgtctctgtaccaacaccacccagacaaacgcccccaaatcatccttangaggcactagcggcctgagggtttctaatcgcttcgctcggctccacgtcngcagcacggcctccgtgactatctcgtcgctccgagcgtggaggacgagctgattntactgctgctactattatactaacgtgtcgttctaacgttagttacgttagtttttcgggaccggtaggtaccgaaccgtaaaggtacgtacccgtccgttacggtacgaacgtacccgaacggtccgtccgcccccgtacgtacccgttcccg

SEQ ID NO: 379887 - DNA, 521 bp, Homo sapiens
  misc_feature: GZ8MTXP02GP10O.17.87.H10.1.454.CMB.2.raw
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatggttggggttataaccttgtctctggtaccaacaccaccagacaaacgcccccaaactcatccttatgaggcactaagcggccctcgaggggtttctaatcgcttcgctcggctccacgtctggcacgcaccggcctccctagaccaatctctggctccgagctgagacgagctgtattatatgctgctcatatcaagtcgtgtacactatgtagtttggacggagacaccgaaaggtcgaccgtacgtaggtcaacgcccgaacggctcgcccctcggtctaccg

SEQ ID NO: 379888 - DNA, 569 bp, Homo sapiens
  misc_feature: GZ8MTXP02H5OER.17.87.H10.1.454.CMB.2.raw
  modified_base (317)..(317): a, c, t, g, unknown or other
  modified_base (349)..(349): a, c, t, g, unknown or other
  modified_base (356)..(356): a, c, t, g, unknown or other
  modified_base (360)..(360): a, c, t, g, unknown or other
  modified_base (371)..(371): a, c, t, g, unknown or other
  modified_base (375)..(375): a, c, t, g, unknown or other
  modified_base (408)..(408): a, c, t, g, unknown or other
  modified_base (413)..(413): a, c, t, g, unknown or other
  modified_base (424)..(424): a, c, t, g, unknown or other
tcagcgtagactagcacgaccggtgctcgatttagcagtactgcgttgggtttgggggggtcacaagaggcagcgctctcgggacgtctccaccatggcctgggctctgctgctcctcactctcctcactcaggacacgagggtcctgggcccagtctgccctgactcagcctgcctcgtgtctgggtctcctggtcagtcgatcaccatctcctgcacgtggaagcggcagtgattggttaggggttaataaccttgtctcgtagtaaccaaacacccaccaagaacaaacgacccccaaaatctaattcctttanagaggacaactaacgcgccctagtaggtttanaatcgtntcgntcgctcacgtngcancacgcctccctagaactaatctcgcgcctacgngacgngaggacgagtntagtaattactactgtctgtactatatactacgtagtcgtatactagttagttagttagttaggacgaacgaccgaaacgaggtacgtaccgtacgtacgacgaaccgaccgaacgtccctacccgtccccgtacgtacctaccg

SEQ ID NO: 379889 - DNA, 618 bp, Homo sapiens
  misc_feature: GZ8MTXP02HRHEQ.17.87.H10.1.454.CMB.2.raw
tcagcgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctcgtgtctgggtctctggtcagtcgatcacatctcctgcacgtggaagcgcagtgagttggttaggggttactacgttgtctcgtagtaccaacaccaccagacaacgccccaatcatcttatgagcacgtagccgcctgtaggttcagtcgtctcgcgtcgcctccgacgtcgtgaccacgccgacggtccctccgtacgaacctacgtctcgtcggcctccgagacgtggaacgacgtgtactagtattagtacgtgtacttcgtaccttatacttaagttaccgtaaacgttcgttactaccgttacgttagtttacgggtttagttttacgggaccggtacggtaacccgtaacggttaaacggtaccgtacccggttaccggtacgtaccgaacggtacccgaacgtcccgtacccgcccgttacgtaccttacccg

SEQ ID NO: 379890 - DNA, 618 bp, Homo sapiens
  misc_feature: GZ8MTXP02G13KE.17.87.H10.1.454.CMB.2.raw
  modified_base (297)..(297): a, c, t, g, unknown or other
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctcgtgtctgggtctcctggtcagtcgatcaccatctcctgcactggaagcggcagtgagtggttggggttataacttgtctctgtaccacaccaccagacaaacgccccaactcatcttagngaggcactagcgcctgtagggttcatcgctcgctcggctccacgtctgcagccacggcctcccgtagactaactccgtacgtcgggcctccgaggtctaggaggacgaggctaggtacttacttacgtgtcgtgtcttctaattacttacgaacgttcggttacgttactaacgtttagttaggtttacgtttttacggggaccggttaacggaccgtaaacccggtaaacgggttccgtaacccggttccgtaacggtaccgaaccggaacccgtaacggtcccgtacccggtcccccgttaccgggtccttaaccccgg

SEQ ID NO: 379891 - DNA, 558 bp, Homo sapiens
  misc_feature: GZ8MTXP02F0STQ.17.87.H10.1.454.CMB.2.raw
  modified_base (300)..(300): a, c, t, g, unknown or other
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatggttggggttataacttgtctctggtaccaacaccaccagacaaacgcccccaaatcatccttangaggcactaagccggcctcgagggtttctaatcgcttcgctggcctccacgtctggcagcacggccctcctgactatctcgtcggctccgaggctggaggacgaggctgtattacttactgtctgctactattattactaacgtcgtgtctactagtgttagttttgggacggtaggacgtaaccgaacgggtacgtaccgtcccgtaggttacgaacgacccgaacgtccgtcccgtccccgtccggtccttacccg

SEQ ID NO: 379892 - DNA, 672 bp, Homo sapiens
  misc_feature: GZ8MTXP02HYXQG.17.87.H10.1.454.CMB.2.raw
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgagttgggttaggggttattaaccgttgtctccgtcggtaccaacaccaccagaccaaacgcccccaaatctactcctttagtggacggcaagtaacgccggaccctcgtaggggtttcaagtcgtctcgctcggcctccacgtctggcacgccgaccggcctcccgtagaacctaacgtctcgtcgggtcctaccgacggtccgtaggacgggacggtaaggtcgtaagtaactttacttacgtcgtccgtgtacttactattacgttacgtaagttcgttacgttacctacgttagttaggtttaggtttttacgggacggtaacggttccgaaaccggttaaacgggtcgtaaccccggtacgttaaccgggttaccaaccggtacccggaaacggtcccgttacccggtcccccggtcggttaacccgttaccccg

SEQ ID NO: 379893 - DNA, 580 bp, Homo sapiens
  misc_feature: GZ8MTXP02JF10O.17.87.H10.1.454.CMB.2.raw
  modified_base (295)..(295): a, c, t, g, unknown or other
  modified_base (339)..(339): a, c, t, g, unknown or other
  modified_base (346)..(346): a, c, t, g, unknown or other
  modified_base (357)..(357): a, c, t, g, unknown or other
  modified_base (364)..(364): a, c, t, g, unknown or other
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctggtctcctggtcagtcgatcaccatctcctgcactggaagcggcagtgattggttggggttataccttgtctctgtaccacaccaccagacaaacgccccaatcatcttangaggcactagccgcctcgtaggtttctaatcgctcgctcgctcnctctgcngcacgcctccngacatcncgtcgctccgagctggaggacgaggctagtattactactgctgctactattacttacgaacgttcgtattacgactttgttagtttacgtttcgggaccggtacggacctaacccggtaaaggttccgtaaccccgttaccgtaacggggttccaaccggccccggtaaacggtccccgttcccggtaccccccgtttcggtaaccctttaccccg

SEQ ID NO: 379894 - DNA, 537 bp, Homo sapiens
  misc_feature: GZ8MTXP02GHTW7.17.87.H10.1.454.CMB.2.raw
  modified_base (296)..(296): a, c, t, g, unknown or other
  modified_base (402)..(402): a, c, t, g, unknown or other
  modified_base (421)..(421): a, c, t, g, unknown or other
  modified_base (436)..(436): a, c, t, g, unknown or other
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctggtctcctggtcagtcgatcaccatctcctgcactggaagcgcagtgatggttggggttataaccttgtctctggtaccacaccaccagacaagcccccaaatcatccttangaggcactaagcgcctgtagggtttcaatcgcttcgctcggcctccacgtctggctagcgaccggcctcccgtagactaactctcgtggcctccgagctgagacgngctgattatactgctgctnatattacaagtcgtntccgattatgtagttttggacggtagctaccgaaggtcgtaccgtaccgtagttccgaacgtcccgaaacggtcctaccgccccgttacggtcttaacccg

SEQ ID NO: 379895 - DNA, 554 bp, Homo sapiens
  misc_feature: GZ8MTXP02G9IPK.17.87.H10.1.454.CMB.2.raw
  modified_base (363)..(363): a, c, t, g, unknown or other
  modified_base (454)..(454): a, c, t, g, unknown or other
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgagtggttggggttataaccttgtctcctggtaccaacaccacccagacaaacgcccccaaatcatccttatgaggcactagccgccctcgtagggtttctaatcgcttcgctcggcctccacgtctggcngccgacgcctcctgacaatctcgtcgggctcccgaggcgtggaaggacggaggctgtattattactgctgctcattatacgtaagttcgtntactacttagtagttagttttcggacggtagacacgtaaggtcgaccgtaccgtaggtacgaacgtacccgaacgtcctcgcccccgtcggtcctacccg

SEQ ID NO: 379896 - DNA, 640 bp, Homo sapiens
  misc_feature: GZ8MTXP02FP6CU.17.87.H10.1.454.CMB.2.raw
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgcccctgactcagcctgcctccgtgtctgggtctcctggtcagtcgatcaccatcctcctgcactggaagcggcagtgagttggttaggggttataaccttgtctcctggtaccacaccaccagacaaacgcccccaatcatccttatgaggcactagcgcctcgaggtttctaactcgcttcgctcggctccacgtcgtggccagccgaccggcctacccgtagaccgtaactcgtcgtcggctcccgagtcgtaggacggaacgcggtctagtactttacgtactgtccgtgtctactattatccgtaagttcgtacggtactaacttagttacggtttaagttttcggggacggtaacggtcccgtaaaccgtaaacggggttaccgtaaaccccggttaccgtaacgggtttacccgaacccggtaccggaaaccggttccgtccccggtacccccgtccggttacccgtttaaccccg

SEQ ID NO: 379897 - DNA, 643 bp, Homo sapiens
  misc_feature: GZ8MTXP02IJIVA.17.87.H10.1.454.CMB.2.raw
  modified_base (281)..(281): a, c, t, g, unknown or other
  modified_base (301)..(301): a, c, t, g, unknown or other
  modified_base (389)..(389): a, c, t, g, unknown or other
tcagcgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggtcagtcgatcaccatcctcctgcacgtggaacgcggcagtgtagttggttggggttatacgttgtctctgaccaacaccaccanacaacgccccaatcatcttngaggcactagccgcctgtagggtttcaacgtcgcgttcgcgtcgtcctaccgtacgtcgtcggacacgcccgaccgtccctaccgtanacctactcgtcgtacgggctcccggagccgtaggacggtacggacggtataggttaattacgttactcggtcctgtacccttagtactttagttaaccgtacgggttactacggttcttaaacggtttgtttcggtttaaacgggtttcgggacggtacggtaccgtaaaccggtaacgggtacgttacccggtaccggttacgtaccaacggtaacccgacggtccgtacccgtccccgtcggtacctacccg

SEQ ID NO: 379898 - DNA, 735 bp, Homo sapiens
  misc_feature: GZ8MTXP02HQXSP.17.87.H10.1.454.CMB.2.raw
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctcgtgtctggtctcctggtcagtcgatcacatcctcctgcacgtggaagcggcagtgtagttgggttaggggttaacttaaccgttgtccttcccgtaggtaacccaaaccgacccaaccccgaagaacccaaaaccgaccccccaaaactcctaactttaccctttaagtcggaacgggtaccctaacgttaaacggcccggtaccccgtaggtaacggggttttaccaagtccgtccgtcgtcgtcggccgtaccgacgtcgtcggccacggtccgaacccgggtccctccctagaacctacgtccttcgcggtcctaccgaggctagggacggacgacgggtcttaggtaactttacgttacgtcgtccgttcgtacctttactaactttagttaccgtaaacggttccgttagtaccttacgtttagtttacgggtttaacgggtttcgggacggtaccgtaacggaaaccggttacggtaaccgttcccggtacggtacgtaccggaaccgacccggtacggtccctccccggtcccgtacgtaccgtttccccg

SEQ ID NO: 379899 - DNA, 653 bp, Homo sapiens
  misc_feature: GZ8MTXP02HTSLU.17.87.H10.1.454.CMB.2.raw
  modified_base (301)..(301): a, c, t, g, unknown or other
tcagcgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgccctcgtgtctgggtctcctggtcagtcatcaccatcctcctgcacgtggaagcggcagtgagttggttggggttataacgttgtctcgtgtaccaacaccaccagacaacgccccaatcatcttangaggcacgtagcggtcctgtacgggttctaagccgtcttacgctcggtcctaccgtacgtcgtggcctagccgtaccggtccctacccgtcgaacctacgtcgtccgtgggtccctaccggacggtacgtacgggaacgggtaccggtacgggttacgttaggtactttacgtactcggtcttacgtcttactactttagtacccgttaaggttccgtacgtacgtacgttagtttgttaacggttttcgggacggttcgaaccgacgtaaacgggtccgtacccgtacgttacggaccgaacgtacccggtaacgtcccgcccggttaccccgtcggttaccttaccccgg

SEQ ID NO: 379900 - DNA, 597 bp, Homo sapiens
  misc_feature: GZ8MTXP02F6T5O.17.87.H10.1.454.CMB.2.raw
  modified_base (267)..(267): a, c, t, g, unknown or other
  modified_base (299)..(299): a, c, t, g, unknown or other
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcgcagtgatggttggggttataaccttgtctctgtaccaacnccaccagacaaacgccccaaatcactccttangaggcactacgcgcctcgtagggttctaatcgcttcgctcggctccacgtctggcagccacggcctccgtagaccaatctcgcggcctccgagctaggacggacgaggctagtacttattacgtgtacgtgccttatattagttacgaaacgttcggtactacgaactttagtagttaagttttcgggacgggtaggtaccgtaaccgtaaacgggttcggaaacccgttaccgtacggttaccgaacggtaccccgaaaggtcccgtacccggcccccgttacggtccttaaccccg

SEQ ID NO: 379901 - DNA, 507 bp, Homo sapiens
  misc_feature: GZ8MTXP02FS1OC.17.87.H10.1.454.CMB.2.raw
  modified_base (304)..(304): a, c, t, g, unknown or other
  modified_base (309)..(309): a, c, t, g, unknown or other
  modified_base (335)..(335): a, c, t, g, unknown or other
  modified_base (378)..(378): a, c, t, g, unknown or other
  modified_base (415)..(415): a, c, t, g, unknown or other
  modified_base (419)..(419): a, c, t, g, unknown or other
  modified_base (496)..(496): a, c, t, g, unknown or other
tcagcgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggccccagtctgccctgactcagcctgcctccgtgtctgggtctcctgtcagtcgatcaccatctcctgcactggaagcgcagtgattggttgggggttataaccttgtctcctggtaccaacaccacccagacaaagcccccaaatcatccttangaggnactaagcgcctcagggttctaatcgnttcgctcggctccacgtctggcagcacggcctcctgacatctntgggctcccgaggctgaggacgaggctgattattacngctnctcattactcaagtcgtgtacactaatgtatttgggcggagccaccaggtcgaccgtcgagtcaagccaaggtcccncgcccgcgctc

SEQ ID NO: 379902 - DNA, 652 bp, Homo sapiens
  misc_feature: GZ8MTXP02JE789.17.87.H10.1.454.CMB.2.raw
tcagcgtagactagcacgaccggtgctcgatttagcagtactgcgttgggtttgggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgattgttggggttataaccttgtctcctggtaccaacaccacccagacaaacgccccaaactcatccttatgaggcactaagcggcctcagggttctaatcgcttcgctcggcctccgacgtctgggcctagccgacggtcctccccgtgaacctaatctcgtcggggtcctaccagggcgttaggacggacgaggcgttcggtaattatttaaaccgtggtcctacggtcttactacgtactttacgaacgttccgtagtttaccacgttattaggtacgtttttacggggacggttacgggtaccgaaacccgtaaaagggttccgtaacccgggttaccccgttaagggttacccgaacgggtaccccaaaacggggtccgtttacccggcccccgttacccgggtaccgttaaccccg

SEQ ID NO: 379903 - DNA, 589 bp, Homo sapiens
  misc_feature: GZ8MTXP02H0DAC.17.87.H10.1.454.CMB.2.raw
  modified_base (301)..(301): a, c, t, g, unknown or other
  modified_base (347)..(347): a, c, t, g, unknown or other
  modified_base (368)..(368): a, c, t, g, unknown or other
  modified_base (385)..(385): a, c, t, g, unknown or other
  modified_base (391)..(391): a, c, t, g, unknown or other
  modified_base (423)..(423): a, c, t, g, unknown or other
  modified_base (425)..(425): a, c, t, g, unknown or other
tcagcgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgccctcgtgtctgggtctcgtggtcagtcgatccaccatcctcctgccacgtggaacgcggcagtgagttgggttaggggttactaacttgtctcgtgtaccaacaccaccagacaaacgaccccaanctatcttatgaggacacagccgccctgtacggtttcagtcgtctcncgtcgctccgtactctggacncgcacggtccctccgtnaacctntcctcgcggcctccgaggtccaggagtacggngntagtattatcgtgtctgtactatagtactacgtagtcgtatactacgttagttacgttaggttacggacggtacgtacgtaaccggtacggttaccgtaccgtacgtacgaccgtaacccggtaccgtacggtcccgtacccgtccccgttcgttaccctaccg

SEQ ID NO: 379904 - DNA, 686 bp, Homo sapiens
  misc_feature: GZ8MTXP02F2U2M.17.87.H10.1.454.CMB.2.raw
  modified_base (269)..(269): a, c, t, g, unknown or other
  modified_base (304)..(304): a, c, t, g, unknown or other
tcagcgtagactagcacgaccggtgctcgatttagcagtactgcgttgggtttgggggggtcacaagaggcagcgctctcgggacttctccaccatggcctgggctctgctgctcctcactctcctcactcaggacacagggtcctgggcccagtctgccctgactcagcctgcctccgtgtctgggtctcctgtcagtcgatcaccatctcctgcactggaagcgcagtgagtggttggggttataaccttgtctcctggtaccaacnccacccagaccaaacgccccaaactcactccttangacggcactaagcgacctcgaggggttctaagtcgtacttcgctccggctccgaacgtcgtaggaccacgccgtaaccgggtcccttaccccgtaggtaaacccaaagtttccgtaaccgttcgggggaccttacccgaaacgggtcgtacggaaacgggtacgaacgggtccgttaagtaacgtttaacgttacttacggtccttacgtccgttaactaagttacgttaccctaaaggttccggttagtactacgttagttacgttagtttttacgggacggtaggtacctacggtaaaagggttcctacccggttaccgttacggtaccgaaccgttccgaaacggtccctacccggtccccgttaccgggctttacccg

SEQ ID NO: 379905 - DNA, 583 bp, Homo sapiens
  misc_feature: GZ8MTXP02JTRUX.17.87.H10.1.454.CMB.2.raw
  modified_base (294)..(294): a, c, t, g, unknown or other
  modified_base (429)..(429): a, c, t, g, unknown or other
  modified_base (446)..(446): a, c, t, g, unknown or other
tcagcgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctcgtgtctgggtctcctggtcagtcgatcaccatcctctgcactggaacgcgcagtgatggttggggtatactgtctctgtaccacaccaccaagacaacgccccaatctatccttagnggacggcaacgtagccgtacctgtacggtttacaactccgctcgcgtccgcctccgacgtcgtcggcacgccgaccggtcctccgtagacgtattccgtacgtcgggtcctcgacggcgtaggacggacgtaggngttacgtattactacgngtcgtcgctactattacgttacaacgttcgtcgtactagttacgtagttagttcgggacgtacgcgtaacgtaggtaccgtaccgtactacggactaacgcccgtaacgcccgttaccggcccctcggaccttcccg

SEQ ID NO: 379906 - DNA, 484 bp, Homo sapiens
  misc_feature: GZ8MTXP01EMWYM.13.76.G10.1.454.CMB.2.raw
  modified_base (383)..(383): a, c, t, g, unknown or other
  modified_base (403)..(403): a, c, t, g, unknown or other
  modified_base (416)..(416): a, c, t, g, unknown or other
  modified_base (420)..(420): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaaggccagtcccctgtgctggtcatctatcaagatgccaagcgccctcagggatccccctgagcgattctctggctccaaactctagggaacacagccactctgaccatcagcgggaccagcngtgatgaggctgactatacngtcagcgtggacngacngcaatgcctcgttcgaaactcggaccgaaggttccaacgctaaggtcagcccaaggccaacccc

SEQ ID NO: 379907 - DNA, 544 bp, Homo sapiens
  misc_feature: GZ8MTXP01D6PAM.13.76.G10.1.454.CMB.2.raw
  modified_base (468)..(468): a, c, t, g, unknown or other
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctgggggtccctgagactctcctgtgcagcctctgggttcaccgtcagtcacacctacatgagctgggtccgccaggctccaggggaaggggctggagtgcgtctcttttattatagtagtggtagtacatactccgcaagactccgtgacggggccgattcaccatctccagagacaattccaaagaacacgtctgtttctcaaatgaacaggcctgagagccgatgacacggccgtgtattacgngtgcgagagagtcgggggacccaacggacgttactaacggctaagtcgggacgttcgtgggggccctaaacggggg

SEQ ID NO: 379908 - DNA, 493 bp, Homo sapiens
  misc_feature: GZ8MTXP01D741R.13.76.G10.1.454.CMB.2.raw
  modified_base (436)..(436): a, c, t, g, unknown or other
tcagtcacgtactacacgaccggtgctcgatttagtcactcatacaggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccccctgagcgattctctggctccaactctgggaactcagccactctgacatcagcggaccaggctagtgatgaggctgacgtattactgtcgaggcgtagggacagcagcaactcgccgnttagtgtcttcggacttggggaaccaagggtcaccgtccttaagtcaacgaaccccg

SEQ ID NO: 379909 - DNA, 550 bp, Homo sapiens
  misc_feature: GZ8MTXP01DC4PZ.13.76.G10.1.454.CMB.2.raw
  modified_base (386)..(386): a, c, t, g, unknown or other
  modified_base (468)..(468): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtgggtcccgcaggcctccgaggggaaggggctggagtgcgtcttctttatttatagtagtgtagtacatactcgcagactcgtgagggccatcacatcncagagacaatccaagaacacgtcttgtttctacaaaatgaaacagccgtagagacgccgatcgacgacggccgtgtattacngtgcgagagagttcggggaccccaacggttaaacgttcgaacgctagtcggacgtcgttcgggggaacccgaagggaacccg

SEQ ID NO: 379910 - DNA, 573 bp, Homo sapiens
  misc_feature: GZ8MTXP01CA8BT.13.76.G10.1.454.CMB.2.raw
  modified_base (257)..(257): a, c, t, g, unknown or other
  modified_base (262)..(262): a, c, t, g, unknown or other
  modified_base (275)..(275): a, c, t, g, unknown or other
  modified_base (308)..(308): a, c, t, g, unknown or other
  modified_base (486)..(486): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagtttttggctgagcgtggtttcgtgtaggcgtatttaaaagtgccagtgtgaggtgcagctggtggagtctggaggaggcttgatccagccgtggggggtccctgagctctcctgtgcagctctgggtcncgtcntcacactacatgngcgtcggtccgcgcgcgcgagggagggcgtggngtgtcgtctttctttatttagttagtagtggtagtactactactcgcacgtaacgtcgtcggacgggcgtactcaccactctacagacgactactacaacgaacacgtcttcgttactactaatagacacgacgtacgagacgacgacgtacgacgacgtcgtgttagttacgtgtgngagaggtacggttacggaccgtacgttaacgttacgttacgtaacgtacgtcggtacggtcggttacgggtaacggaacggtaaccg

SEQ ID NO: 379911 - DNA, 599 bp, Homo sapiens
  misc_feature: GZ8MTXP01DT06K.13.76.G10.1.454.CMB.2.raw
  modified_base (378)..(378): a, c, t, g, unknown or other
  modified_base (390)..(390): a, c, t, g, unknown or other
  modified_base (409)..(409): a, c, t, g, unknown or other
  modified_base (451)..(451): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtctggaggaggcttgatccagccgtggggggtccctgagactctcctgtgcagcctcgtgggttcaccgtcagtcacacctacatgagcgtcgggtcccgccgaggcctccggagggggaagggggcgtagggaggtcgcgttctttcttttatttatagtagtgtagtacatactccgnagaactcgtggngggcatcacatctccaganactaatccaaagaacacgtcttgtttactacaaatgaaaccncgcgtaggacgacgcgatcgacgacggtcgtagttacttacgtggcgaacgaggagtacggttaccggggaaccctaacggttaaccgttaccgacgtcgtaggtcggggtaccggtcgggaccgggggtaaccgaaacggggtcccg

SEQ ID NO: 379912 - DNA, 503 bp, Homo sapiens
  misc_feature: GZ8MTXP01AOITV.13.76.G10.1.454.CMB.2.raw
  modified_base (308)..(308): a, c, t, g, unknown or other
  modified_base (431)..(431): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttctggtatcagcagaagtcaggccagtcccctgtgctggtcatctatcaagatgccaagcggccctnagggactccccctgagcgtattctctggctccaaactctgggaacctcagcccactctcgaccatccaggccgggacccaggctagtgatgaggctgactatacgtgtcgaggcgtagggacnggcagcaactcgcccgcgttagtggtcttacgggacttcgggaacagtcaccgtcttacgtcaacgaacccg

SEQ ID NO: 379913 - DNA, 561 bp, Homo sapiens
  misc_feature: GZ8MTXP01EILXW.13.76.G10.1.454.CMB.2.raw
  modified_base (402)..(402): a, c, t, g, unknown or other
  modified_base (425)..(425): a, c, t, g, unknown or other
  modified_base (435)..(435): a, c, t, g, unknown or other
  modified_base (476)..(476): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtctggaggaggcttgatccagccgtggggggtccctgagactctcctgtgcagcctcgtgggttcaccgtcagtcacacctacatgagcgtgggtcccgccgaggcctaccgaggggaagggggctgggagtgcgtcttcttttattatagtagtggtagtaccatactcgcagaactccgtgacggggcattcacatctcaganacatcaagacacgcttgttctanaaatgaaacngccgtagagacgccgagtcgacgacggccgttgtaattacnggtgcgaagaggacgttcggggaccccaagttaaccgttcacgcgtagtcgggacgttcggacggggaaccgaaacgggaacccg

SEQ ID NO: 379914 - DNA, 505 bp, Homo sapiens
  misc_feature: GZ8MTXP01ELA5F.13.76.G10.1.454.CMB.2.raw
  modified_base (448)..(448): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagccggccctcgacggggactccccccgtggacgcgattcctctggctccaactctgggaactcagcccactctgaccatcagcgggacccaggctatgatgaggctgactattacgtgtcgaggtcgtgggacagcagcaactgccccnttagtcgtcttacggacttggggaaccaaggtccaccggtcaagtccaagaaccccg

SEQ ID NO: 379915 - DNA, 512 bp, Homo sapiens
  misc_feature: GZ8MTXP01DI6I7.13.76.G10.1.454.CMB.2.raw
  modified_base (308)..(308): a, c, t, g, unknown or other
  modified_base (421)..(421): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataaatggcagataaatatacttcctggtatcagcagaagtcaggccagtcccctgtgctggtcatctatcaagatgccaagcggccctnagggactccccccgtgagcgattcctctggcctccaaactctgggaactcagcccactctcgaccatcacggcgggaccccaggcctagtgatgaggctgacttattactgtnaggcgtagggcagcagcaacgtcgcccgtcttagtcgtcttcggaagttcgggaaccaaaggtccaccgtcttaagtccgaacgaaccccg

SEQ ID NO: 379916 - DNA, 668 bp, Homo sapiens
  misc_feature: GZ8MTXP01CHQGT.13.76.G10.1.454.CMB.2.raw
  modified_base (276)..(276): a, c, t, g, unknown or other
  modified_base (280)..(280): a, c, t, g, unknown or other
  modified_base (297)..(297): a, c, t, g, unknown or other
  modified_base (315)..(315): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcgtggtttcgtgtagcgtatttaaaagtgccagtgtgaggtgcagctggtggagtctggaggaggcttgatccagcctggggggtccctgagactctcctgtgcagcctctgggttcaccgtcagtcacaccctanatgngcgtcggccgcgaggcncggagggaggggcgtggngtgtcgttctttattttattagtagtagtggtataccatactccgcagtaccgtcggtggacggggtcctattccacctactcctaccgagaacgtaactaacgttaccgaaacgtaacctacgttactttacgttttacctaacgaaacgtacgaaacgtacgtaccggtaggaacggaccggaccgtagtaccgaaccgtaccgggtaccgttagttacgttacgtggtcggaacggaggacggtacggttaccgggtacccggtaaccggttaaccggttaccgttaccgtaacgtacggtaacggtaccggtaccgggttaccggggtaaccggaaccgggtaacccgg

SEQ ID NO: 379917 - DNA, 509 bp, Homo sapiens
  misc_feature: GZ8MTXP01CJUHU.13.76.G10.1.454.CMB.2.raw
  modified_base (234)..(234): a, c, t, g, unknown or other
  modified_base (325)..(325): a, c, t, g, unknown or other
  modified_base (373)..(373): a, c, t, g, unknown or other
  modified_base (379)..(379): a, c, t, g, unknown or other
  modified_base (397)..(397): a, c, t, g, unknown or other
  modified_base (400)..(400): a, c, t, g, unknown or other
  modified_base (450)..(450): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagcccacctcagtgtccgtgtcccaggacagacagccagcatcactgctctaggaaataattggcagataaatntactctggtatcagcagaagtcaaggccagtcccctgtgctggtcatctatacaagatgccaaagccggccctacgagggacttccccccngacgcgattcgactggcctaccaaactctagggaactcagcccactcngaccancaggcggacccagctagngangagcgtagactattacgtgcaggcgtagggacagcagcaacgtgcccgtnttagtcgtcgttacggacgttacggaacacggtccaccgtacgacgtcgaacgaacccg

SEQ ID NO: 379918 - DNA, 545 bp, Homo sapiens
  misc_feature: GZ8MTXP01C1NWM.13.76.G10.1.454.CMB.2.raw
  modified_base (471)..(471): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtcccgccaggcctccgaggggaagggggctggagtgcgtcttcttttatttatagtagtggtagtacatactccgcagaactcgtgaggggccattcaccatctcagagacaattccaaagaacacgcttgtttctacaaaatgaaacagcctagagagccgatgacacgggcctgtattangtgcgagagagttggggccccaagaacgttcttacggctagtcggacgtcgttacgggggccaacggggaaccc

SEQ ID NO: 379919 - DNA, 550 bp, Homo sapiens
  misc_feature: GZ8MTXP01A0824.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggattcacctttgatgattatgccatgcacgtgggtccgcaagctccgaggggaaggcctgggagtgggtctcgaggtattagttggaatagtggtagcataggctagtgcgggactcgtgtaggaacggggccgattcaccatctccagagacaacgccaagacctccctagtatctggacaaatgaaacagcctgagagctggaggacacgggtccttggttattagttgtagaacaaaagcttaccctaaccccttagtaattttggagttgttaacgttaaccggtaaggg

SEQ ID NO: 379920 - DNA, 532 bp, Homo sapiens
  misc_feature: GZ8MTXP01BRZ3B.13.76.G10.1.454.CMB.2.raw
  modified_base (325)..(325): a, c, t, g, unknown or other
  modified_base (358)..(358): a, c, t, g, unknown or other
  modified_base (391)..(391): a, c, t, g, unknown or other
  modified_base (419)..(419): a, c, t, g, unknown or other
  modified_base (422)..(422): a, c, t, g, unknown or other
  modified_base (428)..(428): a, c, t, g, unknown or other
  modified_base (430)..(430): a, c, t, g, unknown or other
  modified_base (432)..(432): a, c, t, g, unknown or other
  modified_base (434)..(435): a, c, t, g, unknown or other
  modified_base (438)..(438): a, c, t, g, unknown or other
  modified_base (447)..(447): a, c, t, g, unknown or other
  modified_base (467)..(467): a, c, t, g, unknown or other
  modified_base (469)..(469): a, c, t, g, unknown or other
  modified_base (471)..(471): a, c, t, g, unknown or other
  modified_base (502)..(502): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagtttttggctgagcgtggttttcgtgtaggctatttaaaagtgcccagtgtgaggtgcagctggtggagtctggaggaggcttgatccagcctggggggtccctgagactctcctgtgcagcctctgggttcaccgtcagtcacactacatgagctgggtccgcaggcctccgaggggaggggctgggagtgcgtctntttttatttatagtagtgtagtacatactccgnacgaccgtccgtggacggggcctacttcacctntcaccgagcactagtccaagacacgttnttnttctananananncgngagacgcgncgacgacgcgtgtatagtgngngngagcgcggaccgacgttacgttcgttacgtntgtcgtcgtcggcggtaacgaacggaaccg

SEQ ID NO: 379921 - DNA, 506 bp, Homo sapiens
  misc_feature: GZ8MTXP01CKRJZ.13.76.G10.1.454.CMB.2.raw
  modified_base (235)..(235): a, c, t, g, unknown or other
  modified_base (409)..(409): a, c, t, g, unknown or other
  modified_base (414)..(414): a, c, t, g, unknown or other
  modified_base (444)..(444): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaatggcagataaatntacttcctggtatcagcagaagtcaggccagtcccctgtgctggtcatctatcaagatgccaagcggccctgagggactccccctgagcgattctctggctccaaactcgtgggaactcagccactctgaccatccaggccggggaccccagggctagtggatgaggctgactnttacngtcaggctgggacagcagcaactgcccgtnttgtcgtcgttcggacgttcgggaacctaggtccgaccgtacgttacgtccgaacgaacccg

SEQ ID NO: 379922 - DNA, 596 bp, Homo sapiens
  misc_feature: GZ8MTXP01CGJFI.13.76.G10.1.454.CMB.2.raw
  modified_base (230)..(230): a, c, t, g, unknown or other
  modified_base (299)..(299): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgcctcagtgtctgggccccagggcagaggtcaccatctctgcatgggancagctcaacattgggcacattatgatgtacactggtaccagcagttccaggagcaggtcccagactccnatcaatacgtaacaacaatccggcccgacgacgggggtccctgacccgtattcctacgtcgggctccgaggttctggccacctcgacgtcccttcccgtggtccatccgacgtcggggccttccggaagggtccctaggacggtagttcggaacgggtcttacgggtaatttacgtttcctcggtccctaacggttcccttaggttcgaacgtacggtcaacggttcccgttaggtaacgttcggtccgtttcgggtacggtttccgggggaacccggggggttaaccctaacgggg

SEQ ID NO: 379923 - DNA, 491 bp, Homo sapiens
  misc_feature: GZ8MTXP01EJPSG.13.76.G10.1.454.CMB.2.raw
  modified_base (234)..(234): a, c, t, g, unknown or other
  modified_base (421)..(421): a, c, t, g, unknown or other
  modified_base (488)..(488): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgcctcagtgtctggggccccagggcagagggtcaccatctcctgcactgggancagctccaacattggggcacattatgatgtacactggtaccagcagtttccaggagcaggtcccagactcctcatcaatacgtaacaacaatccggcccgtacgacggggtccctgacccgattctctggctccaggtctgcactcagcctcctgtcatcactggctcgagctgagatgaggctgtnttattctgcctaagtccttatcgacaggcagccttgaagtgcttcgggtagttcgggccggggaacncgg

SEQ ID NO: 379924 - DNA, 517 bp, Homo sapiens
  misc_feature: GZ8MTXP01ATELQ.13.76.G10.1.454.CMB.2.raw
  modified_base (441)..(441): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttctggtatcagcagaagtcaggccagtcccctgtgctggtcatctatcaagatgccaagcggccctcagggactccccccgtgagcgattctctggctccaactctgggaactcagccactctgaccatccagccgggacccaggctagtgatgaggctgactattacgtgtcgaggcgtgggacagcagcaactcgcccgnttagtgtcttcgggaacttcgggggaacccaaaggggttccaacccggttccgttaacgtccgaacggaacccccg

SEQ ID NO: 379925 - DNA, 490 bp, Homo sapiens
  misc_feature: GZ8MTXP01CX50G.13.76.G10.1.454.CMB.2.raw
  modified_base (235)..(235): a, c, t, g, unknown or other
  modified_base (307)..(307): a, c, t, g, unknown or other
  modified_base (391)..(391): a, c, t, g, unknown or other
  modified_base (432)..(432): a, c, t, g, unknown or other
  modified_base (444)..(444): a, c, t, g, unknown or other
  modified_base (453)..(453): a, c, t, g, unknown or other
tcagtcacgtactacacgaccggtgctcgatttagtcactcatacaggggaggctctgcttcagctgtgggcacaagaggcagcactcaggacaatctccagcatggcctggtctcctctcctcctcactctcctcgctcactgcacagggtcctgggcccagtctgtactgacgcagcccgccctcagtgtctggggccccagggcagagggtcaccatctcctgcactgggancagctccaacattggggcacattatgatgtacactggtaccagcagttccaggagcaggtcccagactcctnatcaatacgtaacaacaatcggcccgacgacggggtcccctgacccgattctctcggctcccaggtctggcactcagcctcccngtcatcactgggctcgagctgaggatgaggctgattattcngccaagtccatncgagcagcncgaagtgtcgtcgtagttcggtcggggccggaaccgg

SEQ ID NO: 379926 - DNA, 506 bp, Homo sapiens
  misc_feature: GZ8MTXP01DGH7O.13.76.G10.1.454.CMB.2.raw
  modified_base (232)..(232): a, c, t, g, unknown or other
  modified_base (302)..(302): a, c, t, g, unknown or other
  modified_base (320)..(320): a, c, t, g, unknown or other
  modified_base (354)..(354): a, c, t, g, unknown or other
  modified_base (389)..(389): a, c, t, g, unknown or other
  modified_base (405)..(405): a, c, t, g, unknown or other
  modified_base (411)..(411): a, c, t, g, unknown or other
  modified_base (413)..(413): a, c, t, g, unknown or other
  modified_base (415)..(415): a, c, t, g, unknown or other
  modified_base (424)..(424): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagcccgcctcagtgtctgggccccagggcagaggtcacatctcctgcactgggancagctcaacagttgggcacattatgatgtacactggtaccagctagttccaggagcaggtcccagactcncatacaatacgaaacaanaatcggcccgacgacgggtccctagacgtattcnctggctcagtctggcactcacgcctcctcgtcacncacgcgcgcggcgcgngagagngngngtagtattnttctcgctaactcttatacgacgacgcgacgcgttcgtgtcgtcgttcggttacggttaccgggtccggggaaccggtaacg

SEQ ID NO: 379927 - DNA, 548 bp, Homo sapiens
  misc_feature: GZ8MTXP01EAW0Z.13.76.G10.1.454.CMB.2.raw
  modified_base (371)..(371): a, c, t, g, unknown or other
tcagtcacgtactacacgaccggtgctcgatttagtcactcatacagggggcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgaggggaagggctggagtgcgtctcttttattatagtagtggtagtacatactcccgcagactccgtgaacggggccnttcaccatctccagagacattccaaagacacgctgtttactcaaatcgaacagcctagagacggccgatcgacacggccgtgtattacgtgtgcgagagaagtcggggacccagttaacgttacaacggcttagttggaacgtcgtcggggaccaaggggacctcggttctaacccg

SEQ ID NO: 379928 - DNA, 564 bp, Homo sapiens
  misc_feature: GZ8MTXP01BQEQ5.13.76.G10.1.454.CMB.2.raw
  modified_base (353)..(353): a, c, t, g, unknown or other
  modified_base (426)..(426): a, c, t, g, unknown or other
  modified_base (430)..(430): a, c, t, g, unknown or other
  modified_base (485)..(485): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcgtggtttctgtgctatttaaagtgccagtgtgaggtgcagctggtggagtctggaggaggcttgatccagccgtggggggtccctgagactctcctgtgcagcctctgggttcaccgtcagtcacacctacatgagctgggtcccgcaggctccgagggaggggctggagtgcgtctttcttttattatagtagtggtagtacatactccgnagaaccgtccgtggagggggccattccaccatctccagacactaatccaaagacacgtcttatttccttaaanaatnaacgacgacggagagacgacgacgtacgacgacggtcgtacgtagttacgtgtgngagagtacggacggaccgtaacgttacgttacgttacgtaacgtagtcggtcggtcggacgggtaacggaacggaaccg

SEQ ID NO: 379929 - DNA, 636 bp, Homo sapiens
  misc_feature: GZ8MTXP01A06C6.13.76.G10.1.454.CMB.2.raw
  modified_base (253)..(253): a, c, t, g, unknown or other
  modified_base (273)..(273): a, c, t, g, unknown or other
  modified_base (285)..(285): a, c, t, g, unknown or other
  modified_base (297)..(297): a, c, t, g, unknown or other
  modified_base (299)..(299): a, c, t, g, unknown or other
  modified_base (302)..(302): a, c, t, g, unknown or other
  modified_base (313)..(313): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcgtggtttcgtgtagctatttaaaagtgccagtgtgagtgcagctggtgagtctggaggaggcttgatccagccgtggggggtccctgagactctcctgtgcagctcgtggtcnccgtcagtcacactacatgngcgtcggcgcgngcgcgaggaggngnggngtgtcgtcttntttatttagttagtagtagtagtacctatacgtcgcacgtaacgtccgtcggacgggtaccgtacgtactacctactactaccgacgaacgaacgaaccgaaccgaacgtaaccgtaccgtacgtactacgtacgaacaaagtaacgaacgacggacgtagagacgacgtacggacggacgtacgtacgttagttagttagttagtaacgtaacgttaaacgtaaccttacccgtaaacccgttaacgttacgtttaggttacggttaacggttacggtaacggtacgggtacggggttaccggtaaccgggttaaccggtcg

SEQ ID NO: 379930 - DNA, 503 bp, Homo sapiens
  misc_feature: GZ8MTXP01EXJ56.13.76.G10.1.454.CMB.2.raw
  modified_base (449)..(449): a, c, t, g, unknown or other
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttctggtatcagcagaagtcaggccagtcccctgtgctggtcatctatcaagatgccaagcggccctcgagggactccccgtgacgcgattctctggctccaactctagggactcagccactctgaccatcaggcgggaccaggctagtggatgaggggctgactatactgtcgaggcgtggggacagcaggcacgttcgcccgttntagtcgttacgttcggaactgggaccaaggtccaccgttcctaagttcgaaccg

SEQ ID NO: 379931 - DNA, 495 bp, Homo sapiens
  misc_feature: GZ8MTXP01B95SV.13.76.G10.1.454.CMB.2.raw
  modified_base (236)..(236): a, c, t, g, unknown or other
  modified_base (425)..(425): a, c, t, g, unknown or other
  modified_base (432)..(432): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagcccgccctcagtgtctggggccccagggcagagggtcaccatctcctgcactgggancagctccaacattggggcacattatgatgtacactggtaccagcagtttccaggagcaggtcccagactcctcatcaatacgtaacaacaatccggcccgcgacggggtccctgacccgattctctggctccagtctggcacctcacgcctcctgtcatcactgggctcgaggctgaggatgaggctgnttattcngcctaagtccttatcgacgagcacgccttgaagtgcgttcggtagttcggggccggggctcgg

SEQ ID NO: 379932 - DNA, 489 bp, Homo sapiens
  misc_feature: GZ8MTXP01D8AXJ.13.76.G10.1.454.CMB.2.raw
  modified_base (292)..(292): a, c, t, g, unknown or other
  modified_base (318)..(318): a, c, t, g, unknown or other
  modified_base (328)..(328): a, c, t, g, unknown or other
  modified_base (382)..(382): a, c, t, g, unknown or other
  modified_base (401)..(401): a, c, t, g, unknown or other
  modified_base (434)..(434): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttctggtatcagcagaagtcaggccagtcccctgtgctggtcatctatcaagntgccaagcgccctgaggactcccccngagcgattcnctggctccaactctgggaacctcagccactctgaccatcagcggaccaggctangatgaggctgactattacngtcaggctagggacaggcagcaactgccccgtnttgtcgtcttacggacgttacggaacgtagtcctaccgtcttagtcgaacgcccg

SEQ ID NO: 379933 - DNA, 558 bp, Homo sapiens
  misc_feature: GZ8MTXP01ESM2S.13.76.G10.1.454.CMB.2.raw
  modified_base (308)..(308): a, c, t, g, unknown or other
  modified_base (322)..(322): a, c, t, g, unknown or other
  modified_base (398)..(398): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaaggccagtcccctgtgctggtcatcatcaaagatgccaagcgccctnagggatccccccgngagcgtattctctcgctacctaactcgtacggaactcacgccactctacgacatcgacggaccggaccaggctagngataggagcgtagtaacttaattacgtagtcgagggtcggtacgggacgacgacgacgacgaacgtcgccgtacgttacgttcgttacgttacggttacggttacgggtaaccgtaacggtaaccgtaaccgtaccgttaacgtaaccgaaccgaacccg

SEQ ID NO: 379934 - DNA, 516 bp, Homo sapiens
  misc_feature: GZ8MTXP01AB9HS.13.76.G10.1.454.CMB.2.raw
  modified_base (398)..(398): a, c, t, g, unknown or other
  modified_base (424)..(424): a, c, t, g, unknown or other
  modified_base (456)..(456): a, c, t, g, unknown or other
tcagtcacgtactacacgaccggtgctcgatttagtcactcatacagggagcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagccggccctgacgggactcccgtgagcgattcctcgtggctccaactctgggaactcacgcccactctcgaccatcgaggccgggacccaggctagnggatgaggggctagacttattaccgngtcgaggtcgtgggacagcagcacttgcccgngtatcgttcgttcggacgtcggggacctaacgggtccaccgttcctaacgttccaaccgg

SEQ ID NO: 379935 - DNA, 525 bp, Homo sapiens
  misc_feature: GZ8MTXP01AGNIK.13.76.G10.1.454.CMB.2.raw
  modified_base (306)..(306): a, c, t, g, unknown or other
  modified_base (328)..(328): a, c, t, g, unknown or other
  modified_base (397)..(397): a, c, t, g, unknown or other
  modified_base (465)..(465): a, c, t, g, unknown or other
tcagtcacgtactacacgaccggtgctcgatttagtcactcatacagggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttcctggtatcagcagaagtcaggccagtcccctgtgctggtcatctatcaagatgccaagcggccctnagggatccccctgagcgattcncgtgctacactcgtacggactcgacgccactcgtacaccacgtcgacggaccgggaccaggtcctaggngtagagaggctagtacttattacgtgtccgtaggtcgtttagacgtagcgaacgcaacgtcgcccgtnttagtcgtcgttacggacgttcggaactacgtcctacgtacgttacgtcgaaccgaaccg

SEQ ID NO: 379936 - DNA, 547 bp, Homo sapiens
  misc_feature: GZ8MTXP01D0SU0.13.76.G10.1.454.CMB.2.raw
  modified_base (423)..(423): a, c, t, g, unknown or other
  modified_base (461)..(461): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataaattggcagataaatatacttcctggtatcagcagaagtcaggccagtcccctgtgctggtcatctaatcaaagatgccaagccggccctcagggactcccccctgagcgattctctggcctccaaactcgtagggaactcagcccactctgaccatccgagaccggggacccagggctagtgatgagcgtagactattacngtcgaggcgtagggacagcgagccaactcgaccccgtnttaacgtcgttcgttacgggaacgttacggggaaccctaacgggtcctaacccggtaccgttaaacggtcccgaacgtaaccccgg

SEQ ID NO: 379937 - DNA, 633 bp, Homo sapiens
  misc_feature: GZ8MTXP01EDA0Z.13.76.G10.1.454.CMB.2.raw
  modified_base (276)..(276): a, c, t, g, unknown or other
  modified_base (320)..(320): a, c, t, g, unknown or other
  modified_base (368)..(368): a, c, t, g, unknown or other
  modified_base (398)..(398): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcgtggtttctgttagctatttaaaaggtgccagtgtgaggtgcagctggtggagtctggaggaggcttgatccagccgtggggggtccctgagactctcctgtgcagcctctggggttcaccgtcagtcacacctanatgagcgtcggccgcgaggccgacggaggggacggggcgtaggngtcgtcgtttctttattttattagtagtaggtgtataccatactcganacgtacgtcggtggacgggcctactcactntctacagacaactaactacgaaagactacgtctttagtttacttactaaataacgaacgacgtaccggtacgacggacgaccgacgtacgacgtaccggtaccggttacgttagttacgttcggtggaacggaaggaggtacggttacgggtaaccggtaacggttaacgttacgttacgtaacgtacgtaacggtacggtacgggttacgggtaaccgggaaccgggtaaccgg

SEQ ID NO: 379938 - DNA, 575 bp, Homo sapiens
  misc_feature: GZ8MTXP01DGLSO.13.76.G10.1.454.CMB.2.raw
  modified_base (516)..(516): a, c, t, g, unknown or other
  modified_base (561)..(561): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctgggtggggtctggaggaggcttgatccagccgtgggggtcccgtgagactctcctgtgcagcctcgtggttcaccgtcagtcacacctacatgagctcgggtccgccaggctccgagggggaaggggcgtggagtgcgttcttcttttatttatagtagtggtagtacatactccgcaagacctccggtgacggggcccgtatccaccatcctcaagacgaacaacttaccaaagaaacacgtcttcgtttactacaaaatgaaacaggtctaggagacgccgaatcgacgaccggcctagtattacgtgtgacggagtacgngtaccgggggcccaagttacgttacgcgctaagtgggacgttcgngggaaccgaacggg

SEQ ID NO: 379939 - DNA, 534 bp, Homo sapiens
  misc_feature: GZ8MTXP01EJ5KP.13.76.G10.1.454.CMB.2.raw
  modified_base (460)..(460): a, c, t, g, unknown or other
  modified_base (501)..(501): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggtcaccgtcagtcacacctacatgagctgggtccgccaggctccgagggaagggggctggagtgcgtcttcttttattatagtagtggtagtaccatactcgcagaactccgtgagggccattcaccatctcagagacaatccaagaacacgcttgttctacaaatgaaacagcctgagagccgatgacacggcctgtattacngtgcgagagagttcggggacccaacgaacgttcacgctagnggacgtcgttgggggaacccaagggggaacccc

SEQ ID NO: 379940 - DNA, 554 bp, Homo sapiens
  misc_feature: GZ8MTXP01BOZMO.13.76.G10.1.454.CMB.2.raw
  modified_base (392)..(392): a, c, t, g, unknown or other
  modified_base (415)..(415): a, c, t, g, unknown or other
  modified_base (495)..(495): a, c, t, g, unknown or other
tcagtcacgtactacacgaccggtgctcgatttagtcactcatacaggggggagaggagcccagcactgggattccgaggtgtttccattcggtgatcagcactgaacacagaggactaaccatggagttttggctgagctgggttttccttgttgctattttaaaaggtgcccagtgtgaggtgcagctggtggagtcgtgggggaggcttggtcaaggccgggggagtccctgagactctcctgtgaagcctcaactattctactttttgcttcgtgcctgggtgaccgtgggtcccgccgaggcctccgagggggaaggggcgtggagtggattggcatattaaggacagacctaagtggcgcgacacgcacactactgaaactccgtnaaagacagatcatcatctcgagnggtgattccgaacacgacggtgctctaccatactggagcacgacctagaaaactcggagacacgaggtcctatattaacngttgcagtgagttcgggccaccgaacctacgtcgttttgggaggttggtcgcggtcccg

SEQ ID NO: 379941 - DNA, 654 bp, Homo sapiens
  misc_feature: GZ8MTXP01EV791.13.76.G10.1.454.CMB.2.raw
  modified_base (472)..(472): a, c, t, g, unknown or other
  modified_base (526)..(526): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtctggaggaggcttgatccagccgtgggggtccctgagactctcctgtgcagcctcgtgggtcaccgtcagtcacacctacatgagcgtcgggtcccgccgaggcctaccggaggggaagggggctgggagtgcgttcttcttttattatagttagtgtagtaccatactcctacagaacctcggtggacggggccgtacttccacctatcctaccgagacgactaagttaccaaagaactacgtctttagtttactaacaaagttcgaaacncgtcctaggaacggacgccgaatcgaccgtacgggtccttaggttaatttccgnggtgaacggaaaggttacggtacgggttccgggggaacccctaaacggttaaaccgtttacgaaccggtccgttaaggttcgggaaccggttcgggaccgggggtaacccgaaacgggggtaaccccg

SEQ ID NO: 379942 - DNA, 617 bp, Homo sapiens
  misc_feature: GZ8MTXP01D34J7.13.76.G10.1.454.CMB.2.raw
  modified_base (469)..(469): a, c, t, g, unknown or other
  modified_base (513)..(513): a, c, t, g, unknown or other
  modified_base (516)..(516): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggtcaccgtcagtcacacctacatgagcgtcgggtccgccgaggcctccggaggggaagggggctgggagtcgtcgttctttctttttatttagtagttagtggtagtaccatactccgcagtaacctcggtggacggggccgattccaccactctacccagacaacaattcccaaaggaacacgtcttagtttactaacaaattgaaaccncgcgtagacgacgcgagtcgaccgacggtcgttattacttacgnggngaacggaaggacgtacggttaccgggaaccctaaacgggttaaccgttcgacgtctacggtaacgggtaccggtcgggacgggaaccccgaacgggtcccg

SEQ ID NO: 379943 - DNA, 671 bp, Homo sapiens
  misc_feature: GZ8MTXP01CD3T4.13.76.G10.1.454.CMB.2.raw
  modified_base (247)..(247): a, c, t, g, unknown or other
  modified_base (260)..(260): a, c, t, g, unknown or other
  modified_base (272)..(272): a, c, t, g, unknown or other
  modified_base (285)..(285): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagtttttgctgagcgtggtttctgtagctatttaaagtgccagtgtgaggtgcagctggtggagtctggaggaggcttgatccagccgtggggggtccctgagactctcctgtgcagcctntgggttcaccgtnagtcacacctantgagcgtcggccncgaggctacggagggagggcgtggagtgtcgttactttattttagttagtaggttagttacggtacgtaacctacgtacgtccgactacgtaaccgttccgggtgggacgggtacctacttaccaacctactacctacgaagaacgtaactaactaaccgaaacgaacgtacgtacgttacgtttacttaactaaacgtaacgtaacgacgtacggtacgacggacgaccgacgtacgaccgaccggtacgtacgttacgttacgtcggtggaacggtaaggaggtacggttaccgggtacccggtaaccggttaaccgttacgttacgtaacgtacggtaacggtacggtaccgggttaccgggtaaccggaaccgggtaaccgg

SEQ ID NO: 379944 - DNA, 558 bp, Homo sapiens
  misc_feature: GZ8MTXP01DPCY3.13.76.G10.1.454.CMB.2.raw
  modified_base (248)..(248): a, c, t, g, unknown or other
  modified_base (367)..(367): a, c, t, g, unknown or other
  modified_base (380)..(380): a, c, t, g, unknown or other
  modified_base (402)..(402): a, c, t, g, unknown or other
  modified_base (442)..(442): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcngcctctgggtcaccgtcagtcacacctacatgagctcggggtcccgccgaggcctccgaggggaagggggctggagtgcgtctttcttttatttatagtagtggtagtacatactccgnagaactccgtggngggccattcaccatctccaganacaattccaagaacacgtcttgtttctacaaaatgaaacncgccgtggagaacgccgaatcgacgtacggtcgtgttattacgtgtggaacgagagagttcggggacccagttaacgttcacggctagcgggacgtcgacggggccaaggggtccc

SEQ ID NO: 379945 - DNA, 529 bp, Homo sapiens
  misc_feature: GZ8MTXP01AXXSA.13.76.G10.1.454.CMB.2.raw
  modified_base (488)..(488): a, c, t, g, unknown or other
  modified_base (516)..(516): a, c, t, g, unknown or other
tcagtcacgtactacacgaccggtgctcgatttagtcactcatacagggggagaggagcccagcactgggattccgaggtgtttccattcggtgatcagcactgaacacagaggactaaccatggagttttggctgagctgggttttccttgttgctattttaaaggtgcccagtgtgaggtgcagctggtggagtcgtgggggaggcttggtcaaggccgggggagtccctgagactctcctgtgaagcctcaacattcacttttgctcgtgcctgggtgaccgtgggtccgccgaggctccgaggggaagggctggagtggattggccatataaggacagacctaagtggcgcgacacgcacactaccttgaaactccgtcaaagacagattcatcatctcgagaggtgattccgaacaacacggtgtctctccatatggagcagcctagaaatcgagacacagcctatattaactgttgcagtgngttcgggccacgaaccacgtctttgggngttggtgcgtccg

SEQ ID NO: 379946 - DNA, 530 bp, Homo sapiens
  misc_feature: GZ8MTXP01DEPVF.13.76.G10.1.454.CMB.2.raw
  modified_base (328)..(328): a, c, t, g, unknown or other
  modified_base (469)..(469): a, c, t, g, unknown or other
  modified_base (502)..(502): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgcaggctccgaggggaggggctggagtgcgttcttnttttattatagtagtggtagtacatactcgcagaactccgtgacggggcctattcaccatctccagagacaattccaagacacgtcttgtttctacaaatgaaacagcctagagagccgatcgacacggcctgtattacgngtgcgagagcgcgggaccagttaacgttcacgntagcggacgtcgcgggaacgaacggccg

SEQ ID NO: 379947 - DNA, 549 bp, Homo sapiens
  misc_feature: GZ8MTXP01BU0MT.13.76.G10.1.454.CMB.2.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataaattggacagataaatatacttctgtatcagcagagtcagccagtcccctgtgcgtgtcatctatcaagatacgaccaagccggccctacgacgggactcccccctggacgcgtacttcctacgtcggcctccaaacgtcgtacgggaactcacgccactctacgaccatccgacggaccgggaccccaggacctagtggatggaggctagtaacttatacgtgtccgagggcgtagggacagcacgcaacgtcgccgtcttagtcgtacttacgggacttcgggaaccacgggttaacacccggttacaacggtcaacggaaccccg

SEQ ID NO: 379948 - DNA, 482 bp, Homo sapiens
  misc_feature: GZ8MTXP01DEO3T.13.76.G10.1.454.CMB.2.raw
  modified_base (234)..(234): a, c, t, g, unknown or other
  modified_base (417)..(417): a, c, t, g, unknown or other
tcagtcacgtactacacgaccggtgctcgatttagtcactcatacaggggaggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggancagctccaacattggggcacattatgatgtacactggtaccagcagtttccaggagcaggtcccagactcctcatcaatacgtaacaacaatcggcccgcaaggggtccctgaccgaattctctgggctccagtctggcactcagcctcctgtcatcactgggctcgagctgagatgagctgnttattctgccaagtccttatgacagcagccttgaagtgcttcggtagttcggcgggggcccaagg

SEQ ID NO: 379949 - DNA, 506 bp, Homo sapiens
  misc_feature: GZ8MTXP01DJ823.13.76.G10.1.454.CMB.2.raw
  modified_base (427)..(427): a, c, t, g, unknown or other
  modified_base (445)..(445): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggacagaataaatatacttcctggtatcagcagaagtcaggccagtcccctgtgctggtcatctatcaagatgccaagcgccctgagggactccccctgagcgtattctctggctccaactcgtgggaactcagccactctgaccatcagcggacccaggctagtgatgaggctagacttattacgtgtcaggcggtaggacngcaggcaactcgcccgtnttagtgtcgttacggacgttgggaaccaagggtccaccgtcttaagtccgaacgaaccccg

SEQ ID NO: 379950 - DNA, 552 bp, Homo sapiens
  misc_feature: GZ8MTXP01CYQA7.13.76.G10.1.454.CMB.2.raw
  modified_base (389)..(389): a, c, t, g, unknown or other
  modified_base (394)..(394): a, c, t, g, unknown or other
  modified_base (454)..(454): a, c, t, g, unknown or other
  modified_base (481)..(481): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtcccgccaggctccgagggaaggggctggagtgcgtcttctttatttatagtagtgtagtacatactcgcagaactccgtgacgggccgattcaccatcncaganacaatccaaagaacacgcttgtttcttacaaatgaacagccgtagagacgccgatcgacncggaccgtgtatactggtgcgtagagngttcgggggaccccaggaaacgttcacggctagtcgggacgtcgttcgggggaacccaagggggaaccccg

SEQ ID NO: 379951 - DNA, 612 bp, Homo sapiens
  misc_feature: GZ8MTXP01EB2JC.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggtttccttgttgctattttaaaggtgcccagtgtgaggtgcagctggtggagtctggaggaggcttgatccagccgtggggggtccctgagactctcctgtgcagcctctgggttcaccgtcagtcacacctacatgagcgtcgggtccgccgaggcctccgaggggaagggggctgggagtgtcgttctttcttttatttagttagtagtggtagtaccatactccgcagaactcgtggacgggccgattcacatctccagacgaacaataccaaagaacctacgtctttgtttactacaaaatgaaacagcccgtaggaacgacgaccgatcggaccgacggtccgttagtaacttacgtggtggaacggaaggacgaggttccgggggacccctaacgggaacgtttcgacggtcttaagtcgggtaaccgtcgggttacgggggaacccgttaacgggaacccg

SEQ ID NO: 379952 - DNA, 565 bp, Homo sapiens
  misc_feature: GZ8MTXP01C3CW8.13.76.G10.1.454.CMB.2.raw
  modified_base (250)..(250): a, c, t, g, unknown or other
  modified_base (269)..(269): a, c, t, g, unknown or other
  modified_base (379)..(379): a, c, t, g, unknown or other
  modified_base (415)..(415): a, c, t, g, unknown or other
  modified_base (433)..(433): a, c, t, g, unknown or other
  modified_base (436)..(436): a, c, t, g, unknown or other
  modified_base (441)..(441): a, c, t, g, unknown or other
  modified_base (444)..(444): a, c, t, g, unknown or other
  modified_base (446)..(446): a, c, t, g, unknown or other
  modified_base (448)..(448): a, c, t, g, unknown or other
  modified_base (450)..(450): a, c, t, g, unknown or other
  modified_base (453)..(453): a, c, t, g, unknown or other
  modified_base (463)..(463): a, c, t, g, unknown or other
  modified_base (485)..(485): a, c, t, g, unknown or other
  modified_base (487)..(487): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcgtggttttcctgttgctatttaaagtgccagtgtgaggtgcagctggtggagtcgtggaggaggcttgatccagccgtgggggtccctgagactcgtcctgtgcagcctntgggtcaccgtcagtcacncctacatgacgcgtcgggccccgcgacggcctaccggagggggaaggggtccgtagggagtcggtcgttcttttcttttatttagtagtagtggtaataccatactcganagtaacctcgtggcgggcctattccacatcacaganacaatcaaagacacgttnttntacanaanananancgngagagacgangacgacgtcgtcgtatacgtgngngagagacggacggaccgaacgttaacgttacgttacgtaagtagtcggcggtcggttacgggtaacggaacggaaccg

SEQ ID NO: 379953 - DNA, 564 bp, Homo sapiens
  misc_feature: GZ8MTXP01D2W1V.13.76.G10.1.454.CMB.2.raw
  modified_base (248)..(248): a, c, t, g, unknown or other
  modified_base (275)..(275): a, c, t, g, unknown or other
  modified_base (334)..(334): a, c, t, g, unknown or other
  modified_base (357)..(357): a, c, t, g, unknown or other
  modified_base (362)..(362): a, c, t, g, unknown or other
  modified_base (374)..(374): a, c, t, g, unknown or other
  modified_base (396)..(396): a, c, t, g, unknown or other
  modified_base (496)..(496): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagcgtggtttctgtgctatttaaagtgccagtgtgagtgcagctggtggagtctggaggaggcttgatccagcctggggggtccctgagactctcctgtgcagcctntgggttcaccgtcagtcacaccctaanatgagcgtcgggccgccgaggcctacggagggggaaggggctgggagtgtcgttctttnttttattagtagtagtggtatanatacnccgacagctcgnggacgggcatcacatcacaganactaattaccaaagaacacgtcttagttacttactaaataacgaacgaacgtacgtacgagacgacgacgtacgacgacggtcgtagttattacgtgtgngagaggagtacgggaccgacgttaacgtaacgtacgtaacgtagtacggacggtcggttcgggaacgg

SEQ ID NO: 379954 - DNA, 557 bp, Homo sapiens
  misc_feature: GZ8MTXP01C5E5Z.13.76.G10.1.454.CMB.2.raw
  modified_base (390)..(390): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggttcaccgtcagtcacacctacatgagctgggtccgccaggctccgagggaggggctggagtgcgtcttcttttatttatagtagtggtagtaccatactcgcagaactccgtggaggggccgattcaccntctccagagacaattccaagaacacgtcttgtttcttacaaatgaaacagccgtgagagccgatcgacgacggtccgtgtattacgtgtgcgagagacgttcggggacccaggttaaacgttcacggctagtcgggacgtcggttcggggcccgaaggggaaccccg

SEQ ID NO: 379955 - DNA, 695 bp, Homo sapiens
  misc_feature: GZ8MTXP01BP0GB.13.76.G10.1.454.CMB.2.raw
  modified_base (294)..(294): a, c, t, g, unknown or other
  modified_base (475)..(475): a, c, t, g, unknown or other
  modified_base (539)..(539): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagctgggtcccnccgaggcctccgaggggaggggctggagtgcgtcttcttttattatagtagtggtagtaccatactccgcacgtaacctccggtggacggggcccgtattcccgacctactcctacccaagagaacctaacttacccaaagaacccacggtctttagtttaccttacaaaattcggaaacncggcctaggaacggacgacccgaatcggaaacccgacgggtacccgttagtaaacgtttaccgngggttacggaaccgggtaaggaacgggtacgggttccggggggaacccccctaaacggggttaaacccggttttacaacccgggtccgttaaaggtcggggtaaccccgggtttcgggaccggggggtaaccccgaaacggggggtaaccccccgg

SEQ ID NO: 379956 - DNA, 500 bp, Homo sapiens
  misc_feature: GZ8MTXP01EFKGO.13.76.G10.1.454.CMB.2.raw
  modified_base (295)..(295): a, c, t, g, unknown or other
  modified_base (323)..(323): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataaatggcagataaatatacttcctggtatcagcagaagtcaggccagtcccctgtgctggtcatctatcaagntgccaagcggccctgaggactcccccgngagcgattctctggctcaaactctgggaactcagccactctgacatcagcgggaccaggctatgatgagctgacttatacgtgtcaggcgtagggacagcagcaactcgcccgcttagtcgtcttcggacttcggggaaccaagggtccaccggtccttaaaggtccaagaaccccg

SEQ ID NO: 379957 - DNA, 548 bp, Homo sapiens
  misc_feature: GZ8MTXP01CCYDX.13.76.G10.1.454.CMB.2.raw
  modified_base (425)..(425): a, c, t, g, unknown or other
  modified_base (443)..(443): a, c, t, g, unknown or other
  modified_base (466)..(466): a, c, t, g, unknown or other
  modified_base (498)..(498): a, c, t, g, unknown or other
tcagtcacgtactacacgaccggtgctcgatttagtcactcatacaggggggagaggagcccagcactgggattccgaggtgtttccattcggtgatcagcactgaacacagaggactaaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagctgggtccgccaggctccgaggggaagggctgggagtgcgtcttcttttattatagtagtggtagtacatactcgcagactccgtgcgggccagttcacatctcagagacatcaagacacgtcttgtttctacaaatgaacngctggagagccgatgacncggccgtgtatctgtgcgaaggngaggtcggggacccaaacggtacgtttaccgngcctaagcgggaaccgtcggtgggggaccctaacggggccgtaacccggg

SEQ ID NO: 379958 - DNA, 629 bp, Homo sapiens
  misc_feature: GZ8MTXP01DT7OX.13.76.G10.1.454.CMB.2.raw
  modified_base (517)..(517): a, c, t, g, unknown or other
  modified_base (573)..(573): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtcgggtcccgcgaggctccgaggggaggggctggagtgcgttcttcttttattatagtagtggtagtaccatactcgcagaactccgtggacgggccgattcaccatctccagacactaacgttaccaaagaacctacgtctttgtttacctaacaaattcggaaaacctggacccgttaggaacggacgacccgaatccgaaccgaccgggtaccgttagtaattaccgnggtgaacggaagaggtacgttcgggggaacccctaacgggttaaacgttcgaacgngttaaacgtcggggaacccgttggaccgggggaacccgaaacgggggtaacccccg

SEQ ID NO: 379959 - DNA, 545 bp, Homo sapiens
  misc_feature: GZ8MTXP01CDQNZ.13.76.G10.1.454.CMB.2.raw
  modified_base (362)..(362): a, c, t, g, unknown or other
  modified_base (474)..(474): a, c, t, g, unknown or other
tcagtcacgtactacacgaccggtgctcgatttagtcactcatacaggggcggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagctgggtccgccaggctccgaggggaggggctggagtgcgttcttcttttattatagtagtggtacgtacatactccgnaagactccggtgaggggccattccacatcctccagagacaattaccaagaacacgtcttgtttcttacaaatgaacaggcctagagagccgatgacacggccgtgtattacngtgcgagagagtcgggggcccacggaaccgttactaacgctaagtcggacgttcgtcggggccgaacgggg

SEQ ID NO: 379960 - DNA, 750 bp, Homo sapiens
  misc_feature: GZ8MTXP01DXPVJ.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatccagccgtggggggtccctgagactctcctgtgcagcctcgtgggtcaccgtcagtcacacctacatgagcgtcgggtcccgccgaggcctccggaaggggaagggggcgtgggagtcgtcgttctttacttttaagtttagtagttaggtggtagtaccattactccgacacgtaaccgtccggtgggacggggccctattaccaaccctactcctacccgaaggaacaaacctaaacttacccgaaaacggtaaaaccctacccggttcgtttacgtttttaccccttaaaaacgtaaaacgtacgaaaccgtcgtaccgggtaaggaacggaccgaccgtaagtaccggaccggtacccggttaccgttagttaacgttacgtaggtacggaacggtaaggttacgggtaaccgggttacccggggtaaaccccgtaaacggttaaaaccgttacgttaccggtaacgttacggtaaccggggtaccggtccgggttaccgggggaacccggttaaaccgggtaaccccg

SEQ ID NO: 379961 - DNA, 536 bp, Homo sapiens
  misc_feature: GZ8MTXP01DR6S0.13.76.G10.1.454.CMB.2.raw
  modified_base (170)..(170): a, c, t, g, unknown or other
  modified_base (335)..(335): a, c, t, g, unknown or other
  modified_base (462)..(462): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctctaggaaataattggcagataaatatactctggtatcagcagaagtcaggccagtcccctgtcgctggtcatctatcaagatgaccaagccggccctgagggactcccccctggagcgtattcnctggcctccaaactcgtaggggaacctcgacgcccactctacgaccatcagccgggacccaggctagcgatgagcgtagacttattacgtgtcgagggcgtagggacagcacggcaactcgcccgtnttacgtcgttccgttacgggacttacggggaacccaagggtcccaccgtaccgttaagtccgaacggaaccccg

SEQ ID NO: 379962 - DNA, 604 bp, Homo sapiens
  misc_feature: GZ8MTXP01ECNFN.13.76.G10.1.454.CMB.2.raw
  modified_base (399)..(399): a, c, t, g, unknown or other
  modified_base (438)..(438): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtcccgccaggcctccgaggggaaggggctggagtgcgtcttcttttattatagtagtgtagtaccatactccgcagaactccgtggacgggccattcaccatctccaganacaattccaaagaacacgcttgtttctacaaatgaaacncgcgtagagacgaccgatcgacgaccggtccgttagttaacttacgtggtgaacggaaggaggtacggttccggggaacccctaaacggttaaaccgtttacgttaccgtaacgtaggtcgggtaccggtcgggttacgggggtaacccgaaacggggtaaccccg

SEQ ID NO: 379963 - DNA, 632 bp, Homo sapiens
  misc_feature: GZ8MTXP01AF2ZJ.13.76.G10.1.454.CMB.2.raw
  modified_base (198)..(198): a, c, t, g, unknown or other
  modified_base (277)..(277): a, c, t, g, unknown or other
  modified_base (290)..(290): a, c, t, g, unknown or other
  modified_base (317)..(317): a, c, t, g, unknown or other
  modified_base (330)..(330): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagtttttggctgagcggtggtttcgtgtaggcgtatttaaaagtgccagtgtgaggtgcagctggtggagtntggaggaggcttgatccagccgtggggggtccctgagctctcctgtgcagcctctgggttcaccgtcagtcacacctantgcgcgtcggccncgaggccgacggaggggagggcgtggngtgtcgttctttnttttatttagttagttagtagtagtacctactacgtccgcgacgtaaccgtccggtcggacgggaccgtactactacctactactacgacgaacgaactaactaaccgaaacgaacgtacgtacgttacgtttactaactaacgtaacgtaacgtacgacggtacgacgacgacgacgtacgacgaccggtaccgttacgttacgttacgtcgtggaaggagaggtacggacggtaccgtaacgttaaccgttacgttacgtcgtagtaacggtcggtcggttacggtaaccgaacgtaacg

SEQ ID NO: 379964 - DNA, 685 bp, Homo sapiens
  misc_feature: GZ8MTXP01EWB7M.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtcgggggtccctgagactctcctgtgcagcctcgtgggttccaccgtcacgtcacacctacatgagcgtcgggtcccgcgacggctccggagggaggggcgtggagtgtcgtctttcttttattatagtagtaggtagtaccatactccgcacgactcggtggacggggccgtattccaccgtactcctaccgagagtaaccaacttaccaaaggaactaaccggtctttacgtttaccttaacaaagtcgaaacctacgggtaccctagggaagaaccggcccgtaagtccggaaccgtacccgggtacccgttagttacgtttaccgtgggttcggaaccggaagggttaacgggacgggttacccgggggacccctaaacgggttaaaccgttaccgttaccgaacgttaggtcggggaaccgttcggggacggggaacccgttaaaccgggggtccccg

SEQ ID NO: 379965 - DNA, 540 bp, Homo sapiens
  misc_feature: GZ8MTXP01E46CN.13.76.G10.1.454.CMB.2.raw
  modified_base (432)..(432): a, c, t, g, unknown or other
  modified_base (442)..(442): a, c, t, g, unknown or other
  modified_base (460)..(460): a, c, t, g, unknown or other
  modified_base (473)..(473): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctctgtgcagcctgtgggttcaccgtcagtcacacctacatgagcgtgggtcccgccaggcctccgaggggaaggggctggagtgcgttcttcttttattatagtagtggtagtacatacctccgcagctccggtggacggggccattcacatctaccagagacaattccaaagacacgtcttagttctanaaatgaaacngcctgagagccgatgacncggcctgtacttngtgcgagagacgtcggggacccaacggaacgtttcacgtctaagtcgggacgttcgcggggaacccg

SEQ ID NO: 379966 - DNA, 620 bp, Homo sapiens
  misc_feature: GZ8MTXP01EA2CI.13.76.G10.1.454.CMB.2.raw
  modified_base (294)..(294): a, c, t, g, unknown or other
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagcccacctcagtgtccgtgtccccaggacagacagccagcatcacctgctctaggaaataatggcagataaatatacttctggtatcagcagaagtcaggccagtcccctgtgctggtcatctatcaagntgccaagccgaccctgacgggacctcccgtagacgcgtattccgctcggcctacccgaaacttccgtacggggaaccttcgaaacgccctaacttccacgaaccctattacccgaaacgggcccggggaaccccagggcctaagtcgggaattggacgggggtccttaggtaacttagtttaaccgtggttaccgaaggggtcggttacggggaaccagccgagccgtaacgttcggccccggttattacgttcggttaccgtttcgggaaacgttcgggaaacctaacggggttccacccggttacctaacggttccaacccggg

SEQ ID NO: 379967 - DNA, 578 bp, Homo sapiens
  misc_feature: GZ8MTXP01DS6LP.13.76.G10.1.454.CMB.2.raw
  modified_base (392)..(392): a, c, t, g, unknown or other
  modified_base (395)..(395): a, c, t, g, unknown or other
  modified_base (400)..(400): a, c, t, g, unknown or other
  modified_base (426)..(426): a, c, t, g, unknown or other
  modified_base (436)..(436): a, c, t, g, unknown or other
  modified_base (477)..(477): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgcttaattttaaaaggtgcccagtgtgaggtgcagctggtggagtctggaggaggcttgatccagccgtgggggtccctgagactctcctgtgcagcctcgtgggtcaccgtcagtcacacctacatgagcgtgggtcccgccgaggcctccgaggggaaggggctgggagtgcgttctttctttttattatagtagtggtataccatactcgcagactcgtggagggccatcacntcncaganacaatccaagacacgtcttgttctanaaatgaaacncgcgtagagacgcgatcgacgacggtcgtagttacttacgngtgaacgaagaggtacggttccggggacccctaacggttaaccgttcacgtcgttaggtcgggtaccgtcgggttacgggggaacccgaaacggggtcccc

SEQ ID NO: 379968 - DNA, 653 bp, Homo sapiens
  misc_feature: GZ8MTXP01CFHGT.13.76.G10.1.454.CMB.2.raw
  modified_base (198)..(198): a, c, t, g, unknown or other
  modified_base (278)..(278): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagcgtggtttcgtgtaggctatttaaagtgccagtgtgaggtgcagctggtggagtntggaggaggcttgatccagccgtgggggtccctgagactctcctgtgcagcctctgggttcaccgtcagtcacaccctanatgacgcgtcggccgacgacggtccgacggagggggagggcgtgggacggtcgtcgttcgtttacttttatttagttagttaggtacggttagtacgtacgtaccgtccgaacgacgtcgtcggtacgggacgggtaccgtactacactactactacgagacgaactaactaacgaaacgaacgtacgtacgttacgttacttaactaaactaacgaacgtacgtacgtacgacgacgacgacgtacgacgtaccggtaccgtacgttacgttacgtggtcggttacggtaggaggtacggtacgggaccggttaccggttaaccgtaaccgtacgtaacgtacgtacggttacggtcgggttcgggtaaccggg

SEQ ID NO: 379969 - DNA, 583 bp, Homo sapiens
  misc_feature: GZ8MTXP01DD4GQ.13.76.G10.1.454.CMB.2.raw
  modified_base (395)..(395): a, c, t, g, unknown or other
  modified_base (400)..(400): a, c, t, g, unknown or other
  modified_base (437)..(437): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtcgggtcccgccaggctccgaggggaaggggctggagtgcgtctttcttttatttatagtagtggtagtaccatactcgcagaactccgtggagggccattcacatcncaganacaatccaagacacgtctgtttctacaaatgaaaccngcgtagagacgcgatcgaccgacggtcgttagttattacgtggtggaacgaggaggtacggttccgggaaccctaaacggttaaccgttcgaccggtcttaggtcgggtaccgtcgggttacggggaacccgaacggggtaacccg

SEQ ID NO: 379970 - DNA, 637 bp, Homo sapiens
  misc_feature: GZ8MTXP01EX0W5.13.76.G10.1.454.CMB.2.raw
  modified_base (411)..(411): a, c, t, g, unknown or other
  modified_base (514)..(514): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtctggaggaggcttgatccagccgtcgggggtccctgagactctcctgtgcagcctctgggtcaccgtcagtcacacctacatgagcgtcgggtccgccgaggcctccggaggggagggggctgggagtgtcgttctttctttttattatagtagtggtagtaccatactcgcacgaactcggtggacggggccattccactactctccaganaactaactaccaaagaacacgtctttagtttacctaacaaagtcgaaacacggccttagaaggacgaccgaatcgaaccgtaccggtccgtagttaacttcgnggtcgaacggaggttacggacggttaccgggggacccctaacggttaaaccgtttccgttacgggtcttaaggtcgggtaaccggtcggttacgggggaacccgttaaacgggggtaaccccg

SEQ ID NO: 379971 - DNA, 580 bp, Homo sapiens
  misc_feature: GZ8MTXP01B62HL.13.76.G10.1.454.CMB.2.raw
  modified_base (291)..(291): a, c, t, g, unknown or other
  modified_base (358)..(358): a, c, t, g, unknown or other
tcagtcacgtactacacgaccggtgctcgatttagtcactcatacaggggggagaggagcccagcactgggattccgaggtgtttccattcggtgatcagcactgaacacagaggactaaccatggagttttggctgagctgggttttccttgttgctatttaaaggtgcccagtgtgaggtgcagctggtggagtctggaggaggcttgatccagccgtgggggtccctgagactctcctgtgcagcctcgtgggttcaccgtcagtcacaccacatgagcgtgggtccnccaggctccgaggggagggctggagtgcgtcttcttttatttatagttagtggtagtacatactcgnagactccggtgcggggccattcaccatctcagagacaattccaaagaacacgtcttgtttactacaaatgaacagaccctgggaagacgcccgagtacgacgaccgggccgtagtacttacgtgtcggcgaagagaggtcggggccctaaacggtaacgttacgttcgacttaagtcgggaacggtcggtcgggggaccctaacgggggaaccctaaccggg

SEQ ID NO: 379972 - DNA, 558 bp, Homo sapiens
  misc_feature: GZ8MTXP01DZZHF.13.76.G10.1.454.CMB.2.raw
  modified_base (358)..(358): a, c, t, g, unknown or other
  modified_base (381)..(381): a, c, t, g, unknown or other
  modified_base (427)..(427): a, c, t, g, unknown or other
  modified_base (439)..(439): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctgggggtccctgagactctcctgtgcagcctctgggttcaccgtcagtcacacctacatgagctgggtcccgccaggctccgagggaggggctggagtgcgtctcttttatttatagtagtggtagtacatactccgnagaactcgtgagggccatcacanctcagagacaattccaaagaacacgcttgtttctacaaatgaaacncgccgtagagancccggaatcgaacacgggaccgtgtaattactgtgaacgagagagttcgggggaccccaagaaccgtttcacggctaagtcggggaaccgtcgttacgggggcccaaagggggaacccc

SEQ ID NO: 379973 - DNA, 583 bp, Homo sapiens
  misc_feature: GZ8MTXP01ALY2H.13.76.G10.1.454.CMB.2.raw
  modified_base (363)..(363): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtcccgccaggcctccgaggggaagggggctgggagtgcgtcttcttttatttatagtagtggtagtaccatacnccgcagaactccgtggacggggccattccacatctccagagacaattccaaagaacacgtcttgtttctacaaatgaaactgcctggagagcccgaagtcgaaccgacgggtcccgttgtattaccgtggtgaacggagttacggaggttcgggggaccccaaggttaaccgttcacgctagtgggacgttcggttacgggggcccaaagggggaacccc

SEQ ID NO: 379974 - DNA, 588 bp, Homo sapiens
  misc_feature: GZ8MTXP01ELBY3.13.76.G10.1.454.CMB.2.raw
  modified_base (332)..(332): a, c, t, g, unknown or other
  modified_base (424)..(424): a, c, t, g, unknown or other
  modified_base (433)..(433): a, c, t, g, unknown or other
  modified_base (476)..(476): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagcacacctacatgagctgggtccgccaggctccgaggggaagggctggagtgcgttcttnttttattatagtagtggtagtacatactccgacagctccgtgacggggccgattcacatctccagagacaattcaaagacacgctgttctanaaatgaacngcctagacgagccgatcgaacgacggtccgtagttacttacgnggtcgacggaaggaagacggtacgggggaccccttaaacggttaaaaccgtttaaccgtaacgtaaccgttaaggtcggggttaaccggtccggttaacggggggaaccccg

SEQ ID NO: 379975 - DNA, 540 bp, Homo sapiens
  misc_feature: GZ8MTXP01AC6XA.13.76.G10.1.454.CMB.2.raw
  modified_base (238)..(238): a, c, t, g, unknown or other
  modified_base (333)..(333): a, c, t, g, unknown or other
  modified_base (414)..(414): a, c, t, g, unknown or other
  modified_base (453)..(453): a, c, t, g, unknown or other
  modified_base (473)..(473): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataatggacaagaataaatntacttcctggtatcagcagaagtcaggccagtcccctgtgctggtcatctatcaaagatgaccaaggccggccctcgagggactcccccctggancgtattctctcggccttaccaaactgtacgggaactcaacgcccactcgtacaccatccgaggacccggaccaggtctagnggatgaaggctagtactattacgtgcgaggcgtaggacnggcagtcaactcgacccgtnttagtcgtacgttacggaacgttacgggaaccaacggttcacccggttacacgtcgaacgaaccccg

SEQ ID NO: 379976 - DNA, 448 bp, Homo sapiens
  misc_feature: GZ8MTXP01AXTLW.13.76.G10.1.454.CMB.2.raw
  modified_base (443)..(448): a, c, t, g, unknown or other
tcagtcacgtactacacgaccggtgctcgatttagtcactcatacagggtgtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctggggccaagggaccacggtcaccgtctcctcagcctccaccaagggccccatcggtcttccccctggccgccctgctccaggagcacctccccgagagcacagcggccctgggctgcctggtcaagggactactcctagtacgtgactgagcgggctggcaaggcgcataggnnnnnn

SEQ ID NO: 379977 - DNA, 597 bp, Homo sapiens
  misc_feature: GZ8MTXP01CU6IM.13.76.G10.1.454.CMB.2.raw
  modified_base (387)..(387): a, c, t, g, unknown or other
  modified_base (433)..(433): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagctgggtcccgccaggctccgagggaagggggctggagtgcgtcttctttatttatagtagtgtagtacatactcgcagaactcgtgacgggcgattcaccatcncagagacaatccaaagacaacgtcttgtttactacaaagtcaaacncgcctaggagaacgcccgaattcggaaccaccgggtccgttggttaaattaccgtaggtggaacgaaggaggtaacgttcgggggaccccaacgggttaaaccgtttacgacggtaacttaagcggtaacggtcgttacgggggaaccccaaaggggaaccccg

SEQ ID NO: 379978 - DNA, 568 bp, Homo sapiens
  misc_feature: GZ8MTXP01DDJA5.13.76.G10.1.454.CMB.2.raw
  modified_base (392)..(392): a, c, t, g, unknown or other
  modified_base (478)..(478): a, c, t, g, unknown or other
  modified_base (488)..(488): a, c, t, g, unknown or other
  modified_base (494)..(494): a, c, t, g, unknown or other
  modified_base (520)..(520): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtggggggtccctgagactctcctgtgcagcctctgggtcaccgtcagtcacacctacatgagcgtgggtcccgcaggctccgagggaggggctggagtgcgttcttcttttatttatagtagtggtatacatactcgcagactcgtggagggccatcaccatctaccanacgacaacttccaaagacacgtcttgtttctacaaatgaacacgcgtagaagacgccgaatcgaccgacggtccgttatacttacngtgaacgagnggtaanccgggggaccccaagttaaaccgttnacccggaatagtgggacgttcggcggggaacccttaagggggaacccc

SEQ ID NO: 379979 - DNA, 569 bp, Homo sapiens
  misc_feature: GZ8MTXP01EESKS.13.76.G10.1.454.CMB.2.raw
  modified_base (440)..(440): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggtcaccgtcagtcacacctacatgagctgggtccgccaggctccgaggggaaggggctggagtgcgtcttctttttattattagtagtggtataccatactccgcagaactccgtggacggggccgattcaccatctccagagacaattcccaaagaacacgcttagtttctacaaatgaaacngccgtgagagccgatcgacgacggccgtgtattacgtgtggcgtaagaggagttcgggggaccccaggttaaaccgttcttacggcttaagcgggtacgtcgttcgggggaacccaagggggaaccccg

SEQ ID NO: 379980 - DNA, 561 bp, Homo sapiens
  misc_feature: GZ8MTXP01BVHOI.13.76.G10.1.454.CMB.2.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtcccgtgtccccaggacagacagccagcatcacctgctctaggaaataattggacagataaatatacttcctggtatcagcagaagtcaggccagtcccctgtgctggtcatctatcaagatgaccaagccggccctacgacggggactcccccccgtggacgtcgtacttccgtctcgggcctacccaaacgttcgtacgggaacctcgacgcccactctcgaccatcgacggaccgggacccaggcctagtggataggacggcgtagacttattacgtgtcgaggcggtacggggactaggcagcaacgtcgccgtcttagtcgtcttacgggacgttacgggaacctagggtcctaccggtcgttaacgtccgaacgaaccccg

SEQ ID NO: 379981 - DNA, 514 bp, Homo sapiens
  misc_feature: GZ8MTXP01DK306.13.76.G10.1.454.CMB.2.raw
  modified_base (423)..(423): a, c, t, g, unknown or other
  modified_base (455)..(455): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataatggacagaataaatatacttcctggtatcagcagaagtcaggccagtcccctgtgctggtcatctatcaagatgccaagcggcccctgagggactcccccctgagcgattctctgcctccaactctgggaactcagcccactctcgaccatcagccgggacccagggctagtgatagacggcgtgacttattacgtgtcgnggcggtgggacagcacggcaacgtgccccgtnttagtcgtcttacgggacttcgggaaccaaggtccaccgtccttagccaacgaaccccg

SEQ ID NO: 379982 - DNA, 624 bp, Homo sapiens
  misc_feature: GZ8MTXP01BQCJT.13.76.G10.1.454.CMB.2.raw
  modified_base (543)..(543): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagtttggctgagctgggttttccttgttgctattttaaaggtgccagtgtgaggtgcagcgtggtggagtcgtggaggaggcttgatccagccgtgggggtccctgagactctcctgtgcagcctcgtgggtcaccgtcagtcacactacatgacgcgtcggtccgccgaggccgtaccggaggggaacggggcgtagggaggtgtcgttctttacttttatttagtaggtagtggtagtaccatactccgacacgtaacgtccggtggacggggcctacttaccacctactcctacccgaagaacaactaaacttacccgaaaggaactaccgtcttacgtttactaacaaaacttcggaaaactcgaccgtagaacgacggacctagcgaacgacggtaccgttgtactacgtgnggcgagaggtcgcggggaaccctagttaaacgttcgaacgcgtagtcggcggtcggacggggaacccgaaggggaaccccg

SEQ ID NO: 379983 - DNA, 571 bp, Homo sapiens
  misc_feature: GZ8MTXP01EG010.13.76.G10.1.454.CMB.2.raw
  modified_base (471)..(471): a, c, t, g, unknown or other
  modified_base (479)..(479): a, c, t, g, unknown or other
  modified_base (497)..(497): a, c, t, g, unknown or other
  modified_base (499)..(499): a, c, t, g, unknown or other
  modified_base (506)..(506): a, c, t, g, unknown or other
  modified_base (537)..(537): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggttcaccgtcagtcacacctacatgagcgtgggtccgccaggcctccgaggggaggggctggagtgcgtcttctttttattatagtagtgtagtacatactccgcagaactccggtggacggggccgattccaccatcctaccagaagaacaaattcccaaagaaacacgtcttagtttcctacaaaattcgaaactaggccttaggaagaancccgtaancgacgacggtctgtatgngngcgaagnggacgcgggacctaacggttacgttcacgtntagtcggtcgtcggacggggaaccgaacgggccg

SEQ ID NO: 379984 - DNA, 599 bp, Homo sapiens
  misc_feature: GZ8MTXP01AXNNA.13.76.G10.1.454.CMB.2.raw
  modified_base (299)..(299): a, c, t, g, unknown or other
  modified_base (395)..(395): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctgggtggagtctggaggaggcttgatccagccgtgggggtccctgagactctcctgtgcagcctcgtgggttcaccgtcagtcacacctacatgagcgtgggtccnccgaggctccgaggggagggctggagtgcgttcttcttttattatagtagtggtagtacatactcgacagcgtcgtgggacggggccattccaccntcctaccgagacgacaacttaccaaagtaacacgtcttgtttaccttacaaattcggaaacaggtacctggaacgacggcccgaagtggaaccgacgggtccgtagttacttcgtggtcgcggtagaggacgtcgggggccccttaacggttaaccgtttaacgacgccgttaggtcgggacggttcggttcgggggaaccccg

SEQ ID NO: 379985 - DNA, 583 bp, Homo sapiens
  misc_feature: GZ8MTXP01D6XLU.13.76.G10.1.454.CMB.2.raw
  modified_base (400)..(400): a, c, t, g, unknown or other
  modified_base (418)..(418): a, c, t, g, unknown or other
  modified_base (497)..(497): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaatgtgcccagtgtgaggtgcagctggtggagtctggaggaggcttgatccagccgtgggggtccctgagactctcctgtgcagcctctgggttcaccgtcagtcacacctacatgagcgtcgggtccgccaggcctccgaggggaaggggctggagtgcgtcttctttatttatagtagtgtacgtacatactccgcaacgactccggtggacggggccattcacatctcaganacaattaccaaagaaccncgtctgtttctacaaaatcgaaacaggcctaggacgacgccgagtcgaaccgaccgggtccgttagttaactttaccgnggtcgacgaggagacgtcgggggaccccttaacgacgttaccaacggctaagcggtaccggttcgtcggggaacccgaaaccgggg

SEQ ID NO: 379986 - DNA, 542 bp, Homo sapiens
  misc_feature: GZ8MTXP01C56Q9.13.76.G10.1.454.CMB.2.raw
  modified_base (451)..(451): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttgggactgagctggattttcctttggctattttaaaaggtgtccagtgtgaagtgcagctggtggagtcgtgggggaggcttgggtacagcctggcaggtccctgagactctcctgtgcagcctctggattcactttgatgattatgccatgcacgtgggtccgcaagcctccgaagggggaagggcctgggagtggggtctcgagggttattaggttgggaattaggtggtagcaaagttagggctatgcggactcgtgtgagggccatcacatctcagacacaacgcaagaactccctgtatctgacaaatgaacngcctagacgagctgaggaacacgggccttgatttatgttagacaaaagtctaccctaaccccgttagtagtttttgggaagttggttaacg

SEQ ID NO: 379987 - DNA, 604 bp, Homo sapiens
  misc_feature: GZ8MTXP01ESMXP.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgccaggctccgagggaggggctggagtgcgtcttcttttattatagtagtggtagtaccatactccgcagaactccgtggacggggccgattccacctatctaccagacgacaattcccaaagaacacgcttgtttctacaaatcgaaacagcctaggacgacgccgaatcgacgacggtcccgtagtacttacgtgtggcgaagaggtaggttcgggggacccctaaacggttaaaccgtttacgaccggtcttaggtcggggtaaccgttcgggttacgggggtaaccccgaaaggggggtaacccccg

SEQ ID NO: 379988 - DNA, 525 bp, Homo sapiens
  misc_feature: GZ8MTXP01DQB9Z.13.76.G10.1.454.CMB.2.raw
  modified_base (290)..(290): a, c, t, g, unknown or other
  modified_base (404)..(404): a, c, t, g, unknown or other
  modified_base (432)..(432): a, c, t, g, unknown or other
  modified_base (439)..(439): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataatggcagataaatatactctggtatcagcagaagtcaggccagtcccctgtgctggtcatctatcaagntgaccaagccggccctgagggactccccccgtgagcgtattcctctcggcctacccaaactcgtacgggaacctcgacgcccactctgaccatcaggccgggacccaggctagngatgaggctgaacttatacgtgcgaggngaggacnggacagcaactcgccgcttacgtcgtcgttcgttacgttacggaacgacggtaacgtaccgtaccttacgtaaccgaacgaacccg

SEQ ID NO: 379989 - DNA, 638 bp, Homo sapiens
  misc_feature: GZ8MTXP01B6SQD.13.76.G10.1.454.CMB.2.raw
  modified_base (243)..(243): a, c, t, g, unknown or other
  modified_base (272)..(272): a, c, t, g, unknown or other
  modified_base (301)..(301): a, c, t, g, unknown or other
  modified_base (364)..(364): a, c, t, g, unknown or other
  modified_base (440)..(440): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcacgcccgcctcgagtcgtccgtcggggccccagggcaggaggtccaccatctcctgcacgtgggancagctaccaagtagtcgggacactattangatgtacacgtgaccagtctagttcaggngactacggtcccagacctcacatacaatacaaacacaacgtccgcccgaacgtacgggtcccngacctattcgtcgtcgcctacgtcgtctcggccaccgtcacgtccctccgtgccatccgacgtcgggcctaccggnggtcgtaggaggtagtgggtacggttcttaaggttacttttacgtttccgtaccggtaacccgttaacgttaacccgtttagtaacgcccgttaaacggcccgttacggttcccgttagggtaacggttccggtttaacgggtttcccgggggtcggggttaccccggggggaaccccgggggttaaccgttcccggg

SEQ ID NO: 379990 - DNA, 605 bp, Homo sapiens
  misc_feature: GZ8MTXP01BF4ZQ.13.76.G10.1.454.CMB.2.raw
  modified_base (499)..(499): a, c, t, g, unknown or other
  modified_base (511)..(511): a, c, t, g, unknown or other
tcagtcacgtactacacgaccggtgctcgatttagtcactcatacaggggggagaggagcccagcactgggattccgaggtgtttccattcggtgatcagcactgaacacagaggactaaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacaccacatgagctgggtcccgccgaggctccgaggggaaggggctgggagtgcgttcttcttttatttatagtagtggtagtacactactcgcagacctccggtggaacggggccgtattccaccactctccagagacaattccaaagaacacgtcttcgtttctaacaaatagaacagtcctaggggacgaacgccgatacgaccgacggtccgtagtacttaccgngtcggcgaaggngaggtccggggaccctaaacggtaacgttaccttacggttacctaaggacggtcggtacgggcggggaccgaaccggggaacccgtaacccggg

SEQ ID NO: 379991 - DNA, 646 bp, Homo sapiens
  misc_feature: GZ8MTXP01BCOLP.13.76.G10.1.454.CMB.2.raw
  modified_base (332)..(332): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggtcaccgtcagtcacacctacatgagcgtcgggtcccgcaggcctccgaggggaggggcgtggagtgcgttcttnttttattatagtagtggtagtaccatactcgcagtactcgtggacgggccgtattcacctactctaccagacgaactaattaccaaagaacacgtctttgtttaccttacaaagtcgaaactcggacctaggaacggacgacccggaatcggaaccgaccgggtacccgttagtaactttacgtggtcggaacggaaggaggtacgggttccgggggaacccctaaacgggttaaaccgtttacgttaccggtccttaaggtcgggtaacccggttcgggaccgggggaacccgttaaaccgggggtaaccccg

SEQ ID NO: 379992 - DNA, 504 bp, Homo sapiens
  misc_feature: GZ8MTXP01AXCR9.13.76.G10.1.454.CMB.2.raw
  modified_base (309)..(309): a, c, t, g, unknown or other
  modified_base (413)..(413): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataaattggcagataaatatacttcctggtatcagcagaagtcaggccagtcccctgtgctggtcatctatcaagatgccaagcggccctnagggactcccccctgagcgattctctggctccaaactctgggaactcagccactctgaccatccagcgggacccaggctagtgatgaggctgactatacgtgtnaggcgtagggcagcagcaatcgcccgtcttagtcgtcttcgggacttcgggaaccaagggttccaaccgtccgaacgtcgaacgaaccccg

SEQ ID NO: 379993 - DNA, 538 bp, Homo sapiens
  misc_feature: GZ8MTXP01CV5GF.13.76.G10.1.454.CMB.2.raw
  modified_base (365)..(365): a, c, t, g, unknown or other
  modified_base (394)..(394): a, c, t, g, unknown or other
  modified_base (411)..(411): a, c, t, g, unknown or other
  modified_base (430)..(430): a, c, t, g, unknown or other
  modified_base (472)..(472): a, c, t, g, unknown or other
  modified_base (474)..(474): a, c, t, g, unknown or other
  modified_base (476)..(476): a, c, t, g, unknown or other
  modified_base (506)..(506): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcgtgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagcgtgggtcccgcaggcctccgaggggaaggggctggagtgcgttctttctttatttagtagtagtgtagtaccatactcgnacgaactccgtgaggggccattcacatcnccagagacaatccaaanaacacgtcttgttcctaanaatagacacgcgtagagacgacagcgacgacgtctgtatagngngngagagacgcggaccaacgttacgttcacgntagtcggcgtcggacgggaaccgaacggtccg

SEQ ID NO: 379994 - DNA, 527 bp, Homo sapiens
  misc_feature: GZ8MTXP01BXPAN.13.76.G10.1.454.CMB.2.raw
  modified_base (471)..(471): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctatttaaaggtgccagtgtgaggtgcagctggtggagtctggaggaggcttgatccagccgtgggggtccctgagactctcctgtgcagcctctgggttcaccgtcagtcacacctacatgagctgggtccgcaggctccgaggggaagggctggagtgcgtctcttttattatagtagtggtagtacatactcgacagctccgtgaggggccgattcacatctccagagacaattccaaagacacgtctgttctacaaatgaacagtcctagagacgccgatgacacgggtccgtgtaattacgtggtgngagagagtcgggggacccagaacgtttcacgctagtggacgtcgttggggaacccg

SEQ ID NO: 379995 - DNA, 536 bp, Homo sapiens
  misc_feature: GZ8MTXP01DQ3O2.13.76.G10.1.454.CMB.2.raw
  modified_base (393)..(393): a, c, t, g, unknown or other
  modified_base (402)..(402): a, c, t, g, unknown or other
  modified_base (428)..(428): a, c, t, g, unknown or other
  modified_base (458)..(458): a, c, t, g, unknown or other
  modified_base (466)..(466): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagctgggtccgccaggctccgagggaggggctggagtgcgtcttcttttattatagtagtggtagtacatactccgcagaactccgtggagggccattcacatctcaganacatccaanacacgtcttgttctacaaatgaaacngcctgagagccgatgacacggctgtatcgngtgcgagngagttcggggacccagttaacgtttcacgctaagtcgggacgtcgttcgggggaaccttaaggggaaccc

SEQ ID NO: 379996 - DNA, 586 bp, Homo sapiens
  misc_feature: GZ8MTXP01ALM28.13.76.G10.1.454.CMB.2.raw
  modified_base (293)..(293): a, c, t, g, unknown or other
  modified_base (338)..(338): a, c, t, g, unknown or other
  modified_base (421)..(421): a, c, t, g, unknown or other
tcagtcacgtactacacgaccggtgctcgatttagtcactcatacaggggggagaggagcccagcactgggattccgaggtatttccattcggtgatcagcactgaacacagaggactcaccatggagttttggctgagctgggttttccttattactattttaaaggtgtccagtgtgaggtgcagttggtggagtctggaggaggcttggtccaggccgggggggtccctgagactctcatgtgcggcctcgtgggctcaccgtcaacaccaactacatgagctgggtccnccgaggctccgagggaagaggccggagtgggtctcagttatttangtcgacggtgccactattcaccgcagactcggtggaacggggccgttcaccgatctccagacgactactacaagaacacggtntatctacaatagaacgacctagagagtcgagtgacgacggtactcgtacttacgtgtagacgtaaagatcgcgaagacggacgggaccccgttaaggtcggggtccgttgggttgggttacgggtttcttcgtttcgacgtggcggtcggggccgtaacccgggg

SEQ ID NO: 379997 - DNA, 513 bp, Homo sapiens
  misc_feature: GZ8MTXP01CW6AQ.13.76.G10.1.454.CMB.2.raw
  modified_base (436)..(436): a, c, t, g, unknown or other
  modified_base (453)..(453): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttctggtatcagcagaagtcaggccagtcccctgtgctggtcatctatcaagatgccaaggcggccctcagggactccccccgtgacgcgacttctactgggcctccaaacttcgtagggaactcagcccactctgaccatcaggcgggacccaggctatgatgaggctgacttatacgtgtccgaggcgtgggacngcagcaacgtgccccgnttagtcggtcttacggacttcggggaaccaaggtcaccggtcttaaggccaacgaacccg

SEQ ID NO: 379998 - DNA, 569 bp, Homo sapiens
  misc_feature: GZ8MTXP01AOY2D.13.76.G10.1.454.CMB.2.raw
  modified_base (442)..(442): a, c, t, g, unknown or other
  modified_base (481)..(481): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagcgtgggtcccgccgaggctccgaggggaagggggctggagtgcgtcttcttttatttatagtagtggtagtaccatactccgcacgactccgtggaggggccgattcaccatctccagagacaattccaaagaacacgcttgtttctacaaatgaaacngctagagacgccgatggacacggtccgtgtattacgtgnggcgaagttaggacgttcggggaccccaacggttaaccgtttcgacgtctagtcgggaccgtggttacggggccgaagggggaacccc

SEQ ID NO: 379999 - DNA, 609 bp, Homo sapiens
  misc_feature: GZ8MTXP01D6YJL.13.76.G10.1.454.CMB.2.raw
  modified_base (446)..(446): a, c, t, g, unknown or other
  modified_base (465)..(465): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggccgccaggctccgaggggaggggctggagtgcgttcttcttttattatagtagtggtagtaccatactccgcagaacctccgtggaggggccgattcaccatctccagagactaatcccaaagaacacgtcttgtttacctacaaatcggaaaccncgacgtagagacgaccgancgacgacggtccgttagttacttacgtggtggaacgaaggacggtcgggttaccggggaacccctaaaggttaacccgtttacgaccggtcgttaaggtcgggtaaccgggtcgggacgggggtaacccgaacggggtaacccg

SEQ ID NO: 380000 - DNA, 590 bp, Homo sapiens
  misc_feature: GZ8MTXP01BBB21.13.76.G10.1.454.CMB.2.raw
  modified_base (362)..(362): a, c, t, g, unknown or other
  modified_base (372)..(372): a, c, t, g, unknown or other
  modified_base (444)..(444): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggtcaccgtcagtcacacctacatgagctggtccgcaggctccgagggaaggggctagggagtgtcgttctttcttttattatagtagtggtagtacatactccgnagaactccgnggacgggccgtagttccaccatctcagacgaacaattccaaagacacgtcttagtttctaacaaatgaaacngccgtagacgacgccgaagtcgacgtacggtacccgttgtaccttagtgtgggccgaagacgggtacggttcgggggacccctaacggttaacgttccttacgctagtcgggaccgtcggttacggggaaccgaacgggaaccccg

SEQ ID NO: 380001 - DNA, 518 bp, Homo sapiens
  misc_feature: GZ8MTXP01DQHA2.13.76.G10.1.454.CMB.2.raw
  modified_base (172)..(172): a, c, t, g, unknown or other
  modified_base (214)..(214): a, c, t, g, unknown or other
  modified_base (339)..(339): a, c, t, g, unknown or other
  modified_base (424)..(424): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctntaggaaataaatggcagataaatatacttctggtatcagcagaagtcaggccagtcccctgtgctggtcatctatcaagatgccaagccggccctcgagggactccccccgtggacgcgtattcnctgggcctccaaacttcgtacgggaacctcacgcccactctgaccatcagcgggacccaggctatgatgaggctgactattacgngtcaggcgtaggcagcagcaactcgcccgcttagtcgtcttacggacgttcgggaaccaaggtcctacccgtcttaagtccgaacggaaccccg

SEQ ID NO: 380002 - DNA, 561 bp, Homo sapiens
  misc_feature: GZ8MTXP01BE9ZY.13.76.G10.1.454.CMB.2.raw
  modified_base (489)..(489): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagctgggtccgccaggctccgagggaaggggttgagtgcgtcttcttttatttatagtagtggtagtacactactcgcagacctccgtggcggggccgattcaccatctccagagacaattccaagtaaccacgcttagtttcttacaaattgaaacagccctagggagagccgatgacacggtccgtagtacttactgtgcggaagnggatcgggggcccacggtaacgttcgttacgctaagtggaacgtcgcgggggcccaaggggcccgtaacggg

SEQ ID NO: 380003 - DNA, 635 bp, Homo sapiens
  misc_feature: GZ8MTXP01EAIOZ.13.76.G10.1.454.CMB.2.raw
  modified_base (432)..(432): a, c, t, g, unknown or other
  modified_base (441)..(441): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagtttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgaggggaagggggctgggagtgcgtcttcttttatttatagtagtggtagtaccatactccgcagaacctccgtgaggggccgattcaccatctccagagacaattcaaagacacgcttgtttcctaanaaatgaacncgcgtaggagacgccgagtcgaccgtacggtccgttagttaactttacgtggtcggaacggaaggacgggtacgggttaccgggggaaccccctaaacgggttaaacccggtttaccgttaaccgggtcgttaacgggtcggggtacccggttcggggttaccggggggtaaccccgaaacgggggtaaccccg

SEQ ID NO: 380004 - DNA, 525 bp, Homo sapiens
  misc_feature: GZ8MTXP01DUCVA.13.76.G10.1.454.CMB.2.raw
  modified_base (295)..(295): a, c, t, g, unknown or other
  modified_base (393)..(393): a, c, t, g, unknown or other
  modified_base (395)..(395): a, c, t, g, unknown or other
  modified_base (401)..(401): a, c, t, g, unknown or other
  modified_base (406)..(406): a, c, t, g, unknown or other
  modified_base (409)..(409): a, c, t, g, unknown or other
  modified_base (415)..(415): a, c, t, g, unknown or other
  modified_base (417)..(417): a, c, t, g, unknown or other
  modified_base (419)..(419): a, c, t, g, unknown or other
  modified_base (453)..(453): a, c, t, g, unknown or other
  modified_base (459)..(459): a, c, t, g, unknown or other
  modified_base (461)..(461): a, c, t, g, unknown or other
  modified_base (467)..(467): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcgtggtttcgtgtaggctatttaaaggtgccagtgtgaggtgcagctggtggagtcgtggaggaggcttgatccagccgtggggggtccctgagactctcctgtgcagctctggttcaccgtcagtcacacctacatgagctggtccgccaggcnccgagggaaggggcgtggagtgcggtctttcttttatttattagtagtgtagtacatactcgcagaactccgtgagggcggattcacatctccagaananatacanacacnctnttctanananacacgcgagagagacgagcgacgacgtacgtgtntagtgngngagagngcggaccgacgttacgttacttacgtaactagtcgtcgtcggacgggcgaacggaacg

SEQ ID NO: 380005 - DNA, 536 bp, Homo sapiens
  misc_feature: GZ8MTXP01E255H.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgccaggctccgagggaggggctggagtgcgtcttcttttatttatagtagtggtagtaccatactccgcagaactccgtgaggggccattcaccatctccagagacaattccaagaacacgcttgttcttacaaatgaaacagcctgagagccgatgacacggccgtgtattactgtgcgagagagttcggggcccaagaacgttcacggctatgggacgtcgttgggggccaaggggaacccg

SEQ ID NO: 380006 - DNA, 537 bp, Homo sapiens
  misc_feature: GZ8MTXP01B4V56.13.76.G10.1.454.CMB.2.raw
  modified_base (256)..(256): a, c, t, g, unknown or other
  modified_base (293)..(293): a, c, t, g, unknown or other
  modified_base (389)..(389): a, c, t, g, unknown or other
  modified_base (391)..(391): a, c, t, g, unknown or other
  modified_base (401)..(401): a, c, t, g, unknown or other
  modified_base (446)..(446): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctntgggttcacgtcagtcacactacatgagctgggtccncaggctccgaggggagggctggagtgcgtcttcttttattatagtagtggtagtacatactccgcagctccgtgaggggccagttcacatctcagnanaattccaaanacacgctgttctacaaatgaacagcctagagacgcccgatcgacncgggtccttggtattacgtgtcgcggagagaacgtgggggaccccaggaacgtttaacacggctaagtcgggacgtcgttcgggggaaccg

SEQ ID NO: 380007 - DNA, 589 bp, Homo sapiens
  misc_feature: GZ8MTXP01A224R.13.76.G10.1.454.CMB.2.raw
  modified_base (324)..(324): a, c, t, g, unknown or other
  modified_base (384)..(384): a, c, t, g, unknown or other
  modified_base (393)..(393): a, c, t, g, unknown or other
  modified_base (409)..(409): a, c, t, g, unknown or other
  modified_base (427)..(427): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggtcaccgtcagtcacacctacatgagctgggtccgccaggctccgagggaggggctggagtgcgtnttcttttatttatagtagtgtagtaccatactccgcagaactccgtgagggccattcacntctccaganacatccaaagacacgntgttctacaaatgaaacngccgtagacgacgccgatcggacacgggcctaggtattacgtgtggaacaaggaggtacgttcgggggaaccccaacgggttaaaccgtttcgttaaccggtccttagttcggggaacccggttcggttacggggggtaacccaaacggggggtaaaccccg

SEQ ID NO: 380008 - DNA, 482 bp, Homo sapiens
  misc_feature: GZ8MTXP01C62YG.13.76.G10.1.454.CMB.2.raw
  modified_base (416)..(416): a, c, t, g, unknown or other
  modified_base (423)..(423): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggagcagctccaacattggggcacattatgatgtacatggtaccagcagtttccaggagcaggtcccagactcctcatcaatacgtaacaacaatcggcccgcaggggtccctgacccgattctctggctcagtctggcactcagctcctgtcatcactgggctcgaggctgagatgaggctagnttattcngccaagtcccatgacagcagccttgaagtgcgttcggagttcgggcggggaacccgtgg

SEQ ID NO: 380009 - DNA, 658 bp, Homo sapiens
  misc_feature: GZ8MTXP01C6YIT.13.76.G10.1.454.CMB.2.raw
  modified_base (549)..(549): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtcgtggaggaggcttgatccagccgtgggggtccctgagactctcctgtgcagcctcgtgggttcaccgtcagtcacacctacatgacgcgtcgggtcccgccgaggcctaccggaggggaagggggcgtgggagtgtcgttctttcttttatttatagtagtggtataccatactccgcagtaactcggtggacggggccgtattccacctacgtctacccgaagacgaactaaacttaccaaagtaaaccaccgttctttacgtttaccttaacaaaattcgaaaacacggcctaggaacgacgacccgatacggaacccgacgggtaccgttagttaacgtttaccggnggtggaacggtaggaggtaccggaccggggaacccctaaaggttaaccgttacgacggtctaagggtcggtaccggtcgggttaccgggggtaaccgaaccgggtcccg

SEQ ID NO: 380010 - DNA, 652 bp, Homo sapiens
  misc_feature: GZ8MTXP01BRLQL.13.76.G10.1.454.CMB.2.raw
  modified_base (455)..(455): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtgggtcccgcaggctccgaggggagggggctggagtgcgtcttcttttattatagtagtgtagtaccatactcgcagtaacctccgtggacggggccgtattccaccactctacccgagtaacgaactaaattcccaaagaacctacgtcttttagtttaccctaaanaaagtacgaaactcgtccgtaaggaacgaccgaccgtatccggaacccgtacgggtccgttagttaacgttacggtggacggaacggtaaggacggtacggttacccggggaaacccctaacggttaaccgtttaccgacggtcgttaggtcggggtacccggtcggggacgggggaacccgaaccgggggtaaccc

SEQ ID NO: 380011 - DNA, 578 bp, Homo sapiens
  misc_feature: GZ8MTXP01DYG39.13.76.G10.1.454.CMB.2.raw
  modified_base (451)..(451): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtggggggtccctgagactctcctgtgcagcctctgggtcaccgtcagtcacacctacatgagcgtcgggtccgcaggcctccgagggaaggggctggagtgcgttctttcttttattatagtagtgtagtaccatactccgcacgaacctccggtggacggggccgtattccaccatctaccagagaactaatccaaagaacacgtcttgtttactacaaaatgaaacngcctaggagacgtccgaatcgacgacggtctgtattacgtgtgaacgaggagtacgttcggggacccaacggttaacgttcacgctagtcgggtacgtccggttagggggaaccaacggggtaaccc

SEQ ID NO: 380012 - DNA, 590 bp, Homo sapiens
  misc_feature: GZ8MTXP01C2BG8.13.76.G10.1.454.CMB.2.raw
  modified_base (282)..(282): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctanatgagctgggtcccgccgaggcctccgaggggaagggggctgggagtgcgtcttcttttattatagtagtgtagtacatactcgcagctccgtggagggccatcacatctcagagacaattccaaagacacgcttgttactacaaatcgaaacacgccctagacgacgcccgagtcgaaccgacggtccgtagtaattaccgtggtcgacgggaagaggtacggtccgggggaccccaacgggttaaacccgtttccgaaacggtccttaaaggtcggggaaccgttccgggcggggggaaaccccgg

SEQ ID NO: 380013 - DNA, 564 bp, Homo sapiens
  misc_feature: GZ8MTXP01ETD2F.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgccaggctccgagggaggggctggagtgcgtcttctttttattatagtagtggtagtaccatactccgcagaacctccggtggacgggggccatttccacctatctaccagagacaattccaaagaaccacgcttgtttctacaaatgaaacagccgtgaggacgccgatcgaccgacggccgtgtattactgtgcgagaggacgttcgggggacccctaaggacgttcacggctagtcgggacgtcgttgggggaacccaagggggaaccc

SEQ ID NO: 380014 - DNA, 579 bp, Homo sapiens
  misc_feature: GZ8MTXP01DYLTU.13.76.G10.1.454.CMB.2.raw
  modified_base (276)..(276): a, c, t, g, unknown or other
  modified_base (422)..(422): a, c, t, g, unknown or other
  modified_base (478)..(478): a, c, t, g, unknown or other
  modified_base (500)..(500): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttgggactgagctggattttccttttggctattttaaaggtgtccagtgtgaagtgcagctggtggagtcgtgggggagcttggtacagcctggcaggtccctgagactctcctgtgcagcctctggattcactttgatgattangccatcgctacgtcggggtccgacaagcctccgagggggacgggcctgggaggtgggtctcgaggttattaggttggaattaggtggtagcaagtagggctatgggcgtactcgtggtagggaacgggccgattccacctattccnccgaagacgaaccaacggacccaaagaaccctccctgtactctagacaaatgaacngcctagagtgctggaggaaccncgggttccttagttaatttagtgttagacaaagtctaccctaacccgtttagtcgtttttaggaacgtttggttaaccg

SEQ ID NO: 380015 - DNA, 583 bp, Homo sapiens
  misc_feature: GZ8MTXP01D6ANN.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgatctgggttttccttgttgctattttaaaaggtgcccagtgtgaggtgcagctggtggagtctggaggaggcttgatccagcctgggggtccctgagactctcctgtgcagcctctgggtcaccgtcagtcacacctacatgagctgggtccgccaggctccgaggggaagggggctggagtgcgtctttcttttatttatagtagtggtagtacatactccgcagaactccgtgaggggccattcaccatctccagagacaattccaaagacacgtcttagtttctacaaaatcgaaacacgccgtaggagaggcccgatcgaccacgggtccgttgtattactggtgcgtaagaggacgttcgggggacccctaaggttaaccgttcttaacggcttaagtgggtaaccgtcgttacgggggtaacccaaagggggtaaccccg

SEQ ID NO: 380016 - DNA, 623 bp, Homo sapiens
  misc_feature: GZ8MTXP01BP9UM.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggtcaccgtcagtcacacctacatgagcgtcgggtcccgccgaggcctccggaggggaagggggctggagtgcgtcttcttttattatagtagtgtagtacatactccgcagaacctccggtggacggggccgtattccgacctagtcctaccagacgaacctaattacccaaagaactacggactttgtttacctaacgaaaattcggaaactcggcctaggagacgccgaatcggaaccgacggtccgtgttaacttacgtggtgaacggtaaggacgtagttccgggggaaccccaacggttaaaccgttcaccgtctaggtcgggtacgtcggttacgggggaacccaaagggggtaaccccg

SEQ ID NO: 380017 - DNA, 555 bp, Homo sapiens
  misc_feature: GZ8MTXP01CEWS8.13.76.G10.1.454.CMB.2.raw
  modified_base (236)..(236): a, c, t, g, unknown or other
  modified_base (293)..(293): a, c, t, g, unknown or other
  modified_base (419)..(419): a, c, t, g, unknown or other
  modified_base (486)..(486): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataaatggcagataaatntacttcctggtatcagcagaagtcaggccagtcccctgtgctggtcatctatcaagntgccaaggtcggccctgagggactccccccgtgagcgattcctcgtcggcctaccaaacttcgtagggaacctcgacgccctaactctacgaccactacgacggacccgggacccagggcctaagngaagtgacggctgtaacttattacgtgtcgaacggtcggtagggacagcgacgcaaccgtgccccgnttacgtcgtcgttacggacttcgggaacctaacggtccgaaccgtccgttaacgtccgaacgaaccccg

SEQ ID NO: 380018 - DNA, 564 bp, Homo sapiens
  misc_feature: GZ8MTXP01DMOYM.13.76.G10.1.454.CMB.2.raw
  modified_base (404)..(404): a, c, t, g, unknown or other
  modified_base (414)..(414): a, c, t, g, unknown or other
  modified_base (425)..(425): a, c, t, g, unknown or other
  modified_base (438)..(438): a, c, t, g, unknown or other
  modified_base (487)..(487): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagtttttggctgagcgtggttttcctgttaggctattttaaaaggtgcccagtgtgaggtgcagctggtggagtctggaggaggcttgatccagccgtggggggtccctgagactctcctgtgcagcctctgggttcaccgtcagtcacacctacatgagctgggtccgccaggctcccgagggaagggggcgtggagtgcggtcttcttttatttattagtagtggtagtacatactcgcagaactcgtgagggccggattcaccatctcccagaanacactacaanaacacgtcttnttactactaatanaacacgacgtagagacgacgacgacgacgacggtcgtgtatacgtgtgngagagaggcgggaccgacgttaacgttacgggttacgtaacgtagtcggtcggtcggcgggtaacggaacggaaccg

SEQ ID NO: 380019 - DNA, 595 bp, Homo sapiens
  misc_feature: GZ8MTXP01AJ5JE.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactaaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagctgggtcccgccgaggctccgaggggaaggggctggagtgcgtcttcttttatttatagtagtggtagtacatactcgcagactccgtgcggggccatcaccatctcagagacaattccaagacagcttgtttctacaaatgaacagccctagggacgaggtcccgaagtcggaaccgaccgggtcccgtagttacgttacctggtacgcggaaggagacggtccggggacccctaacggtaaaccgtttaccgcggttacttggtacgggaacggttcggcgggggacccaaaggggccccgtaacccggg

SEQ ID NO: 380020 - DNA, 706 bp, Homo sapiens
  misc_feature: GZ8MTXP01EGF1P.13.76.G10.1.454.CMB.2.raw
  modified_base (281)..(281): a, c, t, g, unknown or other
  modified_base (311)..(311): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggtagttttggctgagcttgggttttccttgttgtcttaattttaaaaggtgcccagtgtgaggtgcagctgggtggagtcgtgggaggaggcttggatccgagccgtgggggtccctgagactctcctgtgcagtcctgtgggttcaccgtnacgtcacacctacatgagcgtcgggtcccnccgaggcctaccgagggggaacgggcgtgggagtcgtcgttctttactttttatttagtagttagttggattaacagttaacctcccgaacaagtcctccgggtagggtacgggggccctattccaacctattcccaccgaaggacaactaacttaccgaaaagaacctacgtctttgtttacttaacaaaagttcgaaactacgtacccgttaggaacgtaccggacccgtaagttacggaaacccgacgggtcccggtttagttaaactttccggaaggttcggaacggaaggttaagacgggttccgggggaacccccttaaaggttaaaccggttttaacccaaacgggttcgttaacggtcggttaccggtcgggttaacggggaacccg

SEQ ID NO: 380021 - DNA, 577 bp, Homo sapiens
  misc_feature: GZ8MTXP01C2TCK.13.76.G10.1.454.CMB.2.raw
  modified_base (295)..(295): a, c, t, g, unknown or other
  modified_base (409)..(409): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtgggtcccnccgaggcctccgaggggaaggggcgtggagtgcgttctttcttttatttatagtagtggtagtaccatactccgcagaactccgtgacggggccgtattcaccatctaccaganacaattccaaagaacacgtcttgtttctacaaatcgaacagcctagagacgccgaatcgacacggtccgtgtactacgtgtgcgaggagacgttcggggacccaacggttaacgtttcacgtctaagtcgggacgtcggttacgggggaaccaaacgggggaaccccg

SEQ ID NO: 380022 - DNA, 604 bp, Homo sapiens
  misc_feature: GZ8MTXP01EXZ5I.13.76.G10.1.454.CMB.2.raw
  modified_base (185)..(185): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgnggtaagcagctggtggagtctggaggaggcttgatccagccgtgggggtccctgagactctcctgtgcagcctcgtgggttcaccgtcagtcacacctacatgagctcgggtcccgccgaggcctccgagggggaagggggcgtgggagtgtcgttctttacttttatttagttagtaggttggtagtactatactccgacacgccgtccgtaggacggggccgtagttcactactcctaccagacgaacaattaccaaagaacctacgtcttcgttacttacaaatgaaacgagtcctagagacgcccgagtcgacgtaccgggtccgttagtaacttacgtggtgcggaagagacggtcgggggacccaggaaccggtttaacacggtctaggtggacgttcggttcggggaacccg

SEQ ID NO: 380023 - DNA, 542 bp, Homo sapiens
  misc_feature: GZ8MTXP01BQUI5.13.76.G10.1.454.CMB.2.raw
  modified_base (235)..(235): a, c, t, g, unknown or other
  modified_base (459)..(459): a, c, t, g, unknown or other
  modified_base (476)..(476): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataatggcagataaatntacttctggtatcagcagaagtcaggccagtcccctgtgctggtcatctatcaagatgaccaaggccgccctcgagggactccccccgtggacgcgtacttctcgtcgggcctaccgaaacgtcgtaggggaactcgagtccactctacgaccatcaggaccgggacccagggcctagtaggatggacggtctagtacttattacgtgtcgaggcgtgggcagnacgcaacgtcgcccgtnttagtcgtcgttacggacgttcgggaacctaggtccaccgtacgttaacgtccgaacggaaccccg

SEQ ID NO: 380024 - DNA, 612 bp, Homo sapiens
  misc_feature: GZ8MTXP01B7QU8.13.76.G10.1.454.CMB.2.raw
  modified_base (466)..(466): a, c, t, g, unknown or other
  modified_base (477)..(477): a, c, t, g, unknown or other
  modified_base (494)..(494): a, c, t, g, unknown or other
  modified_base (519)..(519): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagtcctcgtgggttcaccgtcagtcacacctacatggacgcgtcgggtcccgccgaggccgtccggaaggggaggggctggagtcgtcgttctttctttttattagtagtagtggtagtacctatactccgacagtaactccggtggacggggcctacttccgacctatccaccagacgaactaactaccaaagaaccacgtcttagtttacctaaanaaatcgaaacncgacgtagagacgcgancgacgacggtcgtagttactcgtgngaaggaagaggtacggaccgggaaccctaacgttaaccgttacgacgtaagtaggtaacgggtaccgtcggacggggaaccgaacgggtcccg

SEQ ID NO: 380025 - DNA, 628 bp, Homo sapiens
  misc_feature: GZ8MTXP01APHEE.13.76.G10.1.454.CMB.2.raw
  modified_base (468)..(468): a, c, t, g, unknown or other
  modified_base (530)..(530): a, c, t, g, unknown or other
  modified_base (587)..(587): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtctggaggaggcttgatccagccgtgggggtccctgagactctcctgtgcagcctcgtgggtcaccgtcagtcacacctacatgagcgtcgggtcccgccgaggcctaccggaaggggagggggctgggagtgtcgttctttcttttattatagtagtggtagtacatactccgcagaacgtccgtggacgggccgtattccacctatcctaccagaacgaactaattcccaaagaacctacgtcttgtttactacaaaattcggaaacngtacccgtagaacggacgacccgtagtcggaaccgtaccgggtccgtagttaactttaccgnggtggaacgaagagggtacgttcgggggaacccctaaggttaaaccgtttcaccggntaagtcgggaccgttcggacgggggaacccaacgggggccc

SEQ ID NO: 380026 - DNA, 584 bp, Homo sapiens
  misc_feature: GZ8MTXP01EGFJD.13.76.G10.1.454.CMB.2.raw
  modified_base (394)..(394): a, c, t, g, unknown or other
  modified_base (433)..(433): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagcgtgggtccgccaggctccgagggaggggctggagtgcgtcttcttttattatagtagtgtagtacatactcgcagaactccgtggaggggccgattcaccatctccaganacaatccaaagaacacgtcttgtttctacaaatgaaacncgcctaggacgacgccgatcgaccgacgggtccgtgttaattacgtggtcgaacgtaaggagtacgttcgggggacccctaagggttaaccgtttacacgtctagtcgggtaccgtcggttacgggggaacccttaaacgggggaaccccg

SEQ ID NO: 380027 - DNA, 642 bp, Homo sapiens
  misc_feature: GZ8MTXP01AI9E8.13.76.G10.1.454.CMB.2.raw
  modified_base (287)..(287): a, c, t, g, unknown or other
  modified_base (365)..(365): a, c, t, g, unknown or other
  modified_base (379)..(379): a, c, t, g, unknown or other
  modified_base (394)..(394): a, c, t, g, unknown or other
  modified_base (399)..(399): a, c, t, g, unknown or other
tcagtcacgtactacacgaccggtgctcgatttagtcactcatacaggggggagaggagcccagcactgggattccgaggtgtttccattcggtgatcagcactgaacacagaggactaaccatggagttttggctgagcgtggtttctgtaggctatttaaaggtgccagtgtgaggtgcagctggtggagtctgggaggaggcttgatccagccgtgggggtccctgagactctcctgtgcagcctgtcgggttcaccgtcagtcacacacatgagcgtgggccnccgaggcctacgagggggagggctgggagtcgcgttcttctttttattagtaggttacgtggtatacactactccganacgactcggtgggngggcctaattccacnttccncaaggataacaacttccaaagaccacgtactttctttactaacaagtacgaacgacgacgagggaacgacgaccgtaagcgaacgtaccggtcgttagttactacggtggtcggaggtaaggtcggttaccgggtaccgggaccccgtaaacggtaacggtttaccgacggttacgtaaggtaccggggtaaccggttcggggtacccggggacccggtaaccggggttaaccccgtaaccgg

SEQ ID NO: 380028 - DNA, 571 bp, Homo sapiens
  misc_feature: GZ8MTXP01B9ANG.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctatttaaaggtgcccagtgtgaggtgcagctggtggagtctggaggaggcttgatccagccgtgggggtccctgagactctcctgtgcagcctcgtgggttcaccgtcagtcacacctacatgagcgtgggtcccgccaggcctccgagggggaaggggctgggagtgcgtcttcttttattatagtagtcggtagtacatacctccgacacgctccggtggacgggggcctattcacctatctccaggacgacaattaccaaagaacacgtctgttctacaaatgaacagtcctgagacgccgatcgacgcggtccgtagtacttcgtgtgcggagaggtaggtcgggggaccccttacggttaacgttaacacgcgttaagtcgggttacgtcggttcgggggaacccg

SEQ ID NO: 380029 - DNA, 530 bp, Homo sapiens
  misc_feature: GZ8MTXP01A3EVV.13.76.G10.1.454.CMB.2.raw
  modified_base (514)..(514): a, c, t, g, unknown or other
tcagtcacgtactacacgaccggtgctcgatttagtcactcatacagggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggttcaccgtcagtcacacctacatgagctgggtccgcaggctccgaggggaaggggctggagtgcgtctctttttattatagtagtggtagtaccatactccgcagaactccgtgaggggccgattcacatctccagagacaattccaagacacgctgttctcaaatgaacagctgagagccgatgacacggccgtgtattactgtgcgagacgagttgggggaccccagaacgtttcacgctagtcgggacgtcgnggggccaaggggcccc

SEQ ID NO: 380030 - DNA, 553 bp, Homo sapiens
  misc_feature: GZ8MTXP01A1T1C.13.76.G10.1.454.CMB.2.raw
  modified_base (332)..(332): a, c, t, g, unknown or other
  modified_base (402)..(402): a, c, t, g, unknown or other
  modified_base (411)..(411): a, c, t, g, unknown or other
  modified_base (420)..(420): a, c, t, g, unknown or other
  modified_base (425)..(425): a, c, t, g, unknown or other
  modified_base (434)..(434): a, c, t, g, unknown or other
  modified_base (448)..(448): a, c, t, g, unknown or other
  modified_base (472)..(472): a, c, t, g, unknown or other
  modified_base (517)..(517): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcgtgggtttcctgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtcccgccaggctccgaggggaagggggctgggagtgcgtcttntttttattatagtagtggtataccatactccgcagaactccggtgacggggccattcacatctccagaanacatacaanacactcttnttcanaatcgaacngcgagagacgcgancgacgacggtcgtagtatacgtgngaacgaggacggtacggccgggaccctaacgttaacgttcacgtntagtcgggacgtcgggcgggtaaccgaacgggcccg

SEQ ID NO: 380031 - DNA, 625 bp, Homo sapiens
  misc_feature: GZ8MTXP01CVYDA.13.76.G10.1.454.CMB.2.raw
  modified_base (170)..(170): a, c, t, g, unknown or other
  modified_base (461)..(461): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctctaggaaataatggacagataaatatacttctgtatcagcagagtcaggccagtcccctgtgctggtcatctatcaagatcgccaaggccggccctagagggactcccccgtggacgcgtacttcctcgtggcctaccaaactcgtagggaacctcgacgcccactctacgaccatccgacggccgggaacccagggtcctagttcggataggacggtcgtacggtacttacgttaaccgtggttaccgngggtcggtacgggggaacctaacggccgaacggccgtaaccgttccggaccccggttacgttacgtttaccggttcggttttaccggggaaaccgttcggggaaaccccgtaaagggttcccgtaaccggttacccgttaacgtcccgaaccggtaacccccgg

SEQ ID NO: 380032 - DNA, 628 bp, Homo sapiens
  misc_feature: GZ8MTXP01C09RS.13.76.G10.1.454.CMB.2.raw
  modified_base (428)..(428): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtcgtccccaggacagacagccagcatcacctgctctagaaataatggacagataaatatacttctggtatcagcagaagtcaggccacgtcccctgtcgctggtcatctatcaagatcgaccaaggccgccctcgagggactcccccgtgacgcgtacttctcgtcgcctccaactcgtacgggaactcgacgccctactctacgaccatccgacggaccgggacccagggcctagtaggatagacgggntacggtaacttaagttacgtacgttcggacgggtcggtacggggacctaggaccgacgtccgaaccgtcggttaccccgtagttacggttcgttcccgggtttaccgggaaccgggttccggggtaaaccccgtaaacgggggttaacccctaacccgggttacccgttaaaccggtaacccgaacccggtaacccccgg

SEQ ID NO: 380033 - DNA, 570 bp, Homo sapiens
  misc_feature: GZ8MTXP01B3XG6.13.76.G10.1.454.CMB.2.raw
  modified_base (396)..(396): a, c, t, g, unknown or other
  modified_base (407)..(407): a, c, t, g, unknown or other
  modified_base (476)..(476): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtcccgcaggctccgaggggaggggctggagtgcgtcttcttttattatagtagtggtagtacatactccgcagaactcgtggacggggccattcacatctccaganacaatccaaanacacgtcttgtttctacaaatcgaacagcctggaacgagcccgatcgaacgcggtccgtagtattacgnggtgaacggtagaggtacgcgggggaccccaagggttaacgtttacgacgtctagtcgggaaccgtgttcgggggaacccaagggggtaacccc

SEQ ID NO: 380034 - DNA, 566 bp, Homo sapiens
  misc_feature: GZ8MTXP01BMNCD.13.76.G10.1.454.CMB.2.raw
  modified_base (394)..(394): a, c, t, g, unknown or other
  modified_base (412)..(412): a, c, t, g, unknown or other
  modified_base (418)..(418): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggttcaccgtcagtcacacctacatgagctggggtcccgccaggcctccgagggagggggctggagtgcgtcttctttttatttatagtagtggtagtaccatactccgcagaacctccgtgagggcgatcacacnctccagagacataccaanaacacncttgtttactacaaatagaacacgccgtgagacgaccgatacgcgaacggtcccgtgtattacctggtgcgagagagcgggcccgaacgttacgttacgttacgaaccgtgtaacggcggtcgttcggggccgttaacgggaacccgg

SEQ ID NO: 380035 - DNA, 528 bp, Homo sapiens
  misc_feature: GZ8MTXP01DR49L.13.76.G10.1.454.CMB.2.raw
  modified_base (172)..(172): a, c, t, g, unknown or other
  modified_base (292)..(292): a, c, t, g, unknown or other
  modified_base (322)..(322): a, c, t, g, unknown or other
  modified_base (471)..(471): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctctaggaaataatggcagataaatatacttctggtatcagcagagtcaggccagtcccctgtgctggtcatctatcaagntgaccaagcggccctgagggactcccccgngagcgtattctcgtcggctacctaaactcgtagggaacctcgacgtcccactctacgaccatcagccgggacccaggacctagtggatagaggctagtaccttattaccgtgtccgaggcgtagggactagcacgcaacgtcgcccgtnttagtcgtcgttacggattcgggaacaaggtcaccgtcttaacgtcaacgaaccccg

SEQ ID NO: 380036 - DNA, 575 bp, Homo sapiens
  misc_feature: GZ8MTXP01A8FUV.13.76.G10.1.454.CMB.2.raw
  modified_base (332)..(332): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccacctcagtgtccgtgtccccaggacagacagccagcatcacctgctctaggaaataatggacagataaatatacttctggtatcagcagagtcaggccagtcccctgtgctggtcatctatcaagatgaccaagccgccctgagggactcccccgtgagcgattctcncggcctaccaaacgtcgtacgggaactcgacgcccactctcgaccatccgagccgggacccaggcctagcggatgacggctaggtacttacgttacgtcgttcgacgggtcggtacgggactacgcgaacgccaacgtcgacccgtcgttagtcggttcgttaccgggaacgttacggggaacccgtaacgggtaaccctaacccggttacccgttaaacggttccgaaccggtaacccccgg

SEQ ID NO: 380037 - DNA, 544 bp, Homo sapiens
  misc_feature: GZ8MTXP01BXW6D.13.76.G10.1.454.CMB.2.raw
  modified_base (384)..(384): a, c, t, g, unknown or other
  modified_base (455)..(455): a, c, t, g, unknown or other
  modified_base (487)..(487): a, c, t, g, unknown or other
  modified_base (533)..(533): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctatttaaaaggtgccagtgtgaggtgcagctggtggagtctggaggaggcttgatccagccgtgggggtccctgagactctcctgtgcagcctctgggttcaccgtcagtcacacctacatgagctgggtccgccaggctccgaggggaagggctggagtgcgtcttctttattatagtagtggtagtacatactcgacagctcgtgaggggccgatcacatcncagagacaattaccaaagaacacgtcttgttacttacaaattgaacagtcctgaagacgccgatcggaccncggtccgttaggtacttacgtgtgttggaagngtagtcggggacccaggaacgttaacacgctagtcgggacgttcgngggggaacccg

SEQ ID NO: 380038 - DNA, 552 bp, Homo sapiens
  misc_feature: GZ8MTXP01BH8NO.13.76.G10.1.454.CMB.2.raw
  modified_base (237)..(237): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgccctcagtgtcgtggggccccagggcagagggtcaccatctcctgcacgtgggancagctccaacattggggcacattatgatgtacactggtaccagcagtttccaggagcaggtcccagactcctcatcaatacgtaacaacaatccggcccgacgacggggtccctggacccgtattcctcgtcggctccgacggtctcggcacctcacgtcccctccgtgtcatccacgtcgggcctccgggaggcgtggaggatggagtcgtagtatttacgttctcggcctaaggttccttagtcgacgagcacgcccgttggcgttggtccgtttcgggtacgttccgggggcccgggggaaccgtaaccggg

SEQ ID NO: 380039 - DNA, 568 bp, Homo sapiens
  misc_feature: GZ8MTXP01ESMXZ.13.76.G10.1.454.CMB.2.raw
  modified_base (416)..(416): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataatggcagataaatatacttctgtatcagcagaagtcaggccagtcccctgtgctggtcatctatcaagatgaccaagccggccctcgagggactcccccgtggacgcgtattctactggcctaccaaactccgtaggggaacctcgacgcccactctacgaccatcgacggccgggacccagggccttaaggngagtaggacggtcgtagtacttagttacgtgtcgagggtcggtacgggactaggacacgcgaacgtcgccgtcttacgtcggttacggttacggacgttacgggaaccgtacggtcccgtaccggtacgttacgtaaccgaaccgaaccccg

SEQ ID NO: 380040 - DNA, 664 bp, Homo sapiens
  misc_feature: GZ8MTXP01AMK1C.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggtcaccgtcagtcacacctacatgacgcgtcgggtcccgccgaggcctccggaggggaacgggggctgggagtgtcgtctttcttttattatagtagtggtagtacatactccgcacgtaactccggtggacggggcccgtattccgaacctagtcctaccagaagaacctaacttaccgaaagtaaccaccgtctttacgttttaccttaacaaaattacggaaactacggtcccgtaagggacgacgacccgatccggaacgaccgggtccgttagtacttaacgtggtcggaaggtaaggacggaagttccgggggaaccccctaaggttaaccgtttaccgaccggtccttaaggtcgggaaccgttcggttaccgggggaacccgaaacgggggtaacccccg

SEQ ID NO: 380041 - DNA, 560 bp, Homo sapiens
  misc_feature: GZ8MTXP01CWTXK.13.76.G10.1.454.CMB.2.raw
  modified_base (452)..(452): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtgggtccgccaggctccgaggggaggggctggagtgcgtcttcttttattatagtagtggtagtacatactccgacagcgtccgtggacggggccgattcaccatcctccagagacaattcccaaagacacgcttagtttctacaaatgaacagcctgagngccgatcgacacggtccgtagttacttacgtgtgacggaggagtaacggtcgggggaccccaacggttaaccgttaacacgctagtcggacgtcggcgggggaacccg

SEQ ID NO: 380042 - DNA, 589 bp, Homo sapiens
  misc_feature: GZ8MTXP01EX6Z7.13.76.G10.1.454.CMB.2.raw
  modified_base (393)..(393): a, c, t, g, unknown or other
  modified_base (482)..(482): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgcaggctcgagggaggggctggagtgcgtcttcttttattatagtagtgtagtaccatactccgcagaactcgtgaggggccgattcacagtctccaganactaatccaaagacacgcttgttactacaaatgaaactaggcctaggacgagccgatcgaacgacggtccgtaggttattaccgttggngcggtaaggaggaacggttccgggggacccctaaacggaaaccgttttcgaccgtcgtagttcgggaacggttccggacgggggaacccgttaacgggggaaccccg

SEQ ID NO: 380043 - DNA, 538 bp, Homo sapiens
  misc_feature: GZ8MTXP01EJHD9.13.76.G10.1.454.CMB.2.raw
  modified_base (270)..(270): a, c, t, g, unknown or other
  modified_base (388)..(388): a, c, t, g, unknown or other
  modified_base (419)..(420): a, c, t, g, unknown or other
  modified_base (489)..(489): a, c, t, g, unknown or other
  modified_base (515)..(515): a, c, t, g, unknown or other
  modified_base (517)..(517): a, c, t, g, unknown or other
tcagtcacgtactacacgaccggtgctcgatttagtcactcatacaggggggagaggagcccagcactgggattccgaggtatttccattcggtgatcagcactgaacacagaggactcaccatggagttttggctgagctgggttttccttgttgcttattttaaaaggtgcccagtgtgaggtgcagctggtggagtcgtggaggaggcttgatccagccgtgggggtccctgagactctcctgtgcagcctggttggtacaccggtnacgtaccacacctacatgacgcgtcggtcccgccgacggccgtccggagggggaacgggcggtggtagtcggtcgttctttcttttatttatagttagtggtagtacatactaccgcngactccgtcgaggggccgacgtcaccactcnnccagacgacaactaccaacgaacacgactacgttacttactaaactagaacacgtcctagagagcgacncgacgacgcgtgttgttcttgtgcgngngagacgggtccgaacgtaacg

SEQ ID NO: 380044 - DNA, 557 bp, Homo sapiens
  misc_feature: GZ8MTXP01B407V.13.76.G10.1.454.CMB.2.raw
  modified_base (331)..(331): a, c, t, g, unknown or other
  modified_base (370)..(370): a, c, t, g, unknown or other
  modified_base (387)..(387): a, c, t, g, unknown or other
  modified_base (408)..(408): a, c, t, g, unknown or other
  modified_base (413)..(413): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagcgtgggtcccgccaggcctccgaggggaggggctggagtgcgtcttnttttattatagtagtgtagtacatactcgcagaactcgnggacgggccagttcacntctccagagacaattccaaanacacncttgttctacaaatgaaacagccgtgagacgccgatcgacgacggccttgtaacttccgtggtgaacggaagaggtacgttcggggaccccaagttacgttcacgaatgtggacgtcggttcggggaacccgaagggtaacccg

SEQ ID NO: 380045 - DNA, 571 bp, Homo sapiens
  misc_feature: GZ8MTXP01C7NKX.13.76.G10.1.454.CMB.2.raw
  modified_base (232)..(232): a, c, t, g, unknown or other
  modified_base (430)..(430): a, c, t, g, unknown or other
  modified_base (504)..(504): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccacctcagtgtccgtgtccccaggacagacagccagcatcactgctctagaaataatgacagataaatntactctggtatcagcagaagtcaggcctagtcccctgtgctggtcatccgtatcaagatgaccaaggccggccctgacggggtactcccccccgtaggacgtcgtactttccgtcgttcgggtcctacccaaacgttcgtacggggaaacctcgacgacccactctacgaccatcgacggaccggacccaggactagnggagtagacggtacgtacggtaacttactacgtagtccgaggtcggtacgggacagccagcaacgtcgcccgtnttacgtcgtcgttacggacgttcgggtaaccgacgtccgaccgtacgttacgtccgaacgaaccccg

SEQ ID NO: 380046 - DNA, 563 bp, Homo sapiens
  misc_feature: GZ8MTXP01EN13S.13.76.G10.1.454.CMB.2.raw
  modified_base (361)..(361): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggtcaccgtcagtcacacctacatgagcgtcgggtcccgccaggctccgaggggaaggggctggagtgcgtcttcttttattatagtagtggtatacatactcgnagaactcgtgagggcatcacatctcagagacaattccaaagaacacgcttgtttactacaaatcgaaacagccgtagagacgccgatcgacgacggtccgtagtattacgtgtgcgaagaggacgttcggggaccccaaggttaaccgttacacggctagtcgggtaccgtcggttacggggaacccgaaaggggaaccccg

SEQ ID NO: 380047 - DNA, 544 bp, Homo sapiens
  misc_feature: GZ8MTXP01DVJ83.13.76.G10.1.454.CMB.2.raw
  modified_base (424)..(424): a, c, t, g, unknown or other
  modified_base (482)..(482): a, c, t, g, unknown or other
  modified_base (487)..(487): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagctgggtccgcaggctccgaggggaagggggctgggagtgcgtcttcttttatttatagtagtggtagtacatactccgcagctccgtgaggggccattcacatcgtccagagactaattcccgaaagaacacgcttnttcttactaataagaacgacgacgtagagacgcgacgacgacgacgtcgtacgtactntgtgngagagagtcgggaccgacgttacgtaactacgcgtagtcggacgtcggcgggaacgg

SEQ ID NO: 380048 - DNA, 581 bp, Homo sapiens
  misc_feature: GZ8MTXP01AZTE9.13.76.G10.1.454.CMB.2.raw
  modified_base (263)..(263): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcgtggttttctgtagctatttaaaaggtgccagtgtgaggtgcagctggtggagtctggaggaggcttgatccagccgtggggggtccctgagactctcctgtgcagctctggttcaccgtcngtcacacctacatgagctgggtccgccaggctccagggaagggggctggagtgcggtctcttttatttattagtagtggtagtacatactccgcagaactccgtgagggccggattcacactctcccagagacaattacaagaacaacgcctttcttactactaatacgaacacgacgtacgagacgacgacgtacgacgacggtacgtcgttatacgtcgtcgcgaaggaggtacggcggtacccgtaaccgttaaccgttacgttacgtaacgtacgtaacggtacggtcggttacgggtaaccggaacggaaccg

SEQ ID NO: 380049 - DNA, 650 bp, Homo sapiens
  misc_feature: GZ8MTXP01ALEII.13.76.G10.1.454.CMB.2.raw
  modified_base (454)..(454): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtgggtcccgccgaggcctccgaggggaagggggctgggagtgcgttcttcttttattagtagtagtggtagtaccatactcgcagaacctccggtggacggggccattccaccatcctaccagacgaactaattcccaaagacacgcttgtttactacaaatgaaacncgcgtaggacgacgaccgtagtcgaccgtacgggtaccgttagttaacgttacgtggtcggaacggtaaggacggtaccgggttacccgggggaaccccgtaaacggttaacccgtttaccgttaccggtaacgttagggtccgggtaccgggttccgggttacgggggtaaccccgttaaacgggggtaaccccg

SEQ ID NO: 380050 - DNA, 602 bp, Homo sapiens
  misc_feature: GZ8MTXP01B29LV.13.76.G10.1.454.CMB.2.raw
  modified_base (170)..(170): a, c, t, g, unknown or other
  modified_base (300)..(300): a, c, t, g, unknown or other
  modified_base (538)..(538): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctctaggaaataattggacaagaataaatatacttcctggtatcagacaagaagtcaggccacgtcccctgtgctggtcatctatacaagntcgaccaagccgccctcgacgggactcccccgtgagtcgtaactttccgtcgttcggcccttacccgaaacgttcggtacggggaacctccgaacgccctaacgttccacggaacccataccgacgggaccgggaaccccaagggcctagtagggattgggaacggtcgtaggttaacttagttacgtcggtacgaaggggtcggtaggggaaccagcgaacgcgaacgtcgcccgtnttacgtcgtacgttacggacgttacgggaactacggtccaccgtcaacgtccaacggaaccccg

SEQ ID NO: 380051 - DNA, 513 bp, Homo sapiens
  misc_feature: GZ8MTXP01EVANA.13.76.G10.1.454.CMB.2.raw
  modified_base (170)..(170): a, c, t, g, unknown or other
  modified_base (275)..(275): a, c, t, g, unknown or other
  modified_base (388)..(388): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctctaggaaataaattggacagataaatatacttcctggtatcagcagaagtcaggccagtccccngtgctggtcatctatcaagatgccaagcggccctgacggactccccctgagctatctctggctcgaaactcgtgggaactcagccactctgaccatcagcggaccaggctagngatgaggctagacttattactgtcaggcgtagggacaggcacgcaacgtcgccccgattacgtgtccgttacggaacgttcggggaacctaacggtcaacccggtacaacgtcgaacgaaccccg

SEQ ID NO: 380052 - DNA, 524 bp, Homo sapiens
  misc_feature: GZ8MTXP01BJQTR.13.76.G10.1.454.CMB.2.raw
  modified_base (312)..(312): a, c, t, g, unknown or other
  modified_base (330)..(330): a, c, t, g, unknown or other
  modified_base (385)..(385): a, c, t, g, unknown or other
  modified_base (391)..(391): a, c, t, g, unknown or other
tcagtcacgtactacacgaccggtgctcgatttagtcactcatacagggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttcctggtatcagcagaagtcaggccagtccccctgtgctggtcatctatcaagatgccaagcggccctcagggntcccccctgagcgattcnctgctcaaactctgggaactcagccactctgaccatcagccgggaccaggctagngagtgngcgtgtactagttacgtgtcgaggcggtacgggactacgacgacgcaacgtcgcccgtcttacgtcgtcgttacggacggttccgggaaccgtaacggtcctacccggtacgttaacgtccgaaccgaacccg

SEQ ID NO: 380053 - DNA, 561 bp, Homo sapiens
  misc_feature: GZ8MTXP01DS1G9.13.76.G10.1.454.CMB.2.raw
  modified_base (414)..(414): a, c, t, g, unknown or other
  modified_base (476)..(476): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgagggaagggggctggagtgcgtctttctttatttattagtagtgtagtacatactcgcagaactcgtggagggccggactcaccatctccagagacaattccaagaacacgntgtttctacaaatgaacagcctgagagccgatgacacggtccgtgtattacgtgtgaacggngagagttcggggccctacgaaaccgtttcgttaacgtccgtaatcgggtaccggtcgttgggggtaacccgaaggggtaaccccg

SEQ ID NO: 380054 - DNA, 389 bp, Homo sapiens
  misc_feature: GZ8MTXP01AEGC0.13.76.G10.1.454.CMB.2.raw
  modified_base (188)..(188): a, c, t, g, unknown or other
  modified_base (193)..(194): a, c, t, g, unknown or other
  modified_base (196)..(196): a, c, t, g, unknown or other
  modified_base (203)..(203): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (221)..(221): a, c, t, g, unknown or other
  modified_base (239)..(239): a, c, t, g, unknown or other
  modified_base (251)..(251): a, c, t, g, unknown or other
  modified_base (253)..(253): a, c, t, g, unknown or other
  modified_base (267)..(267): a, c, t, g, unknown or other
  modified_base (273)..(273): a, c, t, g, unknown or other
  modified_base (275)..(275): a, c, t, g, unknown or other
  modified_base (277)..(277): a, c, t, g, unknown or other
  modified_base (279)..(279): a, c, t, g, unknown or other
  modified_base (284)..(284): a, c, t, g, unknown or other
  modified_base (287)..(287): a, c, t, g, unknown or other
  modified_base (329)..(329): a, c, t, g, unknown or other
  modified_base (332)..(332): a, c, t, g, unknown or other
  modified_base (336)..(336): a, c, t, g, unknown or other
  modified_base (354)..(354): a, c, t, g, unknown or other
  modified_base (376)..(389): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagtttttggctgagcgtgggttttccttgttgctattttaaaaggtgcccagtgtggnggtgnngntggtggngtgtggnggnggntgncngcggtcgggggtccgtgngctctctgtgcncncctcgtgggttccnccgtcncncncncctcntgngcgtcggggtcccggccgcggcgccggaggggggaggggggnggngggnggtggtcgtttctttttnttttttatttaggtttggtttnnnnnnnnnnnnnn

SEQ ID NO: 380055 - DNA, 694 bp, Homo sapiens
  misc_feature: GZ8MTXP01AEOW6.13.76.G10.1.454.CMB.2.raw
  modified_base (520)..(520): a, c, t, g, unknown or other
  modified_base (591)..(591): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccgaggccggtcgggggtccctgacgtactctccgtgtcgcacgtcctcgtcgggttccacccgtcagtcacacctacatgacgccgtcgggtccgccgaggccgtaccggagggggaagggtcgtgggagtcggtcgtttctttactttttaatttagtagtaggtggttacgtaccatacgtccgactacgtaacccgtccgggttgggaccggggtacccgtattacccaccgtactacctacccaaggtacaaactaacttaccgaaagtaactaccggttctttagttttaacccaaanaaacgtacgacgtacgtacggaggacgacgaccgtagaccgaccgtacggttcgttagttacttaggcggnggaacgaaggacgggtaccggaccgggtaacctaaacggttacgttacgcggtcgttagggtcggtaccgggtccgggacgggaacccgttaacccgggtccg

SEQ ID NO: 380056 - DNA, 510 bp, Homo sapiens
  misc_feature: GZ8MTXP01A8W2D.13.76.G10.1.454.CMB.2.raw
  modified_base (235)..(235): a, c, t, g, unknown or other
  modified_base (421)..(421): a, c, t, g, unknown or other
  modified_base (429)..(429): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggancagctccaacattggggcacattatgatgtacactggtaccagcagtttccaggagcaggtcccagactcctcatcaatacgtaaacaacaatcggcccgacgacggggtccctgacccgattctctcggctccaggtctggcacctcacgcctcctggtcatcactcgggctcggagcgtgaggntgagctgnttattctcgctgtccttagtcgacagcacgccttgaagtcgtcgtttcgggtaggttccgggcgggggttcccgtaacggg

SEQ ID NO: 380057 - DNA, 598 bp, Homo sapiens
  misc_feature: GZ8MTXP01DFH32.13.76.G10.1.454.CMB.2.raw
  modified_base (338)..(338): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgacgactctcctgtgcagcctcgtgggttcaccgtcagtcacacctacatgagcgtgggtcccgccaggcctccggaggggtaacggggcgtggagtgccgttntttctttatttatagtagtgtagtacatactccgacagtaacccgtccggtggacggggccctattccaaccctattccaccagagaactaagtaccaaagaaccagtcttgtttactacaaaatgaaactacgctaggaagacgccgatacgaccgacggtccgttagtacttacgtggtagaacgaggcgtaggccgggaccctaacgttaacgttcacggtaactagtggaccgtgcggggaaccgaacggaacccg

SEQ ID NO: 380058 - DNA, 613 bp, Homo sapiens
  misc_feature: GZ8MTXP01BCRT3.13.76.G10.1.454.CMB.2.raw
  modified_base (533)..(533): a, c, t, g, unknown or other
  modified_base (563)..(563): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagcgtgggcccgccgaggccgtccggggaaggggcggtggaggtgtcgtcttcttttatttattagtagtggtagtactactactcgcacgaccgtccgtcgggcggggccgtacgttacaccacgtctccacgagtaactaaacttaccgaaagaaaccacgtcctttgttttactacaaagtacgaacagcccgtagggagaggacccgagtacgaccgacgggtccgttagtataccgttgagcgaagngaggtccgggacccgaacgtaacgttccgngttcgtaagtcgggcgtacggtcggggacccggaacggccggtaacccgg

SEQ ID NO: 380059 - DNA, 697 bp, Homo sapiens
  misc_feature: GZ8MTXP01DJR5T.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtcgtggaggaggcttgatccagccgtggggggtccctgagactctcctgtgcagcctctgggttcaccgtcagtcacacctacatgagcgtgggtcccgccgaggcctccgagggggaaggggctgggagtgcgtcttcttttattataggtagtggtatacatacctccgacagccgtccgtgggacggggccagttccaccgatcctaccgagtacgaactaattacccaaagaaccacgtcttaggttttaccttaaccaaagttcgaaacgtacgtaccccgttaggaacggacgcccggtaagttcggaaaccgaccggggtcccggttaggttaacgtttaaccggttggttacgggaccgggtaaagggaacggtaacgggttaccggggggaccccccgaaacggggttaaaccccggttttaaccgaaccggttaacgttaacggtcgggggttacccggttaacgggttccggggggtaaaccccgg

SEQ ID NO: 380060 - DNA, 572 bp, Homo sapiens
  misc_feature: GZ8MTXP01AGQM0.13.76.G10.1.454.CMB.2.raw
  modified_base (434)..(434): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcgtgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtcccgccaggctccgaggggaaggggctggagtgcgtcttcgttttattatagtagtggtagtaccatactcgcagaactccgtgaggggccattcacatctccagagacaattccaagacacgctgtttctacaaatgaaacngcgtgagacgcgaagtcgacgacggtcgtagtacttacgtgcggaacgaggaggtacggttccggggaccctaacggttaccgttacgacgtcgtaggtcgggaccggtcgggacggggaacccgaacggggaacccg

SEQ ID NO: 380061 - DNA, 685 bp, Homo sapiens
  misc_feature: GZ8MTXP01CC4VQ.13.76.G10.1.454.CMB.2.raw
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctcagtcgtcccgttccccaggacagacagccagcatcacctgctctggagataaagttgggggataaatatgcttgctggtatcagcagaagccaggccacgtcccctgtgctggtcatctatacaagactaaccgaagccggacccctacgacgggtactccccccgtggacgtcgtacttccgtcttcgggtcctacccgtaaactccggttacggggaaaccacgaacggaccctaactcgtaccgaacctacgtaccgaacgggacccggggtaaccccaggggtccgttaggggtcgggtaagtacgggacggggtcttaacggtaacctttaagtttaaccgtggtacccggtaagggccgggtacggggaacacgggcgtaaacggccgtaaccgttccggacccttacccggttacgggaaaccggttcgggaaaccccggttagttccccgtaacccggtccgttaacggccgaacgaccccgtaacgggaacccctaaaccccg

SEQ ID NO: 380062 - DNA, 566 bp, Homo sapiens
  misc_feature: GZ8MTXP01ERML4.13.76.G10.1.454.CMB.2.raw
  modified_base (427)..(427): a, c, t, g, unknown or other
  modified_base (437)..(437): a, c, t, g, unknown or other
  modified_base (460)..(460): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggttcaccgtcagtcacacctacatgagctgggtccgccaggctccgagggaagggggctggagtgcgtcttctttttattatagtagtggtagtacatactcgcagaactccgtggaggggccgattcaccatctccagacgacaattccaaagacacgcttgttctanaaatgaaacnggcctggagagccgaatgaaccncggccgttgtattacgtgtgcgagaggagttcgggggaccccaaggttaaccgttcaacgccttaagtcgggaacgtcggttacgggggcccaaagggggaacccc

SEQ ID NO: 380063 - DNA, 574 bp, Homo sapiens
  misc_feature: GZ8MTXP01EKX0B.13.76.G10.1.454.CMB.2.raw
  modified_base (337)..(337): a, c, t, g, unknown or other
  modified_base (370)..(370): a, c, t, g, unknown or other
  modified_base (441)..(441): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtgggtcccgccgaggcctccggaggggagggggctgggagtgcgttctttntttttattatagtagtggtataccatactccgnagaactcgtggaggggccattcacatctcagagacaatccaaagacacgtcttgtttctacaaatgaaacngccgtgaagacgcccgatcgacgacgggccttagtattacgtgtggcgaggagacgttcgggggaccccaaggttaacgttccacggtctaagtcgggaccgttcggacgggggaacccgaaggggaaccccg

SEQ ID NO: 380064 - DNA, 711 bp, Homo sapiens
  misc_feature: GZ8MTXP01CC7R1.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtcgggtcccgccgaggcctccggaggggaagggggctgggagtgcgttctttcttttatttagtagtagtggtagtaccatactccgcagaaccgtccggtggacggggcccgtattccaccctatcctacccgaagtaacgaacctaaacttacccaaaagaacctaaccggtctttacggttttaccttaaccaaaattcgaaaccacggtcccgttaggaaacggaccggccccgaagttcggaacccgtaccgggtacccgtttgttaactttaccgtggtcggaacgggtaaggagggtacggttccggggggaaccccctaacgggttaaacccggttttacgacccggtccgttaaaggtcggggtaacccgggtttcgggaccggggggtaaccccgaaaacggggggtaacccccg

SEQ ID NO: 380065 - DNA, 575 bp, Homo sapiens
  misc_feature: GZ8MTXP01BDOMY.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagctgggtcccgccgaggcctccgagggggaagggggctgggagtgcgttcttcttttattagtagtagtggtagtacatactccgacagctccgtggacggggccgtattcaccatcctacagagacaattccaaagaacacgtctgtttacttacaaatcgaaacacgcctaggacgagcccgagtcgaaccgaccgggtccgttagttattacgtggtcgacggagagagtcgggggaccccaggaaccgttaacacgctaagtcggaccgtggttcggggaacccg

SEQ ID NO: 380066 - DNA, 638 bp, Homo sapiens
  misc_feature: GZ8MTXP01ENNQG.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagctctcctgtgcagcctgtgggttcaccgtcagtcacacctacatgagcgtcgggtcccgccgaggcctccggagggggaaggggctgggagtcggtcgttcttctttttattagtagtagttggtagtacatacctccgacagtccgtcggtgggacggggccctagttccacctatcctaccgaagacgtaacctaaattacccgaaaagtaacctacgtactttacgtttaccttaacaaaagttcgaaacgtacgtcccgtaggacgacggcccgaattcggaaaccgtccgggtaccgttagttacttacgtggtcgcggaaggttagacgtccgggggacccacggttaaccgtttcacgtctaggtcggaccggttcggttcggggaacccgg

SEQ ID NO: 380067 - DNA, 549 bp, Homo sapiens
  misc_feature: GZ8MTXP01DUU9B.13.76.G10.1.454.CMB.2.raw
  modified_base (327)..(327): a, c, t, g, unknown or other
  modified_base (438)..(438): a, c, t, g, unknown or other
  modified_base (480)..(480): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagcgtgggtcccgcaggctccgagggaggggctggagtgcgtcttnttttatttatagtagtgtagtacatactcgcagaactccgtggacgggccgtattccaccatctccagacgacaattccaaagaacacgtcttgtttctacaaatgaaacngcctagagagccgatgacacggcctgtactactgtgcgaagngagttcggggacccaggttaaccgttcacgctagtcgggtacgtcgttacggggccaacggggaacccg

SEQ ID NO: 380068 - DNA, 625 bp, Homo sapiens
  misc_feature: GZ8MTXP01AMXG0.13.76.G10.1.454.CMB.2.raw
  modified_base (438)..(438): a, c, t, g, unknown or other
  modified_base (466)..(466): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctggggttttccttgttgctattttaaaaggtgcccagtgtgaggtgcagctggtggagtcgtggaggaggcttgatccagccgtgggggtccctgagactctcctgtgcagcctcgtgggttccaccgtcagtcacacctacatgagcgtcgggtcccgccgaggcctccggaggggaagggggcgtgggagtgcgttcttcttttatttagtagtagtggtataccatactccgacagacctccggtggacggggcccgtattccaccatcaccagacgaactaacttaccgaaanaacacgtcttagtttctacaaatgaacngcctgacgcgcgatgaccgacggtcctagtacgtacgtggtaggcggaaggacgcggttaccgggggaacccctaacgggttaaccgtttaccgttaccggtcctaaggtcggtaacccgggtcggttacggggggaaccccaaacggggtaaccccgg

SEQ ID NO: 380069 - DNA, 793 bp, Homo sapiens
  misc_feature: GZ8MTXP01CHLZ9.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggtcaccgtcagtcacacctacatgagcgtgggtcccgcaggcctcgaggggaggggctggagtgtcgttctttcttttatttatagtagtggtagtacctatactcgcacgaccgtccggtggacggggtcccgtattccgacctacgtctacccgagaacgtaacaaacttaccgaaaacgtaacctaccggttacttttacggtttttaaccttaaacgaaaaacgttacggaaaccgtacggtaccccgttagggaaacgggtaacccgggaccggtaaacgttcccggaaaccccggtaccgggggttaaccccggtttgggtttaaaaccttttaacccgggttgggggttccgggtaacccgggaaagggttacggggtaaacgggtttaccccgggggggaaaccccctaaacgggttaaaacccggtttaacccgttaccggggtaacccttaaggggttcggggtaaccccgggtttacggggttaccggggggaacccccgttaaaacggggggtaacccccccg

SEQ ID NO: 380070 - DNA, 617 bp, Homo sapiens
  misc_feature: GZ8MTXP01CCT4Y.13.76.G10.1.454.CMB.2.raw
  modified_base (434)..(434): a, c, t, g, unknown or other
  modified_base (464)..(464): a, c, t, g, unknown or other
  modified_base (570)..(570): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgcttaattttaaaaggtgcccagtgtgaggtgcagcgtggtggagtcgtggaggaggcttgatccaggccgtgggggtccctgagactctcctgtgcagcctcgtgggtccaccgtcagtcacacctacatgagcgtcgggcccgccaggcctaccggaggggaagggctgggagtgtcgttctttcttttattagtagtagtggtagtacatactccgcagaacttccggtggacggggtccattccactactctaccagacacaactacccgaaanaacacgtcttagtttccaacaaatgaaacngccgtaggacgagccgatacgaccgtacggtccgttagtacttacgtggtacgaaggtaagaggtaacggccggggaaacctaacggttaaacgtttcgaccggtnttaggtcgggacgttcggacgggggtaacccaaacgggggtaacccc

SEQ ID NO: 380071 - DNA, 542 bp, Homo sapiens
  misc_feature: GZ8MTXP01CXX18.13.76.G10.1.454.CMB.2.raw
  modified_base (389)..(389): a, c, t, g, unknown or other
  modified_base (435)..(435): a, c, t, g, unknown or other
  modified_base (446)..(446): a, c, t, g, unknown or other
  modified_base (471)..(471): a, c, t, g, unknown or other
  modified_base (476)..(476): a, c, t, g, unknown or other
  modified_base (481)..(481): a, c, t, g, unknown or other
  modified_base (514)..(514): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggcccgcaggctccgaggggaaggggctggagtgcgtctttctttattatagtagtggtagtaccatactcgcagaactccgtgagggccgattcacatcncagagacaattccaaagaacacgtcttgtttactacaaatgaaacngccgtagaganccgaatgacgacggcctgtattacngtcgngaagngagttcggggacccagttaacgttcacgctagnggacgtcgttacgggccaaggggaaccc

SEQ ID NO: 380072 - DNA, 641 bp, Homo sapiens
  misc_feature: GZ8MTXP01DTA08.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagcttgggttttccttgttgctattttaaaaggtgcccagtgtgaggtgcagctggtggagtctggaggaggcttgatccagccgtgggggtccctgagactctcctgtgcacgcctcgtgggttcaccgtcagtcacacctacatgagcgtgggtcccgccgaggcctccggagggggaacgggggcgtgggagtcgtcgttctttactttttatttagtagttagttggtagtactatacctccgacagtccgtcggtggacggggccattcaccatcctacagagactaattaccaaagacacgtcttgttactacaaatcgaaacagccgtaggacgacgccgagtacggaaccgtaccgggtccgttagttactttccgtaaggtcggcggtaaaggaggtaacgggttccgggggaaccccttaacggggttaaaccgtttaaccaacggtccgttaaggtcggggaccgtttccgggaacggggggtaaccccg

SEQ ID NO: 380073 - DNA, 580 bp, Homo sapiens
  misc_feature: GZ8MTXP01BR9Q3.13.76.G10.1.454.CMB.2.raw
  modified_base (362)..(362): a, c, t, g, unknown or other
  modified_base (373)..(373): a, c, t, g, unknown or other
  modified_base (440)..(440): a, c, t, g, unknown or other
  modified_base (486)..(486): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagctgggtcccgccgaggccgtccgggggaaggggctgggagtgcgtctcttttatttatgtagtggtagtacatactcgnagactccgtgnggggccattcaccatctcagagcaattcaagacacgcttgtttctacaaatgaacagccctgggagngccgatcggaccacgggtccgtagttacttacgtgtcgcggaaggnggacgtcgggggccccaacggtaaccgttacgttacgccgtaagtcgggaaccggttcggtacgggggacccgaacgggggcccgtaacccggg

SEQ ID NO: 380074 - DNA, 603 bp, Homo sapiens
  misc_feature: GZ8MTXP01EGD5H.13.76.G10.1.454.CMB.2.raw
  modified_base (364)..(364): a, c, t, g, unknown or other
  modified_base (448)..(448): a, c, t, g, unknown or other
  modified_base (504)..(504): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagcgtgggtcccgccaggctccgaggggaggggctggagtgcgtctttcttttattatagtagtggtagtaccatactccgnacgaacctccggtggacggggcccgattcacctatctccagagacaattccaaagaccagtcttgtttactacaaatgaaaccncgacgtagacgacgccgagtacgaccgtaccggtacgttagttaacttacgtcggnggaacggtaaggacggtacggttccgggaccctaacggttaacgttacgttacgtcgttaggtcggtacggtcggacggggtaaccgaacggggtcccg

SEQ ID NO: 380075 - DNA, 635 bp, Homo sapiens
  misc_feature: GZ8MTXP01EFCWN.13.76.G10.1.454.CMB.2.raw
  modified_base (300)..(300): a, c, t, g, unknown or other
  modified_base (373)..(373): a, c, t, g, unknown or other
  modified_base (400)..(400): a, c, t, g, unknown or other
  modified_base (442)..(442): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgcttaattttaaaaggtgcccagtgtgaggtgcagcgtggtggagtcgtggaggaggcttgatccagccgtgggggtccctgagactctcctgtgcagcctcgtgggttcaccgtcagtcacacctacatgagcgtgggtcccncgaggctccggaggggaacggggctaggagtgcgtctttacttttaagttatagtagtgtagtacatactcgnacgaactcgtgacgggccatccactanctacagacacaactacaagaacacgtcttagtttacctaaanaaatacgaaacacgtaccgtagaacggacgacgagtacgacgtaccggtaccgttagtacgttacgtgacggaacggaaggttacggaccggttacccgggtaaccccgtaaacggttaacccgttaccgttacgtaacgttaggtaacgggtaccggtcgggttaccggggaacccgaaaccggggaacccg

SEQ ID NO: 380076 - DNA, 537 bp, Homo sapiens
  misc_feature: GZ8MTXP01DR73U.13.76.G10.1.454.CMB.2.raw
  modified_base (170)..(170): a, c, t, g, unknown or other
  modified_base (212)..(212): a, c, t, g, unknown or other
  modified_base (432)..(432): a, c, t, g, unknown or other
  modified_base (449)..(449): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctntaggaaataatggacagaataaatatacttctggtatcagcagagtcaggccagtcccctgtgctggtcatctatcaagatcgaccaagccgcctcgaggctcccccgtgacgcgtacttctcgtcggctaccaaacgtcgtaggggaacctcacgcccactctagaccatccgacggaccgggacccagggctagtgagtgaggctagtactattacgngtcgaggcgtagggacngcagcaacgtcgcccgtgttacgttcgtcgttacggacgttcgggaaccaaggttcccaccgttaccttaacggtccaacgaaccccg

SEQ ID NO: 380077 - DNA, 609 bp, Homo sapiens
  misc_feature: GZ8MTXP01AU5HS.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtcgggtccgccgaggcctccgaggggaggggctggagtgcgtcttcttttatttatagtagtggtagtaccatactcgcagaactccgtgacggggcgattcaccatctccagagacatccaaagacacgcttgtttctacgaaatgaaacagccgtagacggacgaccgatcggacacggccgttagtactttactggtcgaacggaagttgggacgttcgggggacccctaacggttaaaccggtttccttaaccgggaacttacggtaacggggtaaccgttccgggttacggggggaaccccaaaaggggggtccccg

SEQ ID NO: 380078 - DNA, 631 bp, Homo sapiens
  misc_feature: GZ8MTXP01D9ETN.13.76.G10.1.454.CMB.2.raw
  modified_base (457)..(457): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagctctcctgtgcagcctcgtgggttcaccgtcagtcacacctacatgacgcgtgggtcccgccgagggcctaccggagggggaacggggcgtgggagtgtcgttcttcttttaattagtagtagtggtagtacatactccgacagcgtcgtgggacgggcgtactcacatccacagacgactaacttaccgaaagactacgtcttacgtttacctaanaaaagtcgaaacgacggtcccgtaggaacgacgacccgtatacggaaccgcgggtccgttagttacttacgtgtggacggaagaggacggtccgggggaaccccttaaggttaacccgtttaacgaccgtcgttaaggtcgggttacggtccggggttaaccggggaaacccgg

SEQ ID NO: 380079 - DNA, 575 bp, Homo sapiens
  misc_feature: GZ8MTXP01BX1BU.13.76.G10.1.454.CMB.2.raw
  modified_base (394)..(394): a, c, t, g, unknown or other
  modified_base (410)..(410): a, c, t, g, unknown or other
  modified_base (430)..(430): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggtcaccgtcagtcacacctacatgagctgggtccgccaggctccgagggaggggctggagtgcgtcttcttttattatagtagtggtagtacatactccgcagaactccgtggaggggccgattcacatctccaganacatccaagaacacgnttgttctacaaatcgaaacncgcctaggagacgcccgatcgaccgacgggccgttgtaacttactggtgcggaaggagtacgttcgggggacccctaaggttaaaccgttcttaccggcttagtcgggaccgtcggttacgggggaacccaaagggggaaccccg

SEQ ID NO: 380080 - DNA, 563 bp, Homo sapiens
  misc_feature: GZ8MTXP01C3JM8.13.76.G10.1.454.CMB.2.raw
  modified_base (394)..(394): a, c, t, g, unknown or other
  modified_base (399)..(399): a, c, t, g, unknown or other
  modified_base (409)..(409): a, c, t, g, unknown or other
  modified_base (437)..(437): a, c, t, g, unknown or other
  modified_base (449)..(449): a, c, t, g, unknown or other
  modified_base (468)..(468): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtcgtggaggaggcttgatccagccgtgggggtccctgagactctcctgtgcagcctcgtgggttcaccgtcacgtcacacctacatgagcgtcggtcccgcaggcctccgaggggaaggggcgtggagtcgcgttctttcttttattatagtagtgtagtaccatactcgcagaactcgtggagggccatcaccatcncaganacatccaaanacagtcttgtttactacaaatcgaaacncgcgtagagacnccgatcgacgacggcgttntattacgtgtgcgagagacgttcggggacccaaggttaaccgttcacggctaagtcggaacggtcgttacgggggaacccttaacggggaacccg

SEQ ID NO: 380081 - DNA, 499 bp, Homo sapiens
  misc_feature: GZ8MTXP01EEVMT.13.76.G10.1.454.CMB.2.raw
  modified_base (343)..(343): a, c, t, g, unknown or other
  modified_base (385)..(385): a, c, t, g, unknown or other
  modified_base (388)..(388): a, c, t, g, unknown or other
  modified_base (390)..(390): a, c, t, g, unknown or other
  modified_base (403)..(403): a, c, t, g, unknown or other
  modified_base (408)..(408): a, c, t, g, unknown or other
  modified_base (436)..(436): a, c, t, g, unknown or other
tcagtcacgtactacacgaccggtgctcgatttagtcactcatacagggctgggcctcaggaagcagcatcggaggtgcctcagccatggcatggatcctctcttcctcggcgtccttgcttactgcacaggatccgtggcctcctatgagctgactcagccaccctcagtgtcccgtgtccccaggacagacagccagcatcacctgctctggaaataaattggcagataaatatacttcctggtatcagcagaagtcaggccagtcccctgtgctggtcatctatcaagatgccaagcggccctgagggatccccctgagcgattctctggctcaaactcngggaactcagccactctgaccatcagcgggacccaggctagngangngcgtgactatacngtcgnggcgtaggcagcagcaacgtcgcccgtnttacgtcgtcgttacggacgttcgggaacctaaggtccaccgtacttaacgtccgaacgcccg

SEQ ID NO: 380082 - DNA, 532 bp, Homo sapiens
  misc_feature: GZ8MTXP01CE30W.13.76.G10.1.454.CMB.2.raw
  modified_base (236)..(236): a, c, t, g, unknown or other
  modified_base (266)..(266): a, c, t, g, unknown or other
  modified_base (312)..(312): a, c, t, g, unknown or other
  modified_base (315)..(315): a, c, t, g, unknown or other
  modified_base (347)..(347): a, c, t, g, unknown or other
  modified_base (355)..(355): a, c, t, g, unknown or other
  modified_base (378)..(378): a, c, t, g, unknown or other
  modified_base (406)..(406): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctctatgagctgactcagcccacctcagtgtccgtgtccccaggacagacagccagcatcactgctctaggaaataatggacagataaatntactctgatcagcagatcagcagtccctgngctgtcatctatcaagatgaccaagccgcctagaggactcccccgngancgtatcactgctccaaatcgtggaactcgacnccactcanacagcgacgaccgacagactagngagtagacgtcgtacgtactagttacgngtacgaggcggtacggacacggacgacgtaccgaacgtcgccgtacgttacgtacgtacgttacggttacggttacggtaaccgtacggtaaccgtaccgtaccgttacgtaaccgaaccgaaccg

SEQ ID NO: 380083 - DNA, 575 bp, Homo sapiens
  misc_feature: GZ8MTXP01BLYKZ.13.76.G10.1.454.CMB.2.raw
  modified_base (170)..(170): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctctaggaaataatggcagataaatatactcctgtatcagcagagtcaggccagtcccctgtgctggtcatctatcaagatcgaccaaggccggccctacgaggggactccccccgtaggacgcgtattcctaacgtcggcctacctaaactcgtacgggaactcgacgccctactctacgaccatccgagaccggacccaggcctagtgatgacggctagtacttagttacgtgtcgaggtcggtagggaactaggacacgcctaaccgtcgccccggtattacgtcggttccgttacgggacgttccgggtaaccgtaacggtccgtaacccggtccgttaaacgtcccgaaccggaacccccg

SEQ ID NO: 380084 - DNA, 562 bp, Homo sapiens
  misc_feature: GZ8MTXP01EV0DO.13.76.G10.1.454.CMB.2.raw
  modified_base (437)..(437): a, c, t, g, unknown or other
  modified_base (481)..(481): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtgggtcccgccgaggcctccgaggggaggggctggagtgcgtcttcttttattatagtagtggtagtacatactcgcagaactccgtggacggggccattcaccatctccagagacaatcaaagacacgtcttgttctacaaatgaaacngccgtagagcgaccgatcgaccgacggccttgtattagtggtgngaagaggtagttcgggggacccctaaggttaacgtttcaacgtctagtcggacgtcggacggggaaccgaaaggggccccg

SEQ ID NO: 380085 - DNA, 547 bp, Homo sapiens
  misc_feature: GZ8MTXP01C8QK8.13.76.G10.1.454.CMB.2.raw
  modified_base (435)..(435): a, c, t, g, unknown or other
  modified_base (474)..(474): a, c, t, g, unknown or other
  modified_base (480)..(480): a, c, t, g, unknown or other
  modified_base (516)..(516): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgccaggctccgaggggaggggctggagtgcgtcttctttattatagtagtggtagtacatactcgcagaactcgtgacggggccattcaccatctccagagacaattcaaagaacacgtcttgtttccttacaaaatgaaacngccgtagagagcccggatcgaccaggtccgtgtattacngtcggngagagacgttggggcccagaacgttcttacgttaanggaacgtgtcggggacctaagggcctaacgg

SEQ ID NO: 380086 - DNA, 584 bp, Homo sapiens
  misc_feature: GZ8MTXP01DWDRM.13.76.G10.1.454.CMB.2.raw
  modified_base (402)..(402): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgccgaggcctccgaggggaaggggctgggagtgcgtcttcttttattatagtagtcggtagtacatactccgacagcgtcgtggacgggccgattcacatctcaganacaattccaaagacacgtctagtttctacaaaatcgaaacacggcctaggacgacgcccgagtcggaaaccgtcgggccgttaggtattaccgtgttcggacgaggacgtaaggtcgggggaccccacggttaaacgttaacgtaacgcgttaggtcggaccgttcggttcgggggaacccg

SEQ ID NO: 380087 - DNA, 656 bp, Homo sapiens
  misc_feature: GZ8MTXP01ALJ7H.13.76.G10.1.454.CMB.2.raw
  modified_base (297)..(297): a, c, t, g, unknown or other
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagcccacctcagtgtccgtcgtccccaggacagacagccagcatcacctgctctagaaataagtggacagataaatatacttctggtatcagcagaagtcaggccagtcccctgtgctggtcatctatcaagtntcgaccaaggccgcctagacggtacctcccgtgacgtctattcctcgtcgcctacccgaacgtcgtacgggaactcacgccctactcgtcgacgactcgacgggccgggacccagggtaccttaggtggagttacgggacggggtacgtacggtaacctttacgttacgtcgggtacgacggggtcgggttacggggacacggccgaacgtccgtaaccgttccggtacccccggttgttaccggttacggttccccggttaacggggttaaacccgggttccggggaaaccccggtaaccggggttaccccgtaacccccgggttacgttaaaaccgggttccccggaaaaccccggg

SEQ ID NO: 380088 - DNA, 575 bp, Homo sapiens
  misc_feature: GZ8MTXP01ATBI6.13.76.G10.1.454.CMB.2.raw
  modified_base (358)..(358): a, c, t, g, unknown or other
  modified_base (383)..(383): a, c, t, g, unknown or other
  modified_base (408)..(408): a, c, t, g, unknown or other
  modified_base (415)..(415): a, c, t, g, unknown or other
  modified_base (423)..(423): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgcaggctccgagggaaggggctggagtgcgtctcttttatttatagtagtgtagtaccatactcgnagaactcgtgagggccatcacatcncagagacattccaagacacggtttnttactanaatgaacngctagggacgacgcgagacgaccgacggtcgtagtacttacgtgtcgaggaaggaagttcggtccggggacccctaaacggttaacgttaccgttacgcgtaaggtcgggtaaccgtcgggtacggggacccgtaacggggcccgtaaccgg

SEQ ID NO: 380089 - DNA, 717 bp, Homo sapiens
  misc_feature: GZ8MTXP01DV77T.13.76.G10.1.454.CMB.2.raw
  modified_base (658)..(658): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctatttaaaggtgccagtgtgaggtgcagctggtggagtcgtgggaggaggcttgatccagccgtgggggtcctgagactctctgtgcagcctcgtggttccaccgtcacgtcacacctacatgacgcgtcgggtcccgccgacgggccgtaccggagggggaaacgggggcgtaggggagtcggtccgttctttacgttttttaatttagtaggttaggttaggttaagtaactataccgtcccgaacgaacgtccgtcccggtagggacggggaccgtacttccacctactccctaccgaaggaactaactaacttacccgaaaaggtacctaacggttcttagtttaccttaacaaaagtcgaaactagccctaggaacgacgaccgagacggaaccgaccgggtaccgttaggttaaacttcggttggcgacgggaaagggttacggtacgggttccgggggaacccccttaaagggttaaacccggttttaanacccggtaacgttagggtcgggttaaccccggttcgggttaacgggggaaacccccggg

SEQ ID NO: 380090 - DNA, 558 bp, Homo sapiens
  misc_feature: GZ8MTXP01DS9XR.13.76.G10.1.454.CMB.2.raw
  modified_base (435)..(435): a, c, t, g, unknown or other
  modified_base (472)..(472): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggtcaccgtcagtcacacctacatgagctggtccgcaggctccgagggagggctggagtgcgtcttcttttattatagtagtggtagtaccatactccgcagaacctcgtggaggggcctattcaccatctccagagacaagttccaaagaacacgtcttgtttctacaaatgaaacncgcctagagagcccgatcgacaccggcctgtattacnggtgcgagagagttcgggaccctacggaaacgtttcacgtcctaagtcgggtacgtcggttacggggaaccaacgggggaaccccg

SEQ ID NO: 380091 - DNA, 581 bp, Homo sapiens
  misc_feature: GZ8MTXP01D653F.13.76.G10.1.454.CMB.2.raw
  modified_base (439)..(439): a, c, t, g, unknown or other
  modified_base (488)..(488): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggtcaccgtcagtcacacctacatgagcgtgggtcccgccgaggctccgagggaagggggctggagtgcgtctttcttttattatagtagtggtagtacatactccgcagaacctccgtggacgggccgattcaccatctccagagacaatccaagaacacgtcttgtttctacaaatgaaacngccgtagagacgccgatcggacacgggccgtgtattacgtgtgcgtagnggtaacgttcgggggaccctaacggttaacgtttcgttacgctagtcgggtaccggtcggttacgggggaacccgttaacgggggtaaccccg

SEQ ID NO: 380092 - DNA, 542 bp, Homo sapiens
  misc_feature: GZ8MTXP01DZICB.13.76.G10.1.454.CMB.2.raw
  modified_base (447)..(447): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtcccgtgtccccaggacagacagccagcatcacctgctctaggaaataaattggcagataaatatacttctggtatcagcagaagtcaaggccagtcccctgtgctggtcatctatcaagatgaccaagcggccctgagggactccccccgtgagcgtattcctctcggctccaaactcgtagggaacctcgacgtcccactctacgaccatcgacggccgggacccaggctagtgatgaggctgtacttattactgtcgaggcgtagggacnggcagcaactcgcccgtacttagtcgtcgttcgggaaccttgggggaaccctaaaggggtcctacccggtaccttaaggtcccgaacgaaccccg

SEQ ID NO: 380093 - DNA, 545 bp, Homo sapiens
  misc_feature: GZ8MTXP01BLQHN.13.76.G10.1.454.CMB.2.raw
  modified_base (460)..(460): a, c, t, g, unknown or other
  modified_base (471)..(471): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggtcaccgtcagtcacacctacatgagctgggtcccgcaggctccgaggggaaggggctggagtgcgtcttcttttattatagtagtggtagtacatactcgcagaactccgtgagggccgattcaccatctccagtagactaatccaaagaacacgctagtttctacaaatgaaactgcctgagagccgatcgacacggcctntattactggtncgagagacgttcgggggacccaaggttaacgttcacggctagtgggacgttcgcggggaaccgaaaggggcccc

SEQ ID NO: 380094 - DNA, 624 bp, Homo sapiens
  misc_feature: GZ8MTXP01CHI96.13.76.G10.1.454.CMB.2.raw
  modified_base (519)..(519): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggtcaccgtcagtcacacctacatgacgcgtcgggtcccgccacggctccggaggggaagggggctggagtgcgttctttcttttatttagtagtagtggtagtaccatactccgcagaactccgtggacgggccgtattcacctatctaccagacgaactaattacccaaagaactacgtcttagtttactaacaaaatcgaaactacgccgtaggaacgacgcccgtaatcggaccgacgggtccgtagttaactttaccgnggtcggaacgtaaggacggtacgttcgggggaccccaaggttaacgtttacacggtctaaggtcgggaaccgtcggttacgggggaacccaaagggggtaacccc

SEQ ID NO: 380095 - DNA, 664 bp, Homo sapiens
  misc_feature: GZ8MTXP01CS7KA.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtcgggtcccgccgaggcctccgaggggaagggggctgggagtgcgtcttctttattatagtagtggtagtacatactcgcagaactcgtggacgggccgattcaccatctacagagactaattccaaagaacacgtcttagtttacctacaaaagttcgaaacacggtacccgttagggaacggtacgaccccggtaattacgggaacccgtaacggggtcccggtttagttaacttttaaccgtgggttcggcggtaaggacggtaacggttccggggggaaccccctaagggttaaacccgttttcaaccgggtccttaaggtcggggtaaccggttccgggttacgggggtaaccccgaacggggggtaaccccg

SEQ ID NO: 380096 - DNA, 561 bp, Homo sapiens
  misc_feature: GZ8MTXP01D4URT.13.76.G10.1.454.CMB.2.raw
  modified_base (388)..(388): a, c, t, g, unknown or other
  modified_base (447)..(447): a, c, t, g, unknown or other
  modified_base (462)..(462): a, c, t, g, unknown or other
  modified_base (472)..(472): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctggtttcctgttgctatttaaaggtgcccagtgtgaggtgcagctggtggagtcgtggaggaggcttgatccagccgtgggggtccctgagactctcctgtgcagcctctgggtcaccgtcagtcacactacatgagctggtccgccaggctccgagggaaggggctggagtgtcgtcttcttttattatagtagtgtagtacatactcgcagaactcgtggagggccgattcaccatctaccaganacaatccaaagacacgtcttagtttctacaaatcgaaacagcctagagaacgccgtaancgacgacggtcgttntattacgtgngaagagaggtacgttcgggaaccctaacgttaaccgttcttacgtaactagtcgggtacggtcggacggggaaccgaacggggtaaccc

SEQ ID NO: 380097 - DNA, 594 bp, Homo sapiens
  misc_feature: GZ8MTXP01AX4W9.13.76.G10.1.454.CMB.2.raw
  modified_base (440)..(440): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggtcaccgtcagtcacacctacatgagcgtcgggtcccgcaggcctccgaggggaggggctgggagtgcgtcttcttttattatagtagtggtagtacatactcgcagaactccgtgacggggccattcacatctacagagacaattccaaagaacacgtcttgtttactacaaaatcgaaacncggcctaggaagacgcccgaagtcgaacgaccgggtccgttagttacttacgtggtggaacggaagaggacggttcgggggacccctaaggttaaccgtttcacggtctagtcgggaaccgtcggttacgggggaacccaacgggggtaacccg

SEQ ID NO: 380098 - DNA, 639 bp, Homo sapiens
  misc_feature: GZ8MTXP01D6UTV.13.76.G10.1.454.CMB.2.raw
  modified_base (464)..(464): a, c, t, g, unknown or other
  modified_base (475)..(475): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtgggaggaggcttgatccgagccgtcgggggtcctgagactctcctgtgcagcctcgtgggttcaccgtcagtcacacctacatgagcgtcgggtcccgccgaggcctccggaggggaacgggggcgtgggagtggtcgttctttactttttatttattagttaggtggttacgtacctatactccgcacgaacctcggtggacgggcctattccacctactctacagagaactaataccaaagaacacgtcttagttctanaaactgaaacngaccgtaggacgacgccgtatcgaaccgacggtccgttagttacttacgtgcggaacggagagcggttccgggggaaccctaacgggttaaaccgtttcgaaccgtcgttaacggtcgggtaaccggtcgggacgggggtaaccccaaacgggggtaacccccg

SEQ ID NO: 380099 - DNA, 594 bp, Homo sapiens
  misc_feature: GZ8MTXP01DCD5F.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtcgggtcccgcaggcctccgaggggaagggggctggagtgcgttcttcttttatttatagtagtggtagtaccatactcgcagaactcgtggacggggccgtattccacctatcctaccagacgaacaacttccaaagaacacgtcttgtttacttacaaatgaaacagccgtgaagacgccgaatcgacgaccggtccgttagtacttacgtgtgcggaagagacgttcgggggaccccaacggttaacgttcacggtctagtcgggtaccgtcggttcgggggaacccgttaacggggaacccg

SEQ ID NO: 380100 - DNA, 599 bp, Homo sapiens
  misc_feature: GZ8MTXP01A3990.13.76.G10.1.454.CMB.2.raw
  modified_base (383)..(383): a, c, t, g, unknown or other
  modified_base (385)..(385): a, c, t, g, unknown or other
  modified_base (390)..(390): a, c, t, g, unknown or other
  modified_base (424)..(424): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggtcaccgtcagtcacacctacatgagctgggtccgccaggctccgaggggaagggggctggagtgcgtcttcttttattatagtagtgtagtacatactcgcagaactccgtgacgggcatcacancncaganacatccaagacacgcttgttctacaaatgaaacncgcgtaggagacgaccgaagtcggaaccgtaccggtccgttagttaacgttacgtggtcggaacggaaggacggtacgggttacccggggaacccctaaacgggttaaccgtttaccgaccggtcttaggtcgggtaccggtacgggacgggggtaaccgaaccggggtaacccg

SEQ ID NO: 380101 - DNA, 557 bp, Homo sapiens
  misc_feature: GZ8MTXP01BRVYT.13.76.G10.1.454.CMB.2.raw
  modified_base (361)..(361): a, c, t, g, unknown or other
  modified_base (437)..(437): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggctttccttgttgctattttaaaaggtgcccagtgtgaggtgcagctggtggagtctggaggaggcttgatccagccgtgggggtccctgagactctcctgtgcagcctctgggttcaccgtcagtcacacctacatgagctcggtccgccaggctccgaggggaaggggctggagtgcgtcttcttttattatagtagtggtacgtacatactccgnaagactcggtgacggggcctagttcaccatctaccagagacaattccaagaacacgtctgttctacaaatgaaccnggcctagagacgccagtgaacgaccggtccgtgtaattaccgtggtggcgaggagacgtcgggggacccttacgttacgttactaacggctaagtggacgttcgtcggggccgaacgggg

SEQ ID NO: 380102 - DNA, 611 bp, Homo sapiens
  misc_feature: GZ8MTXP01CDHJR.13.76.G10.1.454.CMB.2.raw
  modified_base (250)..(250): a, c, t, g, unknown or other
  modified_base (511)..(511): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcngcctcgtgggtcaccgtcagtcacacctacatgagcgtcgggtcccgccgaggcctccgaggggaaggggctggagtgcgtcttcttttattatagtagtgtagtaccatactccgcagaacctccggtggacgggccgtattcaccatctaccagacgaactaacttccaaagaaccacgtactttgtttacctacaaaactgaactacggcccgtaggaacgacgacccgatcgaccgaccggtccgtgtaacttacgngtgaacgaggagtacggttcgggggacccctaaggttaaccgtttcacgtcgtagtcgggaacggtcgggttacgggggaacccgaacggggtaaccccg

SEQ ID NO: 380103 - DNA, 555 bp, Homo sapiens
  misc_feature: GZ8MTXP01D2RB1.13.76.G10.1.454.CMB.2.raw
  modified_base (430)..(430): a, c, t, g, unknown or other
  modified_base (481)..(481): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgagggagggggctggagtgcgtcttcttttatttatagtagtggtataccatactccgcagaacctccgtggacggggccgattcacccatcctccagagacaaattccaaagaacacgcttgttcttnaaatgaacagcctagagagcccgaatgacgaacggccgtgtattactgtgngagagagttcgggggacccctacggaaacgttcacggctaagtggaccgtgttcggggccgaacggggaacccg

SEQ ID NO: 380104 - DNA, 543 bp, Homo sapiens
  misc_feature: GZ8MTXP01ATP3A.13.76.G10.1.454.CMB.2.raw
  modified_base (383)..(383): a, c, t, g, unknown or other
  modified_base (386)..(386): a, c, t, g, unknown or other
  modified_base (391)..(391): a, c, t, g, unknown or other
  modified_base (423)..(423): a, c, t, g, unknown or other
  modified_base (501)..(501): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtgggtccgccaggctccgaggggagggctggagtgcgtcttcttttattagtagtagtggtagtaccatactcgcagactccgtgagggccatcacntcncaganacatcaagacacgcttgttctacaaatgaacngcctgagagccgatcgacgacggccgtgtatacgtgtgcgagagagttcggggacccaacggttaaccgttcaccgtntagtcgggacgtcggttacggggaacccgaaggggaaccccg

SEQ ID NO: 380105 - DNA, 543 bp, Homo sapiens
  misc_feature: GZ8MTXP01ANSJD.13.76.G10.1.454.CMB.2.raw
  modified_base (438)..(438): a, c, t, g, unknown or other
tcagtcacgtactacacgaccggtgctcgatttagtcactcatacagggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtgggtcccgccaggctccgaggggaggggctggagtgcgtctcttttattatagtagtggtagtaccatactcgcagaactccgtgaggggccattcaccatctccagagacaattccaagaacacgctgttctacaaatgaacagcctgagngccgatgacacggccgtgtattactgtgcgagacgagttcgggggaccccaaggaacgtttcacggctagtcgggacgtcgttgggggcccaagggggaaccccg

SEQ ID NO: 380106 - DNA, 511 bp, Homo sapiens
  misc_feature: GZ8MTXP01A2V55.13.76.G10.1.454.CMB.2.raw
  modified_base (187)..(187): a, c, t, g, unknown or other
  modified_base (235)..(235): a, c, t, g, unknown or other
  modified_base (245)..(245): a, c, t, g, unknown or other
  modified_base (260)..(260): a, c, t, g, unknown or other
  modified_base (348)..(348): a, c, t, g, unknown or other
  modified_base (418)..(418): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgccctnagtgtctggggccccagggcagagggtcaccatctcctgcactgggancagctccaanattggggcacattangatgtacactggtaccagcagtttccaggagcaggtcccagactcctcatcaatacgtaacaacaatcggcccgacgacggggtcccngaccgattctctgctccagtctggcacctcacgcctccctgtcactcactgggctccgagctgaggatgngctgtattattcgtcgtccaagttcccttaagtcgaccgagcagttccttgaagtgtcgttacgggtcgttccgggtcgggggaaccctcggg

SEQ ID NO: 380107 - DNA, 534 bp, Homo sapiens
  misc_feature: GZ8MTXP01CJ6O0.13.76.G10.1.454.CMB.2.raw
  modified_base (475)..(475): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggggttcaccgtcagtcacacctacatgagctgggtccgccaggctccgaggggaagggggctgggagtgcgtctcttttatttatagtagtggtagtaccatactccgcagaactccgtgaggggccattcaccatctccagagacaattccaagacacgctgttctcaaatgaacagcctgagagccgatgacacggcctgtattactgtgcgtagagngttcggggcccagacgttcttacgctgtcggacgtcgttcggggccgaaggggaacccg

SEQ ID NO: 380108 - DNA, 734 bp, Homo sapiens
  misc_feature: GZ8MTXP01D5X4N.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggtttcctgttgctatttaaaggtgccagtgtgaggtgcagcgtggtggagtcgtgggaggaggcttgactccaggccgtgggggtccctgagactctcctgtgcagcctcgtgggtcaccgtcagtcacacctacatgagcgtcgggtccgcgaggctccggaggggaggggcgtggagtgtcgttctttcttttatttagttagtaggtggttacgtacactacgtccgacacgtaaccgtcggtgggacggggccgtaacttccaacctacgtcctaccaaagggtactaaacctaaacttaccgaaaaggtaaccctaaccggttcttttacggttttaccttaaacgaaaaaacgttcggaaaaacctcggtacccgttaaggggaaacggtaaccggacccggtaaagtccgggaaaccgtaccggggtaccggtttaagttaactttaccggttggacgggaacggtaagggacggtaaacgggttcccgggggaaacccctaacgggttaaaccgtttcttaacgggaacttaggtcgggtaccgggtcgggttacgggggtaaccgaacgggggtaaccccg

SEQ ID NO: 380109 - DNA, 569 bp, Homo sapiens
  misc_feature: GZ8MTXP01ACITZ.13.76.G10.1.454.CMB.2.raw
  modified_base (487)..(487): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgccaggctccgagggaaggggctggagtgcgtcttcttttattatagtagtggtagtacatactccgcagaactccgtgacggggccgattcaccatctccagagacaattccaagaacacgcttgtttcttacaaatgaacagcccgtgacgagcccgatcgacacgggccgtagtacttactgtgcgaaggngtagttcgggggaccccaacggttaaccgttacgaccgtctagtcgggacggtccgttacggggaaccgaaggggaaccccg

SEQ ID NO: 380110 - DNA, 650 bp, Homo sapiens
  misc_feature: GZ8MTXP01AU7FA.13.76.G10.1.454.CMB.2.raw
  modified_base (360)..(360): a, c, t, g, unknown or other
  modified_base (399)..(399): a, c, t, g, unknown or other
  modified_base (426)..(426): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtctggaggaggcttgatccagccgtggggggtccctgagactctcctgtgcagcctcgtgggtcaccgtcagtcacacctacatgagcgtgggtcccgcaggcctccgaggggagggctggagtgcgtcttcttttattatagtagtggtagtacatactccgnacgaactcgtggacggggcctagtccactatctacaganacatccaaagacacgcttgtttactanaaattcgaactacgccgtagaacggtacgacccgtaagcgaaccgtaccgggtccggttagttaaacctttacgtcgggtggaaccggtaaaggaacgggtacgttaccggggggacccccctaaaaggggttaaacccgtttaccgttaacccgggtcctttaaggcggggtaacccggtttcgggttaccgggggtaaccccgaaacggggggtaacccccg

SEQ ID NO: 380111 - DNA, 546 bp, Homo sapiens
  misc_feature: GZ8MTXP01C5FIB.13.76.G10.1.454.CMB.2.raw
  modified_base (330)..(330): a, c, t, g, unknown or other
  modified_base (358)..(358): a, c, t, g, unknown or other
  modified_base (451)..(451): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctatttaaaggtgcccagtgtgaggtgcagctggtggagtctggaggaggcttgatccagccgtgggggtccctgagactctcctgtgcagcctcgtgggttcaccgtcagtcacacctacatgagcgtgggtcccgcaggctccgaggggaagggctggagtgcgtcttnttttattatagtagtggtagtacatacncgacagcgtcgtggacgggccgatcacatctcagagacaattaccaagacacgtctagttctactaaatgaacagccgtgagagccgatgacncggtccgtagtacttactggtcgacgaggagacgtcgggggaccccacggaaccgtttcaacgtctaagtcgggacggtcgttcgggggaacccg

SEQ ID NO: 380112 - DNA, 710 bp, Homo sapiens
  misc_feature: GZ8MTXP01AHYIU.13.76.G10.1.454.CMB.2.raw
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctagaaataatggacagataaatatacttcctggtatcagcagagtcaggccagtcccctgtgctggtcagtctatcaagatcgaccgaagccggccctcgacggggactccccccgtagacgtcgtaattccgtacgtcgggcctacccgaaacgtcgttacggggaaaccttcgaacgtccccaacgtcctacggaaccctagtaccgaacggcccgggaacccagggtccgtagttacgggagttacggaacgggtcttaggtaacccgtttagtttaaccgttcgggttaccgaaggggtccggttacgggggactaaaccgggccgtaacggtcccgaacgttccgggaccccgtacgtttaacggtcggtttaaccggtttacccgggttaaaccgggttaccgggggtaaaccccgttaacgggggttcccctaaacccgggtttacccgttaaacgggttaaccccgaacccgggtaaacccccccggg

SEQ ID NO: 380113 - DNA, 563 bp, Homo sapiens
  misc_feature: GZ8MTXP01ADEG7.13.76.G10.1.454.CMB.2.raw
  modified_base (294)..(294): a, c, t, g, unknown or other
  modified_base (362)..(362): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtgggtccnccaggcctccgaggggaggggctggagtgcgtcttcttttattatagtagtggtagtacatactccgnagaactcgtggacggggccgattccaccatcctccagacgaacaattccaaagaaccacgtcttgtttctacaaatgaaactgccgtagagagccgatgacacggtccgtgtattacgtgtgcgagagcgttcggggacccaaggacgtttacgacgtctagtcgggaccgtcggttcggggaaccgaacggggaaccccg

SEQ ID NO: 380114 - DNA, 599 bp, Homo sapiens
  misc_feature: GZ8MTXP01BOS5L.13.76.G10.1.454.CMB.2.raw
  modified_base (515)..(515): a, c, t, g, unknown or other
  modified_base (563)..(563): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtcgggtccgccaggcctccgaggggaaggggctggagtgcgttcttctttttagttatagtagtggtagtaccatactcgcacgtaactccggtggacggggcctagttccacctatcctaccagagaactaacttaccaaagaaccacgtcttacgtttactacaaatgaaacacgccgtagaacggacgaccgaatgacgaccggtaccggtagtacttacgtgnggtaacgagaggacgttcgggggccccaacggttacgtttacaccggntagtggaccgtcgaggaaccggaacccgaaacgggg

SEQ ID NO: 380115 - DNA, 633 bp, Homo sapiens
  misc_feature: GZ8MTXP01BIF6S.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtgggtcccgcaggcctccgaggggaggggctggagtgcgttcttcttttattatagtagtgtagtaccatactcacagaactccgtggacgggccgattccaccatcctaccagacactaattccaaagaccacgtcttagtttacctacaaatcgaaactagcccgtaggaacgacgacccgaagtcgaaccgtaccgggtacccgttagttacttacgtggtcgaacggtaaggacggtacggttccgggggacccctaacgggttaaaccgtttacgacccggtcttaaggtcgggtaacccggtcgggttaacggggggaaccccaaaagggggtaacccccg

SEQ ID NO: 380116 - DNA, 575 bp, Homo sapiens
  misc_feature: GZ8MTXP01DCFZW.13.76.G10.1.454.CMB.2.raw
  modified_base (395)..(395): a, c, t, g, unknown or other
  modified_base (478)..(478): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtcccgccaggcctccgaggggaaggggctggagtgcgtctttcttttatttatagtagtggtagtaccatactccgcagaacctcgtgaggggccattcaccatcncagagacaatccaaagaacacgtcttagtttctacaaatgaaacagccgtagagacgccgaatcgacacgggcctgtattacnggtgaacgtaggagcgttcgggggacccctaaggaaccgtttcacggcttaagtcgggtaacgtcggttacgggggaacccgaacgggggtaacccc

SEQ ID NO: 380117 - DNA, 533 bp, Homo sapiens
  misc_feature: GZ8MTXP01C14Y9.13.76.G10.1.454.CMB.2.raw
  modified_base (240)..(240): a, c, t, g, unknown or other
  modified_base (399)..(399): a, c, t, g, unknown or other
  modified_base (456)..(456): a, c, t, g, unknown or other
  modified_base (463)..(463): a, c, t, g, unknown or other
  modified_base (467)..(467): a, c, t, g, unknown or other
  modified_base (472)..(472): a, c, t, g, unknown or other
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctcagtgtcccgtgtccccaggacagacagccagcatcacctgctctaggaaataatggacagataaatntacttctggtatcagcagaagtcaggccagtcccctgtgctggtcatctatacaagatcgaccaagccgccctgacggggcctccccgtggacgcgtacttctcgtggcctaccgaaacttccgaggggaaacctcgaacgcccactcgtacgacctanccgagccggggaccagggactagtggatcggaggctagacctatctgtcagggtcgngggaccngcgngcgcncgccttgtcgtcgttcgttcggacgtcggacgtaacgtccgaccgttacgtaacgcgaacg

SEQ ID NO: 380118 - DNA, 596 bp, Homo sapiens
  misc_feature: GZ8MTXP01DWS2P.13.76.G10.1.454.CMB.2.raw
  modified_base (463)..(463): a, c, t, g, unknown or other
  modified_base (549)..(549): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctctgggttcaccgtcagtcacacctacatgagcgtcgggtcccgcaggcctccgaggggaggggctggagtgtcgttctttcttttattatagtagtggtagtaccatactccgcagaacctccggtggacggggtccctattccacctagtcctaccaagacgaactaattacccaaagaaccacgtcttcgtttactacaaatgaaacngccgtagagacgccgatcgaccgcggtaccgtgtatacgtggtgaacgagagacggttcggggacccaaggttaacgttcaccgtntaagtcgggtaaccgtcggttacggggaaccgaacggggtaaccccg

SEQ ID NO: 380119 - DNA, 721 bp, Homo sapiens
  misc_feature: GZ8MTXP01CRCTS.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtggtcaccgtcagtcacacctacatgagcgtcgggtccgccgaggcctaccggaggggaaggggcgtgggagtcgtcgttctttcttttatttagtagttagtggtagtaccatacgtccgacacgtaaccgtcggtggacggggtcccgtattccaacctacttccgtacccgaaggaacgtaaacctaaactttacccgaaaagtaaacccgtacggttccgtttacgttttacccttaaacgaaaacgttacggaaaccgacggtcccgttaaggaacgggtaaccggacccgggtaataccgggaacccggtaaccgggtccggttagttaacttaacgtggtcggaacgggtaaggacgggtacggttccgggggaacccctaacgggttaaaccgtttcgccggtaactaggtcgggaccggtcgggttaccgggggtaacccgaacggggtaaccccg

SEQ ID NO: 380120 - DNA, 591 bp, Homo sapiens
  misc_feature: GZ8MTXP01ER1QH.13.76.G10.1.454.CMB.2.raw
  modified_base (336)..(336): a, c, t, g, unknown or other
  modified_base (365)..(365): a, c, t, g, unknown or other
  modified_base (401)..(401): a, c, t, g, unknown or other
  modified_base (423)..(423): a, c, t, g, unknown or other
  modified_base (431)..(431): a, c, t, g, unknown or other
  modified_base (453)..(453): a, c, t, g, unknown or other
  modified_base (496)..(496): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccgagccgtgggggtccctgagactctcctgtgcagcctcgtgggttcaccgtcagtcacacctacatgagcgtcgggtcccgccaggcctccgaggggaaggggctggagtgcgtctttntttttattatagtagtggtagtacatacnccgcagaaccgtccgtggacggggcctattccaccngtctccagagaacaatccaaanactacgtnttagtttctacaaatgaaaccngacgtagagacgacgagtcgacgtacggtcgttagtattacgnggtgaaggagaggtacggttccgggaccccgtaaacgttaaccgttacaccgtcgttagtcgggtacgtcggacggggaacccgaaacgggcccg

SEQ ID NO: 380121 - DNA, 604 bp, Homo sapiens
  misc_feature: GZ8MTXP01AQ9FE.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggtcaccgtcagtcacacctacatgagctgggtcccgccaggctccgaggggaggggctggagtgcgtcttctttttattatagtagtgtagtaccatactcgcagaacctccggtggacggggccagttccacctatctacccagagaactaaacttccaaagacacgtcttagttccttaacaaatcgaaactaggccctaggaagacgcccggtaatcggaaccgtacgggtccgttaggtaactttacgtgggtcgcggtaaggacggaacggttccgggggacccctaacggttaacgtttcacggctagtcggacgtcgcggggaacccaagggaaccccg

SEQ ID NO: 380122 - DNA, 625 bp, Homo sapiens
  misc_feature: GZ8MTXP01DZ6P0.13.76.G10.1.454.CMB.2.raw
  modified_base (466)..(466): a, c, t, g, unknown or other
  modified_base (509)..(509): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtccctgagactctcctgtgcagcctctgggttcaccgtcagtcacacctacatgagcgtgggtcccgccaggcctccgaggggaaggggctggagtgtcgtctttctttttattagtagtagtggtagtaccatactccgcagtaacctccgtggacggggcccgtattccgacctatctaccaagagaacaacttaccaaagaaaccacgtcttagtttacttaacaaatcgaaacngaccgtagagacgccgaagtcgacacgggtcctagtattacgngtggcgaaggaggacgttccgggggacccctaacggttaaaccgtttaccgttacggtaacttagtcggggaaccggtttcgggaccgggggtaacccgaaacgggggtaaccccg

SEQ ID NO: 380123 - DNA, 627 bp, Homo sapiens
  misc_feature: GZ8MTXP01ARVV1.13.76.G10.1.454.CMB.2.raw
  modified_base (170)..(170): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctctaggaaataattggcagataaatatacttcctggtatcagcagaagtcaggccagtcccctgtcgctggtcatctatcaagatgccaagccggccctacgaggggactccccccgtagacgcgtattcctacgttcgggcctccaaacgtcgtacggggactcgacgtcccacttctcgacctacgccgaacgggcccgggaacccctagggtcctaagttcgggaattgggaacggtctaggtaacttaattaccgtgttaccgagggttccggaggggaccgaagccaagccgaacgttcggccccggtattacgttacggtacccgttacgggttaaccgttaccggggaacctaaacgggtccctaacccgggttaccgttaaaccggttccgaaccggtaaccccccggg

SEQ ID NO: 380124 - DNA, 596 bp, Homo sapiens
  misc_feature: GZ8MTXP01C6KSX.13.76.G10.1.454.CMB.2.raw
  modified_base (336)..(336): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtcgggtcccgccaggcctccgaggggaaggggctggagtgagttctttnttttatttatagtagtgtagtacatactcgcacgaaccgtcgtggacgggccgtacttccaccatcctacagagacaattccaaagaacacgtcttagtttctacaaatgaaactagccgtagagacgccgatcgaccgacggtccgttgttattacgtggtgaacggtaggagtacggttcggggacccctaacggttaaacgtttcaacggtctaagtcgggacgtcggttacggggaacccgaaaggggtaaccccg

SEQ ID NO: 380125 - DNA, 608 bp, Homo sapiens
  misc_feature: GZ8MTXP01CNKAW.13.76.G10.1.454.CMB.2.raw
  modified_base (500)..(500): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtggtcaccgtcagtcacacctacatgagcgtcggtcccgcacggctaccgaggggaaggggcgtggagtgtcgttctttcttttatttagtagtagtggtagtaccatactccgcagacctcgtggacgggccattccacatctacagacgacaactacaaagaacacgtctttagtttactacgaaatcgaactagccgtagaacgacgacccgataccgacgacggtcccgttgtaacttacgnggtgcggaaagacggtacggttccggggaacccctaacggttaaccgtttacgaccgtcgtaagtcgggtacggtcggttacgggggaaccccgaacgggtaaccccg

SEQ ID NO: 380126 - DNA, 579 bp, Homo sapiens
  misc_feature: GZ8MTXP01B8OI9.13.76.G10.1.454.CMB.2.raw
  modified_base (402)..(402): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtcccgccgaggcctccgaggggaagggggctgggagtgcgtcttcttttattatagtagtggtagtacatactccgcagaactccgtgaggggccattcacctatctccaganacaattacccaagaacacgtcttgtttctacaaatgaacaggcctaggagacgccgatcgacgacggccgtagtactacgtgtgcgagagtacgttcggggaccccaaggttaaacgttcttaccggcttagtcggggtacgtcggttacgggggaacccgaacgggggtaaccccg

SEQ ID NO: 380127 - DNA, 529 bp, Homo sapiens
  misc_feature: GZ8MTXP01ELJ8S.13.76.G10.1.454.CMB.2.raw
  modified_base (170)..(170): a, c, t, g, unknown or other
  modified_base (357)..(357): a, c, t, g, unknown or other
  modified_base (411)..(411): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtgtcccgtgtccccaggacagacagccagcatcacctgctctaggaaataatggacagaataatatacttctggtatcagcagaagtcaggccagtcccctgtgctggtcatctatacaagatcgccaaggccggccctgacggggactccccccgtgagcgtattctctggcctccaaactcgngggaactcacgcccacgtcacgacccatcgacggaccgggacccagggcttagngataggacgcgtagtacttattacgtgtacgagggtcgagggcagcagcaactgacctcttagtcggtcttacggagttcgggaaccagggtccaccgtacagtccgaacgaaccccg

SEQ ID NO: 380128 - DNA, 628 bp, Homo sapiens
  misc_feature: GZ8MTXP01CBPTZ.13.76.G10.1.454.CMB.2.raw
  modified_base (425)..(425): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggtcaccgtcagtcacacctacatgagcgtcgggtcccgccgaggcctccggaggggaagggggctggagtgcgtcttcttttattatagtagtggtatacatactcgcagaactcgtggaggggcccgtattccacactctaccagagacaattccaaagaacacgtnttgttctacaaatgaacagcctggacgtacgcccgagtcgaccgacggtcccgttggttaacttacgtggtggaaccggaaggacgggtacggttccgggggaacccctaacgggttaaacccggtttaccttacggtaaccgttaaggtcggggtaaccggttcgggttaccgggggtaacccgaaacgggggtaacccccg

SEQ ID NO: 380129 - DNA, 695 bp, Homo sapiens
  misc_feature: GZ8MTXP01DWK7B.13.76.G10.1.454.CMB.2.raw
  modified_base (173)..(173): a, c, t, g, unknown or other
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctctaggaaataatggacagaataaatatacttctggtatcagcagaagtcaggccagtcccctgtcgcttggtcagtcctatacaaagatcgaccgtaagccggaccctcgaacgggacctccccgtagacgtccgtaatttcctcgtcggtacctacccgaaacgtttccgtaacgggggtaaccttcgaaccggtccctaaacgttcctacggaaccctacgttaccgaaccgggtacccgggggaaaccccaggggtacccttaaggtacgggaacgttagggaacgggggtaccgttagggttaaaccctttaagttaaccgtacggttccgaagggggtacccggttagggggtaaccacggaccgacggccgtaacgttcggaccccggttattaacgtcggttacgtttccgggaaaccgttcggggaacccgtaacgggttcccacccggttaccgttaacgccgaaaccccgg

SEQ ID NO: 380130 - DNA, 494 bp, Homo sapiens
  misc_feature: GZ8MTXP01DQ9YY.13.76.G10.1.454.CMB.2.raw
  modified_base (421)..(421): a, c, t, g, unknown or other
  modified_base (436)..(436): a, c, t, g, unknown or other
tcagtcacgtactacacgaccggtgctcgatttagtcactcatacagggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggacagataaatatacttcctggtatcagcagaagtcaaggccagtcccctgtgctggtcatctatcaagatgccaagcggccctgagggactccccctgagcgattctctggctcaactctgggaactcagccactctgacatcagcgggacccaggctagtgatgaggctgactagttactgtcgaggcgtggacngcagcaactgcccgnttagtgtcttacggacttgggaaccaaggtccaccgtcgttaagtcgaacgaaccccg

SEQ ID NO: 380131 - DNA, 733 bp, Homo sapiens
  misc_feature: GZ8MTXP01DX6OX.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatccagccgtgggggtccctgagactctcctgtgcagcctcgtgggtcaccgtcagtcacacctacatgagcgtcgggtcccgccgaggccgtccggaaggggaaggggcgtgggagtcggtccgtttctttactttttagtttagttaggttaggtggtagttaaccctacttaccgtccgacgtacgtaacccgttccgggtggggacgggggtacccgtaactttacccaaccctactaccgttacccgaaaggtaactaaacctaaacttacccgaaaacggtaaaccctaaccggtcttttacgttttaccttaaacaaaaagttcggaaaacctcggtacccggtaggaaacgaccggacccgtaagtacggaaccgaccgggtaccgttagttaactttacgtgtcggaacggaagaggtacggttccggggaacccctaacgggttaaccgttacgttacggtaactaaggtcggacggttcggacgggggaaccgaaacggggtaacccg

SEQ ID NO: 380132 - DNA, 493 bp, Homo sapiens
  misc_feature: GZ8MTXP01DJ3SX.13.76.G10.1.454.CMB.2.raw
  modified_base (235)..(235): a, c, t, g, unknown or other
  modified_base (360)..(360): a, c, t, g, unknown or other
  modified_base (421)..(421): a, c, t, g, unknown or other
  modified_base (424)..(424): a, c, t, g, unknown or other
  modified_base (465)..(465): a, c, t, g, unknown or other
  modified_base (492)..(492): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggancagctcaacattggggcacattatgatgtacactggtaccagcagtttccaggagcaggtcccagactcctcatcaatacgtaaacaacaatcggcccgacgaacggggtccctgacccgattcncgtggcttcccaggtctggccactcacgccctccctgtcatcacgtggctccgagctgagntgngctgattattctgcctaagtccttatgcagcagccttaggngtgtcgtcggtacgttcgggcgggcgng

SEQ ID NO: 380133 - DNA, 603 bp, Homo sapiens
  misc_feature: GZ8MTXP01A8TZB.13.76.G10.1.454.CMB.2.raw
  modified_base (480)..(480): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagcgtcgggtcccgccgaggcctccggaggggaagggggctggagtgcgtctttcttttattatagtagtggtagtaccatactccgcagaactccggtggacggggcctacttcaccactctaccagacgaactaactaccaaagaaccacgtcttgtttactacaaatcgaaactacgccgtaggagacgaccgtancgacgcggtccgttgtaacttacgtgtggaacgaggagtcgttcgggggaccctaacggttacgttacgacgcttagtcgggtacgtcgggttacggggaacccgttaaacggggtaaccccg

SEQ ID NO: 380134 - DNA, 582 bp, Homo sapiens
  misc_feature: GZ8MTXP01ANMGE.13.76.G10.1.454.CMB.2.raw
  modified_base (279)..(279): a, c, t, g, unknown or other
  modified_base (294)..(294): a, c, t, g, unknown or other
  modified_base (365)..(365): a, c, t, g, unknown or other
  modified_base (449)..(449): a, c, t, g, unknown or other
  modified_base (467)..(467): a, c, t, g, unknown or other
  modified_base (472)..(472): a, c, t, g, unknown or other
  modified_base (490)..(490): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctctgggttcaccgtcagtcacacctanatgagcgtgggtccnccgaggctccgaggggaaggggctggagtgcgttcttcttttattatagtagtggtagtaccatactccgnacgaacctccgtggacggggccgattccaccatctaccagagacaaactccaaagaacacgcttagtttctacaaaatgaaacncgacgtgacgacgccgancgacncggtctagtattacgtgngcgaggacggacggttccgggaccctaacggttaacgttaccgacgtaactagtcgggacgttcgggacggggtaacccgaacgggaacccg

SEQ ID NO: 380135 - DNA, 582 bp, Homo sapiens
  misc_feature: GZ8MTXP01DMQ2G.13.76.G10.1.454.CMB.2.raw
  modified_base (329)..(329): a, c, t, g, unknown or other
  modified_base (363)..(363): a, c, t, g, unknown or other
  modified_base (371)..(371): a, c, t, g, unknown or other
  modified_base (373)..(373): a, c, t, g, unknown or other
  modified_base (383)..(383): a, c, t, g, unknown or other
  modified_base (386)..(386): a, c, t, g, unknown or other
  modified_base (391)..(391): a, c, t, g, unknown or other
  modified_base (405)..(405): a, c, t, g, unknown or other
  modified_base (419)..(419): a, c, t, g, unknown or other
  modified_base (472)..(472): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctctgggttcaccgtcagtcacacctacatgagcgtcggtccgccaggctccggagggaaggggcgtggagtgcgtntttcttttattatagtagtgtagtacatactcgnagactcgngngggcatcacntcncaganacaatcaaagaacncgtcttgttactanaaatgaacacgccgtagaagcgccgaatcgacaccggtccgtagtacttacgnggtgcgtaagaggtaggttccggggaaccctaacgttaaacgtttccgaccgtgttaaacgtcgggtaaccggtcggttaccgggggtaacccgaaacggggtaaccccg

SEQ ID NO: 380136 - DNA, 515 bp, Homo sapiens
  misc_feature: GZ8MTXP01ELI56.13.76.G10.1.454.CMB.2.raw
  modified_base (235)..(235): a, c, t, g, unknown or other
  modified_base (258)..(258): a, c, t, g, unknown or other
  modified_base (380)..(380): a, c, t, g, unknown or other
  modified_base (382)..(382): a, c, t, g, unknown or other
  modified_base (386)..(386): a, c, t, g, unknown or other
  modified_base (403)..(403): a, c, t, g, unknown or other
  modified_base (438)..(438): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggancagctcaacattgggcacattangatgtacactggtaccagcagtttccaggagcaggtcccagactcctcatcaatacgtaaacaaacaagtccggcccgacgacggggtccctgaaccgattctctcgggctccagtctggcncncacnccctcctgtcatcacgnggcctcgaggctgaggatcgagctgtattatttcngtcaagtcccttatcgttacgagcacgccttaggaacgtgtcgttcgggtacgttcggggccgggggccctaacggg

SEQ ID NO: 380137 - DNA, 662 bp, Homo sapiens
  misc_feature: GZ8MTXP01ETOUI.13.76.G10.1.454.CMB.2.raw
  modified_base (463)..(463): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctatttaaaagtgcccagtgtgaggtgcagctggtggagtctggaggaggcttgatccagccgtgggggtccctgagactctcctgtgcagcctcgtgggtcaccgtcagtcacacctacatgagcgtcgggtccgccgaggcctaccggaggggaaggggctggagtgcgttcttcttttattagtagtagtggtataccatactccgcagaaccgtcggtggacggggccgtattccgacctatctaccagacgaactaactaccaaagaactacgtctttagtttacctacaaaatgaaaacncgtaccgtggaaacgacgcccgtaatcgaaccgaccggggtaccttggttaaacttccgtgggtcggaacggtaagggttacggaaccggttcgggggtaacccctaaacggggttaaaccgtttttccaacggtccgttaaggttcggggaacccgtttcggggaccgggggaacccgttaaacggggggtaaccccg

SEQ ID NO: 380138 - DNA, 588 bp, Homo sapiens
  misc_feature: GZ8MTXP01D57EO.13.76.G10.1.454.CMB.2.raw
  modified_base (446)..(446): a, c, t, g, unknown or other
  modified_base (456)..(456): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggtcaccgtcagtcacacctacatgagctcgggtccgccgaggcctccggaggggaaggggctggagtgcgttctttcttttatttatagtagtggtagtaccatactccgcagaacctccgtggacggggccattccaccatctccagagacaatccaaagacacgtcttgtttctacaaatgaaacngccgtagagngaccgatcgacgacggtccgtagtacttacgtggtgaacgtaaggagacggttcggggacccctaacggttaacgttacaccgctaacgtcgggacgtcggttacgggggaaccgttaacggggtaaccccg

SEQ ID NO: 380139 - DNA, 644 bp, Homo sapiens
  misc_feature: GZ8MTXP01A6F3R.13.76.G10.1.454.CMB.2.raw
  modified_base (333)..(333): a, c, t, g, unknown or other
  modified_base (367)..(367): a, c, t, g, unknown or other
  modified_base (593)..(593): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtgggttcaccgtcagtcacacctacatgagcgtgggtccgcgaggctccgaggggaggggctggagtcgcgttcttnttttatttagtagtagtggtagtacatactccgnacgactcgtggaggggccattcacactctacccagacgaactaacttaccgaaacgacacgtctttacgtttacctacaaaagtcgaaacctaggtacccggtaggaacggacgacccgaagtccgaacgtaccgggtaccgttgttaacgtttaccgtggtcggaacggaaggaggtacggttccgggggaccctaaacggttaaaccggtttccgttaccggtnttacggtcgggtaccggttcgggacggggtcccggaaacggggtaaccccg

SEQ ID NO: 380140 - DNA, 635 bp, Homo sapiens
  misc_feature: GZ8MTXP01EQEL2.13.76.G10.1.454.CMB.2.raw
  modified_base (197)..(197): a, c, t, g, unknown or other
  modified_base (410)..(410): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggngtaaactggaggaggcttgatccagccgtggggggtccctgagactctcctgtgcagcctctgggttcaccgtcagtcacacctacatgagcgtgggtccgcaggctccgaggggaaggggctggagtgcgttcttctttttattatagtagtggtagtacatactccgcacgaactccgtggacggggccgattccaccatctaccaggaanacaattaccaaagacacgtcttgtttacttacaaatggaaaccaggtccctagaacgcgaccgatccggaacacgggtcccgttgtaaactttcgtggttagcggaaggacggtaacggttccggggggacccctaaaacgggttaaccgttttaccgaccggtccttaaggttcggggaaccggtttcggaccggggggtaacccaaaacggggggtaaccccg

SEQ ID NO: 380141 - DNA, 625 bp, Homo sapiens
  misc_feature: GZ8MTXP01BB2RY.13.76.G10.1.454.CMB.2.raw
  modified_base (290)..(290): a, c, t, g, unknown or other
  modified_base (357)..(357): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctggtttcctgttgctatttaaaggtgccagtgtgaggtgcagctggtggagtctggaggaggcttgatccagccgtggggggtccctgagactctcctgtgcagcctcgtggggttcaccgtcagtcacacctacatgagctgggcccncaggctccgaggggaggggctggagtgcgtcttctttttattatagtaggtgtagtacatactccgnacgaactccggtggacggggccgtaacttccaacctactctacccaagacgaactaacttacccgaaagaacctacgtcttagtttcctacaaatgaacctagccgtaggacgacgaccgtagcgaccgacgggtccggttataacgtttacgtggtcgaacggtaaggaggtacggttccgggggaaacccctaacgggttaacgtttaccgacggtccttaggtccgggacgttcggacggggtaacccgaaaggggtaaccccgg

SEQ ID NO: 380142 - DNA, 516 bp, Homo sapiens
  misc_feature: GZ8MTXP01A7O9K.13.76.G10.1.454.CMB.2.raw
  modified_base (291)..(291): a, c, t, g, unknown or other
  modified_base (335)..(335): a, c, t, g, unknown or other
  modified_base (370)..(370): a, c, t, g, unknown or other
  modified_base (375)..(375): a, c, t, g, unknown or other
  modified_base (401)..(401): a, c, t, g, unknown or other
  modified_base (425)..(425): a, c, t, g, unknown or other
  modified_base (459)..(459): a, c, t, g, unknown or other
tcagtcacgtactacacgaccggtgctcgatttagtcactcatacagggtgcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcactgctctgaaataatggacagataaatatacttctggtatcagcagaagtcaggccagtcccctgtgctggtcatctatcaagntcgaccaagccggaccctcgaggacctccctagacgcgtattcncgtggactccaacgtcgtacgggaactcgacgccnctacngaccatcgacgcgggaccaggctacngggactggagggctagactatacngtcgaggcgtggacagccagtcacgttcgcccgntacgtgttccgttcggaacgtcggaccaagggtccaccgttacgaacgttcgaaccg

SEQ ID NO: 380143 - DNA, 569 bp, Homo sapiens
  misc_feature: GZ8MTXP01EGD3F.13.76.G10.1.454.CMB.2.raw
  modified_base (368)..(368): a, c, t, g, unknown or other
  modified_base (378)..(378): a, c, t, g, unknown or other
  modified_base (381)..(381): a, c, t, g, unknown or other
  modified_base (439)..(439): a, c, t, g, unknown or other
  modified_base (462)..(462): a, c, t, g, unknown or other
  modified_base (483)..(483): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtggtccgccgaggcctccgaggggaaggggctggagtgtcgtctttcttttattattagtagtggtacgtacatactcgnacgaactcgnggngggccatcacatctcagagactaatccaaagacacgtcttgtttacacaaatgaaacngccgtgacgacgccgatcgaccncgggtaccttgttacttacgngtcggcgtagaggaggttcggggaccctaagggttaacgttacgacgctagtggaccgtggttacggggaaccgaacgggaacccg

SEQ ID NO: 380144 - DNA, 526 bp, Homo sapiens
  misc_feature: GZ8MTXP01DNWMG.13.76.G10.1.454.CMB.2.raw
  modified_base (322)..(322): a, c, t, g, unknown or other
  modified_base (461)..(461): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtcgtccgtgtccccaggacagacagccagcatcacctgctctaggaaataaattggcagataaatatacttctggtatcagcagaagtcaggccagtcccctgtgctggtcatctatcaagatgaccaagcgccctgagggactcccccngagcgattctctggcctcaaactcgtacgggaacctcacgcccactctagaccatccgagccgggaccaggctaagtggaatgacggcgttggacttatacgtgtccgaggcgtagggacagcagcaacgtcgcccgtnttagtcgttcgttacggacttcggggaacctaacgggtccaccgtacgttagtcaacgaaccccg

SEQ ID NO: 380145 - DNA, 652 bp, Homo sapiens
  misc_feature: GZ8MTXP01CJX5J.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttggatcagccgtgggggtcctgagactctcctgtgcagcctcgtgggtcaccgtcagtcacacctacatgagcgtggtccgcgaggctccggagggaaggggcgtggagtgtcgttctttcttttatttatagtagtggtagtaccatactcgcagactcgtggacgggcattccacctatctacagacgaacaacttccgaaacgaacacgtcttgttacttacaaatcgaaacagtacccgtagaacgacgacccggaagtagaccgacgggtacccgttagttaacgtttacgtggtggaaccggtaaggacgggtaacggttaccgggggaaccccctaaacgggttaaacccgtttaacgttaccgggtaacttaacggtcgggggttacccgtaccggggttacgggggtaaccccgaaacgggggtaacccccg

SEQ ID NO: 380146 - DNA, 875 bp, Homo sapiens
  misc_feature: GZ8MTXP01BOZKT.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgcttaattttaaaaggtgccagtgtgaggtgcagctggtggagtcgtggaggaggcttgatccagccgtgggggtccctgagactctcctgtgcagcctcgtgggttcaccgtcagtcacacctacatgagcgtcgggtccccgaccgacggccgtaccggaaggggggaacgggggtccgtagggggtacggttcggtccggttttacctttttacgttttttttaaagtttttaagtttaagggtttaagggtttacggggtttaaacggttaacccctaacgttaaccgttccccggactaaaccggtaaacccgttcccggggttcgggggacggggggtacccgtactttaccccgaacccgtacttcccgttacccgaaggtaaacgtaaacctaaacgtttaccccgaaaaaggtaaaccctaacccggttcttttacgtttttacctaaacaaaagttcgaaacgtacgtacccggtaaggaacggacgggaccccgttaagtccgggaaacccgtaccgggggttacccgttaggtttaactttaaccggtgggtacccgggaacggtaacgggagggtaaccgggttccggggggaaccccctaaaacggggttaaacccggtttaccttaaacccgggtgttaacggttcgggggaaccgggtttaccgggttacggggggtaacccaaaaccggggggtaacccccg

SEQ ID NO: 380147 - DNA, 658 bp, Homo sapiens
  misc_feature: GZ8MTXP01EYE8U.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtatggaggaggcttgatccagccgtggggggtccctgagactctctgtgcagcctcgtgggttcaccgtcagtcacacctacatgaggttcgggtccgccgaggctccgagggggaacggggctgggagtgtcgttcttcttttatttagtagttagtggtagtacatactcgacagacctccggtggcgggccgtattccacctatcctcagacgaacaacttaccaaagtaaccacgtacttcgttttacctacaaaattcgaaactacgccgtagggaacggacgaccgaagtacgaaccgaccggtccgttagttacttacgtgtacggcggaaggtaacggacggttacgggggaacccctaaacgggttaacgttaccgttacgttcgttaagggtcgggtaacggtttcgggacgggggacccgtaaaccgggggttaacccgtaacccgggg

SEQ ID NO: 380148 - DNA, 680 bp, Homo sapiens
  misc_feature: GZ8MTXP01EDF5Q.13.76.G10.1.454.CMB.2.raw
  modified_base (239)..(239): a, c, t, g, unknown or other
  modified_base (297)..(297): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagcccgcctcagtgtctcggggccccagggcaggaggtcaccatctcctgcacgtggggacncagctaccaacagttggggcactattatgatgtacactggtaccagcagtttcaggancgacgtcccagacctcctacactacaactaacgtaaacaaactaaacgtcccggaccccgacgaaccgggggtcccctacggtaacccggtacttccgtcgttcggggtccttacccgtacggttcgttcgggacctacccgttccacggtcccccttcccgttggttccaacgttcctaacgtcgggggcccttaccccggggaagggtccgttacgggaacgggtagtaccggggtagggttaccttagggttaacttttacgttttaccgtcggtacccttaacggttcccttaaagttcgaaccgacggtcacggttcccttaggtaaggtcgttcggtttacgggtcggttccgggggcccgggggttaaccctcggg

SEQ ID NO: 380149 - DNA, 587 bp, Homo sapiens
  misc_feature: GZ8MTXP01D7MEP.13.76.G10.1.454.CMB.2.raw
  modified_base (297)..(297): a, c, t, g, unknown or other
  modified_base (332)..(332): a, c, t, g, unknown or other
  modified_base (555)..(555): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtcagcctcgtgggttcagcttcagtgtatattggatgagcgtgggtccncagctcgagggagggctgggagtgggtggaccaanataaacacgaaggaccggaagtcgaacccatacctaagcgcggactcgtgtaggaaggggccgtattccacctatcctaccgagacgaaccaaaccggacctaaagaacctacaacttaatactttagactaaagttcgggaaccgcgtaggagagacggaaggcacggtctagtgtaattacgttgtgagagagagttggacgtaaggtggaacgttacggnggggttacgggggcccggggttaaccgtcggg

SEQ ID NO: 380150 - DNA, 639 bp, Homo sapiens
  misc_feature: GZ8MTXP01DT1C1.13.76.G10.1.454.CMB.2.raw
  modified_base (263)..(263): a, c, t, g, unknown or other
  modified_base (267)..(267): a, c, t, g, unknown or other
  modified_base (276)..(277): a, c, t, g, unknown or other
  modified_base (282)..(282): a, c, t, g, unknown or other
tcagtcacgtactacacgaccggtgctcgatttagtcactcatacaggggggagaggagcccagcactgggattccgaggtatttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttacncgtnctcacacanngacgngtcggccgcgcgcacggagggaggcgaggtagtcgtcgttctttactttattagtagtagtagtacgtactactacgtcgacgacgtaccgtcgtgggacgggacgtactaccactactcctacgagacgtaactaactaaccgaaacaaccgacgttctttacgtttacctaaataacgtaacgaacgacgtaccggtaggacggaccgacgtacgacgaccggtaccggtaccgtagttacgtacgtggtcgaaggaggacggtacgggaccggtaccgtaaccgttaaccgttacgttaccgtaactaggtaacggtacggtcgggttacgggtaaccggaacgggtaacccgg

SEQ ID NO: 380151 - DNA, 692 bp, Homo sapiens
  misc_feature: GZ8MTXP01CKFV5.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctggattcacctttgatgattatgccatgcacgtgggtccgcaagctcgaggggagggcctgggagtgggtctcgaggttattaggttaggaataggtggtagcgagtaggactagtggcggtactcgtggtaggaacggggccagttccaccaattccgtacccgaaggaacgaaaccgaaaccgacccaaacgtaaacccttccccgttaggtaacttcccgttaagggaactaaaacgttcgaaaaccgtacggcccgttaggaaggtaacggccgttaaggggaacgggaaccccgtaccgggggtcccgtttaaggttaaagttttaacccgggttcgggtacgggacggttaagggacggttaccgggtaacccgggggaacccctaaacgggttaaccgttaaccgttaccgtaacggttaacggtccgggg

SEQ ID NO: 380152 - DNA, 678 bp, Homo sapiens
  misc_feature: GZ8MTXP01C54S1.13.76.G10.1.454.CMB.2.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggacagataaatatacttcctggtatcagcagaagtcagccagtcccctgtgctggtcatctatacaagagtcgaccgaacggccggcccctaggacgggtacctcccccgaggacgcgtacttcctcgtcgtcctaacctaccgtcgtacgggtaacctaccaaccctactctacgaccctacgtacgaccgggacccggaaccggtacgtaccttagggtacggtagtcgggaacggtaccgttaacggggttaactttaacgtttaccggttacggttaccggtacgggtaccgggttaggggaaccgacggtcgacggacctaccggtaaccgcccggttacttcgttcgttaccggttacggttaaccgggttacgggttaacccgtaaccgggtacccgtaacccgttaaccgtacggttacctaaccgggaaccccgtaaaccccgg

SEQ ID NO: 380153 - DNA, 536 bp, Homo sapiens
  misc_feature: GZ8MTXP01EJXDX.13.76.G10.1.454.CMB.2.raw
  modified_base (212)..(212): a, c, t, g, unknown or other
  modified_base (235)..(235): a, c, t, g, unknown or other
  modified_base (418)..(418): a, c, t, g, unknown or other
  modified_base (478)..(478): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctntagaaataatggacagataaatntattctgtatcagcagaagtcaggccacgtcccctgtgctggtcatctatacaagatcgaccaaggccggccctgacgggactcccccgtggacgcgtattcctcgtcggcctaccaaacgttccgtacgggaacctcgacgccctactctacgaccatccgacggccggacccgaggctagngataggacggctagtacttatacgtgtccgaggcgtaggacagcagcaacgtcgcccgtnttagtcgtcgttacggacgttcgggaaccaggtccaccgtcacgtccgaacgaacccg

SEQ ID NO: 380154 - DNA, 659 bp, Homo sapiens
  misc_feature: GZ8MTXP01DZI85.13.76.G10.1.454.CMB.2.raw
  modified_base (619)..(619): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctattttaaaaggtgcccagtgtgaggtgcagctggtggagtcgtggaggaggcttgatccagccgtgggggtccctgacgactctcctgtgcagcctcgtgggtcaccgtcagtcacacctacatgagcgtcgggtcccgccaggctccggaggggaagggggctggagtgtcgttctttcttttatttatagtagtggtagtacactactccgacagaacctcggtggacggggtcccgtacttccaaccctatcctaccaagtacgaactaaacttaccaaagaaacctacggtctttacgttttacctaacgaaaaattgaaaaccgtcgtcccgttaagggaaacggaccggacccgtaatacggaacccgtaaccgggtaccgttaggttaacttacgtggttcgaacgtaaggagtacggttcggggaacccctaagttaaccgtttcacggtnttagcgggtacgtcggttacgggggaaccaaacgggcccg

SEQ ID NO: 380155 - DNA, 587 bp, Homo sapiens
  misc_feature: GZ8MTXP01B3QLZ.13.76.G10.1.454.CMB.2.raw
  modified_base (383)..(383): a, c, t, g, unknown or other
  modified_base (419)..(419): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtgggtccgcaggctccgagggaggggctggagtgcgtcttcttttattatagtagtggtagtacatactcgcagaactcgtgacggggccattcacntctcagagacaatccaagacacgtcttgtttactanaaatgaacacgccgtagaggacgcccgaagtcgaaccgcgggtacctggttaacttacgtgtcgaacggaggagtacgttcgggggacccctaaggaacccgtttcaccggctaggtcgggtaaccgggtcggttacgggggaaccccgttaaacgggggtaaccccg

SEQ ID NO: 380156 - DNA, 600 bp, Homo sapiens
  misc_feature: GZ8MTXP01DNWX9.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactaaccatggagttttggctgagctgggttttccttgttgctattttaaaaggtgcccagtgtgaggtgcagctggtggagtctggaggaggcttgatccagccgtgggggtcctgagactctcctgtgcagcctcgtgggttcaccgtcagtcacacctacatgagcgtgggtccgccgaggctccgaggggaagggctggagtgcgtcttcttttattatagtagtggtagtacactactcgcacgactcgtgcgggcctattcaccatctaccagacgaactaacttccaaagaccacgtcttcgtttactacaaattgaaacagtccctagggaacgacgacccgagtcgaccgacggtccgtagttactacgtgtcgcggaagaggacggtcggggacccaaacggtaacgttaccgttacgcctaaggtcgggaaccgttcgggaccgggggaccgaaacggggcccgtaacccggg

SEQ ID NO: 380157 - DNA, 706 bp, Homo sapiens
  misc_feature: GZ8MTXP01DGOTY.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagcgtggtggagtcgtggaggaggcttgatcgagccgtgggggtcctgagactctcctgtgcacgcctcgtgggttcaccgtcacgtcacacctacatgagcgtcgggtccgcgacggcgtaccggaggggaaggggcgtgggaggtcgtcgttctttcttttagtttagttagttaggtggtacgtacctatacgtccgacacggtaaccgttccggtgggacgggggtacctacttaccaccgtatcctacccaaggaacgtaacctaaacgttacccgaaagtaaacccgtacggttctttagtttacccttaacgaaaagttacgaaaccacggtaccgtaggaaacggacgacccgtaagtaccggaaccgtacggggtaccgttagttaactttaccgtgggtacgaacggaaggacggtacggttccgggggaacccctaacggttaaccgtttacgacgtcgtaggtcgggtaccggtggttaccgggggaacccgttaacggggaaccccg

SEQ ID NO: 380158 - DNA, 547 bp, Homo sapiens
  misc_feature: GZ8MTXP01DUGBP.13.76.G10.1.454.CMB.2.raw
  modified_base (433)..(433): a, c, t, g, unknown or other
  modified_base (454)..(454): a, c, t, g, unknown or other
  modified_base (470)..(470): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctatttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgaggggaaggggctgggagtgcgtcttcttttattatagtagtggtagtacatactccgacagctccgtgaggggccattcacatctcagagacaattccaaagacacgcttgttcttacaaatgaaacngcctagagagccgatgaaccncggtccgtgtattacngtgcgagttagagtcgggggccccaacggttaacgttaactacggcttaagtcgggacgttcgttcgggggaacccg

SEQ ID NO: 380159 - DNA, 643 bp, Homo sapiens
  misc_feature: GZ8MTXP01BD9JD.13.76.G10.1.454.CMB.2.raw
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcacgccaccctcagtcgtccgtcgtccccaggacagacagccagcatcacctgctctagaaataatggacagaataaatatacttctggtatcagcagagtcaggccacgtcccctgtcgctggtcatctatacaagatcgaccaacggccgaccctcgagggactcccccgtgacgcgtacttcctcgtcggccctaccaacgttccgtacggggaacctcgacgtccctactctacgaccacgtaccgacggacccgggacccgagggtacctagtacggaagttacggaacggtcgtacggtaacctttacgttaaccgttggttaccggaacgggtcgggttaacggggaccgtacggtaccgaacgggccgtaacgtccggttacccggtacttacgttcggttaccggtttaccgggacgttacggggaaccgtacggtccgtacccggtacgttaacgtccgaaccggaaccccg

SEQ ID NO: 380160 - DNA, 532 bp, Homo sapiens
  misc_feature: GZ8MTXP01AZP0T.13.76.G10.1.454.CMB.2.raw
  modified_base (378)..(378): a, c, t, g, unknown or other
  modified_base (441)..(441): a, c, t, g, unknown or other
  modified_base (519)..(519): a, c, t, g, unknown or other
tcagtcacgtactacacgaccggtgctcgatttagtcactcatacaggggggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgcaggctccgagggaagggctggagtgcgtctcttttattatagtagtggtagtacatactccgcagactccgtgaggggcatcaccaatctcagagacatccaanaacacgcttgttctacaaatgaacagcctgagacgccgaatgaccacgggggcctgtattacngtgcgagagagtcggggcccacgaacgttaacacggctagttggacgtcgttggggccaagggccacggtcaccgtcncctcgaacgcccc

SEQ ID NO: 380161 - DNA, 549 bp, Homo sapiens
  misc_feature: GZ8MTXP01CG3IH.13.76.G10.1.454.CMB.2.raw
  modified_base (485)..(485): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtcccccaggacagacagccagcatcacctgctctaggaaataattggacagataaatatacttcctggtatcagcagaagtcaggccagtcccctgtgctggtcatctatcaagatgaccaagccggccctcgagggactccccccgtggagcgtattcctcgtcggcctacccgaaacttccgtaggggaacctcgaacgccctactctacgaccagtcgacggaccgggaccccaggtctagtcgggaatggacggtcgtaggtaacttattacgtgtccgagggcgtgggacagcaacgccnctcggcctcgttgtcggtcttcgggacttcgggaaccagggtccaccgtcagtccgcgaacccg

SEQ ID NO: 380162 - DNA, 566 bp, Homo sapiens
  misc_feature: GZ8MTXP01AZUWM.13.76.G10.1.454.CMB.2.raw
  modified_base (469)..(469): a, c, t, g, unknown or other
  modified_base (491)..(491): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctggggtcaccgtcagtcacacctacatgagcgtgggtccgccaggctccgaggggaggggctggagtgcgtcttcttttattatagtagtggtataccatactccgcagaacctccggtggacgggggtccagttccaccgatctaccagacgactaaacttccaaagaaccacgtcttagtttcctacaaatgaacagccgtgagagcccgtancgactaccggcgtgtatcgtgngaacgaggagcggttcggggaccctaaggaacgtttcacgtctatgggacgtcgacggggtaaccgaaggggccc

SEQ ID NO: 380163 - DNA, 609 bp, Homo sapiens
  misc_feature: GZ8MTXP01ETSZA.13.76.G10.1.454.CMB.2.raw
  modified_base (406)..(406): a, c, t, g, unknown or other
  modified_base (453)..(453): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtggggggtccctgagactctcctgtgcagcctctgggttcaccgtcagtcacacctacatgagcgtcgggtcccgccgaggctccggaggggaagggggctgggagtgcgttcttcttttattatagtagtgtagtacatactcgcagactccgtggacggggcctattcaaccatctccaganaactaattaccaaagaacacgtctttacgttcttaacaaatgaaacncgcctaggaagacgcccgaagtcgaaccgaccgggtaccttaggttaacttacggtgtggaacgagaaggtcgttacggggacccaaacggttaacgtttccaacgtcttaagtcgggtacgtcgggttacggggtaacccgaaagggggaacccg

SEQ ID NO: 380164 - DNA, 633 bp, Homo sapiens
  misc_feature: GZ8MTXP01ERTW8.13.76.G10.1.454.CMB.2.raw
  modified_base (467)..(467): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtctggaggaggcttgatccagccgtgggggtccctgagactctcctgtgcagcctctgggttcaccgtcagtcacacctacatgagcgtcgggtcccgccgaggcctccggaggggaagggggctgggagtgcgttcttctttttatttatagtagtggtagtaccatactccgcacgaactccgtggacggggccgattccacactctacccaagacgaactaattaccaaagaactaccgtctttgtttactaaccaaaatcgaaacncgaccgtagaacggacgcccgaatacggaccgacggtcccgttagtaaccttagtgggtgaacggaaggaggacggttccgggggaaccctaacggttaaaccgttcttacggtaacttagtcgggtacggtcggttacgggggaacccgttaacggggaaccccg

SEQ ID NO: 380165 - DNA, 561 bp, Homo sapiens
  misc_feature: GZ8MTXP01CMGAD.13.76.G10.1.454.CMB.2.raw
  modified_base (235)..(235): a, c, t, g, unknown or other
  modified_base (258)..(258): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagcccgccctcagtgtctgggccccagggcagagggtcaccatctcctgcactgggancagctcaacattgggcacattangatgtacactggtaccagctagtttccaggagcaggtcccagactcctcatcaatacgtaacaacaagtccggcccgacgtacggggtcccctagacccgtatttcctcgtcgacctccgacggtcctcggcctacctcgacgtcccttcccgtggtccatccacgtcgggccttccggaggtctcggaggagtggacggtctaggtatttacgtttctgtcctaagtccttattcgactaacggcacgttccgttggtaagtgtccgttcgggtacgttccggggccgggggccctaacggg

SEQ ID NO: 380166 - DNA, 579 bp, Homo sapiens
  misc_feature: GZ8MTXP01C1TCO.13.76.G10.1.454.CMB.2.raw
  modified_base (426)..(426): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagctgggtcccgcaggctccgaggggaaggggctggagtgcgtcttcttttatttatagtagtgtagtacatactcgcagaactccgtggagggccgattcacatctcagacgacaattccaaagaacacgtcttgtttactanaaatgaaacacgccgtagagacgccgatcgaccgacggtccgtagtattacgtgtggcgagacggacgttcgggggaccccaaggttaaaccgttcgttaacgtcctaagtcgggtacgtcggttacgggggtaacccgaaggggtaaccccg

SEQ ID NO: 380167 - DNA, 531 bp, Homo sapiens
  misc_feature: GZ8MTXP01AESMZ.13.76.G10.1.454.CMB.2.raw
  modified_base (333)..(333): a, c, t, g, unknown or other
  modified_base (420)..(420): a, c, t, g, unknown or other
  modified_base (426)..(426): a, c, t, g, unknown or other
  modified_base (433)..(433): a, c, t, g, unknown or other
  modified_base (436)..(436): a, c, t, g, unknown or other
  modified_base (441)..(441): a, c, t, g, unknown or other
  modified_base (444)..(444): a, c, t, g, unknown or other
  modified_base (473)..(473): a, c, t, g, unknown or other
  modified_base (475)..(475): a, c, t, g, unknown or other
  modified_base (502)..(502): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagcgtggttttccttgtgctatttaaaggtgccagtgtgaggtgcagctggtggagtctggaggaggcttgatccagccgtggggggtccctgagactctcctgtgcagcctcgtgggttcaccgtcagtcacacctacatgagcgtgggtcccgccaggctccgaggggaagggctgggagtgcgttcttnttttattagtagttagtggtagtacatacctccgacagcctccggtggacggggccattcacatcctcagagacattccaaagaacngtcttnttctaanaangaacngcngagcgcgagcgacgcggtctatactgtgngngagagcggtccggaccacgttacgtcncgtcgtggtcggacgtcggaacgggaacg

SEQ ID NO: 380168 - DNA, 574 bp, Homo sapiens
  misc_feature: GZ8MTXP01DHV11.13.76.G10.1.454.CMB.2.raw
  modified_base (334)..(334): a, c, t, g, unknown or other
  modified_base (381)..(381): a, c, t, g, unknown or other
  modified_base (441)..(441): a, c, t, g, unknown or other
  modified_base (485)..(485): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtcgggtcccgccaggctccgaggggaagggggctggagtgcgtcttnttttatttatagtagtgtagtaccatactccgcagaacctccgtggnggggccattcaccatctccagagacaatccaagaacacgtcttgttctacaaatgaaacncgccgtgagacgccgatcggaccacggtcccgttgtacttacgngtgcggtagaggacgttcgggggaaccctacggttaaacgttcacggtctaagtcggacgtcggttcggggaaccaacggggtaacccg

SEQ ID NO: 380169 - DNA, 670 bp, Homo sapiens
  misc_feature: GZ8MTXP01DSK8M.13.76.G10.1.454.CMB.2.raw
  modified_base (332)..(332): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggtccaccgtcagtcacacctacatgagtcgtcgggtcccgcaggctccgaggggaggggctggagtgcgtcttntttattatagtagtggtagtaccatactcgcagtaacctcgtggacggggtctattcaaccatctaccagacgaactaacttcccaaaaggtaacctaacggtctttacgttaccttaacaaaaacgtgtaaaacctcggtaccgtaggaacggtaccgtacccgaagtaccggaaccgtaccgggtaccgtttgttaacttacgtcggtcggaacggtaaggagggtacggttaccggggtaaacccctaacggttaaacccgtttcgttaaccgtcgttaacggtccgggtaaccgggtccggttacgggggtaacccgaaaccgggggtaacccc

SEQ ID NO: 380170 - DNA, 566 bp, Homo sapiens
  misc_feature: GZ8MTXP01DQXPU.13.76.G10.1.454.CMB.2.raw
  modified_base (438)..(438): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggttcaccgtcagtcacacctacatgagctgggtccgccaggctccgagggagggggctggagtgcgtcttcttttatttatagtagtggtagtacatactccgcagaactccgtggaggggccgattcaccatctccagagactaatccaaagacacgtcttgtttctacaaatgaaacngcctagagagccgaatgaccacgggtccgttgtattactggtgcgagagacgttcgggggacccaacggttaacgttcacgtctaagtcgggaacggtcgttacgggggaacccaaggggtaaccccg

SEQ ID NO: 380171 - DNA, 819 bp, Homo sapiens
  misc_feature: GZ8MTXP01BF94V.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccaggccgtgggggtccctgagtactctcctgtgcagcctcgtgggttcaccgtcagtcacacctacatgagcgtcgggtcccgccaggcctccggaagggggaaggggctgggagtcgtcgttcttcttttattatagtagtggtagtacatactccgcagtaacgtccgtgggacggggtcccgtattccgacctactccgtaccaaggaacgaacctaaacttacccgaaaaaggtaaccctaaccgggtacttttacggttttacccttaaaaccaaaagttaccggaaaaacctaccgggtaccccggtttaaagggaaacggtaaaccggaccccggtaaagttacccgggaaacccggaccgggggttacccccggtttaaggtttaaaccctttaacccgggttgggttacgggaacccgggtaaagggacgggtaaccggggttacccggggggaaaccccctaaaacggggttaaaaccccgggttttacccgttaaaccggggttccccgttaaaggtccggggggtaaacccgggttccgggttaacccggggggggaacccccggttaaaaccggggggtaacccccccgg

SEQ ID NO: 380172 - DNA, 660 bp, Homo sapiens
  misc_feature: GZ8MTXP01DIF9I.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtctggaggaggcttgatccagccgtgggggtccctgagactctcctgtgcagcctcgtgggttcaccgtcagtcacacctacatgagcgtcgggtcccgccgaggcctaccggagggggaagggggcgtgggagttcggcgtttctttactttttaagtttagtaggttaggtggtagtaccatacgtccgcacgaacctccgtggacggggtcctaattccaccactcctaccagacgaacaacttaccaaagaacacgtcttagtttacctacaaatacgaacacgcctgaagacgccgaagtcgaccgacgggtaccgttggttaattaccgtggtggaaccggaagaggacggttccgggggaacccctaacgggttaaaacccgttttacgaacccgggttcgttaacggtcgggtaccggtcgggttaccggggaacccgaaaccggggtaacccg

SEQ ID NO: 380173 - DNA, 645 bp, Homo sapiens
  misc_feature: GZ8MTXP01BN66C.13.76.G10.1.454.CMB.2.raw
  modified_base (369)..(369): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtcgggtccgcgaggcctccggaggggaagggggcgtggagtcgtcgttctttcttttattagtagtagtggtagtaccatacncgcagaacctccggtggacggggcctattccgacctactcctaccagacaactaacttaccgaaagaaccacgtctttagttttaccttaacaaagtcgaaactacgaccgttaggaaggacgcccgtaagtccgaaccgaccgggtaccgttagttaactttacgtggtcgaacggaggaggtacggttcggggaacccctaacggttaaaccgtttcgacgtcgtagtcggggtaccgtcggttaccgggggaaccgttaacggggtaaccccg

SEQ ID NO: 380174 - DNA, 606 bp, Homo sapiens
  misc_feature: GZ8MTXP01B0LP5.13.76.G10.1.454.CMB.2.raw
  modified_base (374)..(374): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacactacatgagctgggtcccgcaggcctccgaggggagggggctggagtgcgttcttcttttatttatagtagtggtataccatactccgcagaactccggnggacgggccgattccgaccatctaccagagaaccaagttaccaaagaaccacgtcttagtttctacaaatgaacagccgtgaagacgcccggtatgaccgtacggacccgttgtaactttacgtggtcggaacggaggaggtacggttcgggggacccctaacgttaaccgttaccgaacggtctaagtcgggtaccgtcggttacgggggaaccgttaacggggaaccccg

SEQ ID NO: 380175 - DNA, 497 bp, Homo sapiens
  misc_feature: GZ8MTXP01A7MG3.13.76.G10.1.454.CMB.2.raw
  modified_base (330)..(330): a, c, t, g, unknown or other
  modified_base (389)..(389): a, c, t, g, unknown or other
  modified_base (394)..(394): a, c, t, g, unknown or other
  modified_base (406)..(406): a, c, t, g, unknown or other
  modified_base (413)..(413): a, c, t, g, unknown or other
  modified_base (420)..(420): a, c, t, g, unknown or other
  modified_base (422)..(422): a, c, t, g, unknown or other
  modified_base (426)..(426): a, c, t, g, unknown or other
  modified_base (434)..(435): a, c, t, g, unknown or other
  modified_base (446)..(446): a, c, t, g, unknown or other
  modified_base (450)..(450): a, c, t, g, unknown or other
  modified_base (453)..(453): a, c, t, g, unknown or other
  modified_base (455)..(455): a, c, t, g, unknown or other
  modified_base (457)..(457): a, c, t, g, unknown or other
  modified_base (459)..(459): a, c, t, g, unknown or other
  modified_base (461)..(461): a, c, t, g, unknown or other
  modified_base (478)..(479): a, c, t, g, unknown or other
  modified_base (482)..(482): a, c, t, g, unknown or other
tcagtcacgtactacacgaccggtgctcgatttagtcactcatacagggggagaggagcccagcactgggattccgaggtgtttccattcggtgatcagcactgaacacagaggactcaccatggagttttggctgagcgtggtttccgtgttagctattctaaaggtgcccagtgtgaggtgcagctggtggagtctggaggaggcttgatccagccgtgggggtccctgagactctcctgtgcagcctctgggttcaccgtcagtcacacctacatgagctggggtcccgccaggcctccgaggggaacggggctggagtgcgtcttnttttattatagtagtcggtatacatactccgcaagactcgtgacggggccatcacatcncaganacatccaagacncgctgtntacatananagcngagagcgnngacgacgcgtntatntgngngngngngcggcgacgacgttacnntgngcgcgtcggcgaacg

SEQ ID NO: 380176 - DNA, 657 bp, Homo sapiens
  misc_feature: GZ8MTXP01C0JWK.13.76.G10.1.454.CMB.2.raw
  modified_base (361)..(361): a, c, t, g, unknown or other
  modified_base (377)..(377): a, c, t, g, unknown or other
  modified_base (465)..(465): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagtttggctgagctgggttttccttgttgctattttaaaaggtgcccagtgtgaggtgcagctggtggagtcgtggaggaggcttgatccagccgtgggggtccctgagactctcctgtgcagcctcgtcgggttcaccgtcagtcacacctacatgagcgtggtcccgcaggctccggaggggaaggggctggagtgcgttctttctttattatagtagtggtataccatacncgcacgtaaccgtcgngggacgggctatccaactctcctacgaagactaactaacttaccgaaagtaccgtacgtcttttacgttacctaacaaatcggaaacncgtccggtaggaacgggacctaccggtaatacggaaccgtccgggttaccgttagttaaacgttccggtaggtacggaacggtaagacgggtcgggcccgggtaaacccctaacggttaaccgttaccgaccgtaacggtaaggtccggttacggtcggttaccggggaacccgggttaaacgtaaccccgg

SEQ ID NO: 380177 - DNA, 625 bp, Homo sapiens
  misc_feature: GZ8MTXP01AQZWB.13.76.G10.1.454.CMB.2.raw
  modified_base (239)..(239): a, c, t, g, unknown or other
  modified_base (297)..(297): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggacagataaatntacttctggtatcagcagaagtcaggcccagtcccctgtcgctggtcatctatcaagntgccaaggccgccctgagggactccccctggagcgtattcgtctcgcctaccgaactcgacgggaactcgacgtcccaacctctacggacctacgtccgacgggacccgggaccccgtaaggtccgttagtaggggtaacgttagggaacggacgttacggtaacctttaacgttaaccgttggttacccggaggggtaccggttacgggggacctaacggaccgacgcccgtaaccgtcggaccccgtcgttacgtcgttccggttacggaccggttcgggaaccgtacggtccacccggtacgttacgtccgaaccggtaaccccg

SEQ ID NO: 380178 - DNA, 596 bp, Homo sapiens
  misc_feature: GZ8MTXP01EADDH.13.76.G10.1.454.CMB.2.raw
  modified_base (303)..(303): a, c, t, g, unknown or other
  modified_base (406)..(406): a, c, t, g, unknown or other
  modified_base (423)..(423): a, c, t, g, unknown or other
  modified_base (426)..(426): a, c, t, g, unknown or other
  modified_base (461)..(461): a, c, t, g, unknown or other
  modified_base (486)..(486): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcgtggggttttccttgttgctattttaaaaggtgcccagtgtgaggtgcagctgggtggagtcgtgggagggagggcttggatccagccgtggggggtccctgagactctcctgtgcagcctctgggttcaccgtcagtcacacctacatgagctcgggtccncaggctccgagggaaggggctggagtgcgtcttcttttattatagtagtggtagtacatactccgcagaactccgtggaggggccattcaccatctccagaanacactacaagacacgtnttnttactacaaatagaactcgcgtagagacgacgtancgacgacggtcgttagtacttacgngtgaacgaggacggtacgttaccggggtaaccctaacggttaaccgttacgttacgtcgtaggtcgggtacggttcgggttaccggggtaacccggaacggggtaacccg

SEQ ID NO: 380179 - DNA, 730 bp, Homo sapiens
  misc_feature: GZ8MTXP01AQJPW.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtcgtggaggaggcttgatccagccgtgggggtccctgagactctcctgtgcagcctcgtgggttccaccgtcagtcacacctacatgagcgtcgggtcccgccgaggccgtccggagggggaacgggggcgtgggagtgcgttcttcttttatttatagtagtggtagtacatactccgacacgcgtcggtggacggggcctagttcacctacttccctaccaaggtacgaactaaacttacccgaaaaggacctacggtctttacgttttaccttaacgaaaacgttcggaaaacctcggtcccgttagaacgggtacgcccggtaagttccgggaaacccgtccggggttacccggttagttaaacgtttaaccggtgggttacggaccgggaaagggttaacgggtaacggggttcccggggggttaacccccttaaacggggttaaacccgttttaaccgtaaccgggtaactttaaacggggtccggggttacccgggttcggggttaacccggggggaaaccccg

SEQ ID NO: 380180 - DNA, 639 bp, Homo sapiens
  misc_feature: GZ8MTXP01BWGGM.13.76.G10.1.454.CMB.2.raw
  modified_base (378)..(378): a, c, t, g, unknown or other
  modified_base (535)..(535): a, c, t, g, unknown or other
  modified_base (545)..(545): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgactccgagccgtgggggtccctgagacctctcctgtgcagcctcgtgggtcaccgtcagtcacacctacagtgagcgtcgggtcccgccgaggcctccggaggggaaggggctgggagtcgtcgttctttcttttatttagtagtagtggtacgtacctactacnccgcagaacctccggtggacgggccgtattccgacctatcctaccaagacaactaacttccgaaagaacctacggtctttagtttacctacaaaagtcgaaacacgtccgtaggaacgtacgcccgtatacgaccgacggtccgttagtacttacgngtggcgaagnggtacggttccggggaaccccaaggttaaccgtttccaacggtcgttagtcgggtccggtccggttacgggggtaacccaacggggtaaccccg

SEQ ID NO: 380181 - DNA, 579 bp, Homo sapiens
  misc_feature: GZ8MTXP01CQHJB.13.76.G10.1.454.CMB.2.raw
  modified_base (462)..(462): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagctggtccgccaggctccgaggggaggggctggagtgcgttcttcttttatttatagtagtggtagtaccatactcgcagaacctcgtggaggggcccgattcaccactctaccagagaacaattaccaaagaccacgtcttagtttcttacaaatcgaacagccggtgacgagccgancgacgacggtccgttgtattacgtgtgaacgaggagacggcgggaccccaaggttaaccgttccacggtcctaagtcgggtaccgtcggttacggggaaccgttaaggggaaccccg

SEQ ID NO: 380182 - DNA, 589 bp, Homo sapiens
  misc_feature: GZ8MTXP01BG7DA.13.76.G10.1.454.CMB.2.raw
  modified_base (372)..(372): a, c, t, g, unknown or other
  modified_base (441)..(441): a, c, t, g, unknown or other
  modified_base (493)..(493): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggtttcttgttgctatttaaaggtgccagtgtgaggtgcagctggtggagtctggaggaggcttgatccaggccgtggggggtccctgagactctcctgtgcagcctctgggttcaccgtcagtcacacctacatgagcgtggtcccgccgaggctccggaggggagggggcgtggagtgcgttcttctttttatttatagtagtggtagtaccatactcgcagactcgnggagggccgattcactatctaccagagacaactaccaaagaacacgtcttcgtttctacaaatgaaacncgccgtgaagacgccgagtcgacgacggtccgtgttaacttacgtggtcggngaagaggtacgttcgggggacccctaacggttaaccgtttacgaccgtctaaggtcgggacggtcgttcgggggtaaccgaacgggggtaaccccg

SEQ ID NO: 380183 - DNA, 745 bp, Homo sapiens
  misc_feature: GZ8MTXP01CECAR.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtgggtcaccgtcacgtcacacctacatgagcgtcgggtcccgccgaggcctccggagggggaacggggcgtaggagtcgtcgtttctttctttttaatttagtaggttagtaggttaagtacctatacgtccgacgtaacgtaaccgttccgggtgggacgggggtacccgtactttacccgaacctacttaccgtacccgaaagtaacggaaaccctaaaacttacccgaaaaacggtaaaccctaaccgggttccttttacgttttacctttaaacaaaaacgttacggaaaacctacggtccgttaagggaacggaacgacccgtaatacgaaccgaccgggtaccgtagttaaacgttacgtggtgaaccgggaggaacgggtacggccggggtaaaccccgtaaggttaaacccgtttcgaccgtcgttaaagtcgggtaccggtacgggttacgggggaacccgttaaacgggggtaaccccg

SEQ ID NO: 380184 - DNA, 594 bp, Homo sapiens
  misc_feature: GZ8MTXP01AC2I0.13.76.G10.1.454.CMB.2.raw
  modified_base (393)..(393): a, c, t, g, unknown or other
tcagtcacgtactacacgaccggtgctcgatttagtcactcatacaggggggagaggagcccagcactgggattccgaggtgtttccattcggtgatcagcactgaacacagaggactaaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacaccacatgagcgtgggtcccgccgaggcctccgaggggagggctggagtgcgtcttcttttatttagtagtagtgtagtacactactcgcagactccgtgaacggggccattcaccatcncagagacaacttcaaagacacgtctgtttactacaaatgaaacagccctaggggacgacgcccgagtcgaccgacgggccgttagtaacttaccgtggtcgacggaaggacggttaggtcgggggaccccaagggtaaccgtttaccgacggctaaggtcggaacgtcggtcgggggacccaacggggttcccgaaccggg

SEQ ID NO: 380185 - DNA, 604 bp, Homo sapiens
  misc_feature: GZ8MTXP01C41LL.13.76.G10.1.454.CMB.2.raw
  modified_base (419)..(419): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataatggacagaataaatatacttcctggtatcagcagaagtcagccagtcccctgtgctggtcatctatacaagatcgaccaacggccggcccctacgacgggactcccccgtgacgcgtattctcgtggtcctaccaacgtcgtagggaacctcacgccctactctacgaccagtcgacggacggacccaggtactagnggaatgggtaacgcgttacggtaacttagttacgtacgtaccggtacgggtcgggtacgggacgtaacggccgacggaccgtaaccgtccggaccccgtcttacgttcggttccgttaccgggacgttacggggaaccctaagggttcccaacccggtaccttaacggtccgaaccgaaccccgg

SEQ ID NO: 380186 - DNA, 630 bp, Homo sapiens
  misc_feature: GZ8MTXP01BH1YH.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctgggggtccctgagactctcctgtgcagcctctgggtcaccgtcagtcacacctacatgagcgtcgggtccgccaggcctccgaggggaaggggctgggagtgcgtcttcttttattatagtagtggtagtaccatactccgcagaacctccgtgagggggccagttcaccatcctacagagacaatccaagaacacgcttagtttctacgaaatcgaaactagccgttagaacggacgacccgtagtcgaaccgtaccgggtcccgttaggttattaaccgtggtcggaacggaagacgggtaagttccggggggaacccctaaacggttaaacccggtttccgaaccgtccgttaagtcggggtaaccgtcgggttacgggggaacccgttaaacgggggaaccccg

SEQ ID NO: 380187 - DNA, 625 bp, Homo sapiens
  misc_feature: GZ8MTXP01BKDYW.13.76.G10.1.454.CMB.2.raw
  modified_base (413)..(413): a, c, t, g, unknown or other
  modified_base (448)..(448): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctatttaaaggtgccagtgtgaggtgcagctggtggagtctggaggaggcttgatccagccgtgggggtccctgagactctcctgtgcagcctctgggtcaccgtcagtcacacctacatgagcgtcgggtccgcaggcctaccggaggggaaggggctgggagtgtcgtctttcttttattattagtagtggtacgtaccatacgtccgcagtaacctccggtggacggggccgtattccacctatctaccaganaactaactcaaagaacacgtcttagtttcctaaanaagtacgaactcgtacggtagaacgaccgacgtagcggaaccgtccgggtaccgttagttaacgttcgtggacgaacggaaggacgggtacggttaccggggaaccctaaacggttaccgttacacggtcgtaggtcgggtaccggtcgggaccggggaacccgaacgggtaacccg

SEQ ID NO: 380188 - DNA, 601 bp, Homo sapiens
  misc_feature: GZ8MTXP01AS7JK.13.76.G10.1.454.CMB.2.raw
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtctgggaggaggcttgatccagccgtgggggtccctgagactctctgtgcagcctcgtgggtccaccgtcagtcacacctacatgagctcgggtcccgccgaggcctaccgagggggaacggggctggagtgcgttcttcgttttattagtagtagtcggtagtacatactccgcaagactcggtgaggggcccattccacatcctccaagacgaacaacttaccaaagaaccacgtcttgtttacttacaaatcgaaacagggtccctaggagacgtacccgatcggaacaccgggtcctgttattaccgtggtgcgttaggacgttaggtccggggacccaacggttaacttacgtaacgtcctaagtcgggacgttcggtcgggggaacccgaaccgggg

SEQ ID NO: 380189 - DNA, 634 bp, Homo sapiens
  misc_feature: GZ8MTXP01AJ1VC.13.76.G10.1.454.CMB.2.raw
  modified_base (545)..(545): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtcctgagactctcctgtgcagcctcgtggtcacgtcagtcacactacatgagcgtcggtccgccgaggcctccggaggggaaggggcgtgggagtgtcgtttctttctttttattagtagttagtggtataccactacgtccgacgacgtaaccgtccggtggacggggcctacgttccaacctctacctaccgaagagtaacctaaacttacccgaaaggtaaccctacggtactttacgtttacctaacaaaactcggaaactacgtccgtagacggacgaccgagtacgacgaacgggttcctagtacttacgngtggaacgaggaggcgttacggggaccctaacggttaacgttacaccgtgtagtcgggacgttcggacggggaaccgaagggtaacccg

SEQ ID NO: 380190 - DNA, 552 bp, Homo sapiens
  misc_feature: GZ8MTXP01DCURB.13.76.G10.1.454.CMB.2.raw
  modified_base (234)..(234): a, c, t, g, unknown or other
  modified_base (358)..(358): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcacgccgcctcagtgtcgtgggccccagggcagaggtcacatctcctgcacgtgggancagctcaacagttgggcacattatgatgtacactgtaccagcagttccagagcaggtcccagactcctcatcaaataacgtaacaacaatccggacccgacacggggtccctagaccgtattcncgtggctaccagtctcggcacccgtcacgccttccgtgtcacttccacgtcgggtccctacggacggtcgtacgaggagtgaggtctagtacttattcgtcgtcctaagtccttatcgacgacgccttagttccttggtaacgtcggtcgttttaccgggacggtttcccgggggcgggggttaacccgtccgg

SEQ ID NO: 380191 - DNA, 598 bp, Homo sapiens
  misc_feature: GZ8MTXP01A8TGF.13.76.G10.1.454.CMB.2.raw
  modified_base (362)..(362): a, c, t, g, unknown or other
  modified_base (437)..(437): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagcgtgggtcccgcaggctccgaggggaaggggctggagtgcgtcttcttttagttatagtagtgtagtaccatactccgnagaacctcgtgaggagccgattcacatctcagagacaattcccaaagaacacgtcttgttactacaaatgaaacnggcctagacgacgtccgagtcgacgtaccggtccgttgtacgttacgtggtaacgcggaaagagacggtaccgggggaaccccttaacgggttaaccgttaccgtaacgggaccttaaggcggggtaccgttcgggtaacgggggaacccgaaaccggggg

SEQ ID NO: 380192 - DNA, 585 bp, Homo sapiens
  misc_feature: GZ8MTXP01AJRRT.13.76.G10.1.454.CMB.2.raw
  modified_base (437)..(437): a, c, t, g, unknown or other
  modified_base (478)..(478): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggttcaccgtcagtcacacctacatgagctgggtcccgccaggctccgagggaggggctggagtgcgttcttcttttattatagtagtggtagtaccatactcgcagaactccgtgacgggccattccacatctccagagacaattccaaagacacgcttgtttactacaaatgaaacngccgtagacgacgccgatcgacacgggccgtgtacttacgngtggaaccgaggaggacgttcgggggacccctaacgggttaaccgtttcgaccgcgttagtcggggaccggttcggttacgggggtaacccaaacgggggaaccccg

SEQ ID NO: 380193 - DNA, 674 bp, Homo sapiens
  misc_feature: GZ8MTXP01BXZVT.13.76.G10.1.454.CMB.2.raw
  modified_base (171)..(171): a, c, t, g, unknown or other
  modified_base (282)..(282): a, c, t, g, unknown or other
  modified_base (447)..(447): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccacctnagtgtccgtgtcccaggacagacagccagcatcactgctctaggaaataaagttggactaagaataaaattactacttcctaggtatcagcagaagtcaggccagtccccngtgctggtccatctatacaaggatagaccgtaaacggccggacccctaggacggggtaactccccccgtaggaacgtccggtacttccgtaaccgtcgggtcctaccctaaaccgttccgtaacggggaaaccttcgaaacgtccccaactcctacgaaccctanaccgaacggacccggggaaccccaaggtccgttaagcggaagtggtaacgggtctacggttaaccttagttaaccgtggttaccgaggggtcggtacgggaacgtacgcgaacggcctaaccgtcggccccgtagttacgtacggttcccgttaacgggacgttaccggggaaccgtacgggtaaccacccgggttacttaacggttaacccgaacgaaacccccgg

SEQ ID NO: 380194 - DNA, 578 bp, Homo sapiens
  misc_feature: GZ8MTXP01DLDPQ.13.76.G10.1.454.CMB.2.raw
  modified_base (403)..(403): a, c, t, g, unknown or other
  modified_base (451)..(451): a, c, t, g, unknown or other
  modified_base (464)..(464): a, c, t, g, unknown or other
  modified_base (514)..(514): a, c, t, g, unknown or other
  modified_base (537)..(537): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggtcaccgtcagtcacacctacatgagcgtcgggtcccgcaggcctccggaggggaagggggcgtgggagtggtcgtctttcttttatttatagtagtggtagtacatactccgcagaacctccgtggacggggcctattcaccntctccagagactaatccaaagaacacgcttgtttcacaaatcgaaacngaccgtagaacgngaccgatcggacgacgggtccgttagttacttacgtgtggaacgaggagngttcggggaccctagaaccgttnacgtctagtcgggacgtcggttaggggccgaagggtaaccc

SEQ ID NO: 380195 - DNA, 695 bp, Homo sapiens
  misc_feature: GZ8MTXP01BOTZ4.13.76.G10.1.454.CMB.2.raw
  modified_base (248)..(248): a, c, t, g, unknown or other
  modified_base (266)..(266): a, c, t, g, unknown or other
  modified_base (279)..(279): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtctggaggaggcttgatccagccgtgggggtccctgagactctcctgtgcngcctcgtgggtcaccgtnagtcacacctacntgagcgtcgggtccgcgaggccgtaccggaggggaggggctggagtgtcgttctttcttttattatagtagtggtagtaccatactccgacacgtaccgtccggtgggacggggcctattccacctacgtcctacccgaaggaactaacctaaacgttaccgaaaacgtaaccgtaaccgggttctttacggttttaccttaaacaaaacgttacggaaaaccgtcggtacccggtaaggaacgggaccgtacccgtaaagtcccggaaccgtaccggggttaccgttaggttaaacttaccggttggtaccggaacggtaaggaggtacgggttccggggacccctaaacggttaaccgtttacacggtctaggtcggaccggtcggttaccggggaacccaaggggtaaccccg

SEQ ID NO: 380196 - DNA, 616 bp, Homo sapiens
  misc_feature: GZ8MTXP01EU60E.13.76.G10.1.454.CMB.2.raw
  modified_base (333)..(333): a, c, t, g, unknown or other
  modified_base (361)..(361): a, c, t, g, unknown or other
  modified_base (454)..(454): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctatttaaaaggtgcccagtgtgaggtgcagctgggtggagtcgtggaggaggcttgatccaggccgtcgggggtccctgagactctcctgtgcagcctctgggtcaccgtcagtcacactacatgagcgtcggtccgccaggctccggaggggaggggctggagtgtcgtctttnttttattagtagtagtgtagtacatacncgcacgaacctcggtggacggggccatcacctactctacagacgaactaactaccaaagaactacgtctttactttactaacaaatcgaaacncggacctggaagtcgaccgtatcggacccgtaacgggtccgttagtaaagtttccgtggtcggaacggaaggacggtacgggttccggggaaccctaaacggttaacgttacgaccgtctaggtccggtacggtcggacggggaaccgaacgggtaaccccg

SEQ ID NO: 380197 - DNA, 599 bp, Homo sapiens
  misc_feature: GZ8MTXP01D5MF4.13.76.G10.1.454.CMB.2.raw
  modified_base (237)..(237): a, c, t, g, unknown or other
  modified_base (263)..(263): a, c, t, g, unknown or other
  modified_base (466)..(466): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagcccgccctcagtgtctcggggccccagggcagaggtcaccatctcctgcactggggancagctccaacagttggggcacattangatgtacactggtaccagctagtttccaggagcgacggtcccagactcctacatacaaataacgtaaacaaacgaacgtcccggacccgacgacggggtccctacggaaccgtacttcctcgtcggctcccgaggtcgcggtcacctcacgtccctccgtgtccactccgacgtcgggtcctccgggacggcgttaggaaggngtggagtctagtactttacttctcggtcctaaggttcccttagttaccgacgacgtaccacgttccgttaggtaacgtcggttcgtttaccgggtacggttccgggggcccgggggttaacccgtaaccgggg

SEQ ID NO: 380198 - DNA, 610 bp, Homo sapiens
  misc_feature: GZ8MTXP01A9RYN.13.76.G10.1.454.CMB.2.raw
  modified_base (170)..(170): a, c, t, g, unknown or other
  modified_base (195)..(195): a, c, t, g, unknown or other
  modified_base (211)..(211): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacngccagcatcactgctntagaaataatgacagataatatacttctgtatcagcagaagtcaggccacgtcccctgtgctggtcagtctatacaagatcgaccaaggccgccctagagggactcccccgtggacgtcgtacttccgtcgtcggtccctactaaactcgtacgggacctcgacgcctacgtctacgaccagtccgacgggacccgggaacccaggtccttaagtcggaagttacggaacggtccgtaaggttacttaacgttacgttcggtaccgagggttcggacggggacagggcacgccgtaacgtcggcccgtgttacgtcggttacgttacgggttacgttcgggggtaaccctacgggttccgaacccggttaccttaacggtcccgaaccggaacccccgg

SEQ ID NO: 380199 - DNA, 704 bp, Homo sapiens
  misc_feature: GZ8MTXP01BJZ0V.13.76.G10.1.454.CMB.2.raw
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagaataaatatacttctggtatcagcagaagtcaggccagtccccctgtgctggtcatcctatcaagatgaccaaagccggccctcgacggggacctccccgtaggacgtcgtactttcctcgtcggccttcccgaaacttccgtacgggggaaaccttcgaacggtcccctaaattcccgttacggaacccttaacgccgaaacgggccggggtaaccccaggggtaccctagttcgggaattcgggaacgggggtcccttaagggtacctttaacgtttaaccgtcggttacccggtagggggtaccggttacgggggaaccacgggacccaaacggggccctaaccgttccgggcccccggttattaacggttcgggtttaccccggtttcgggaaacccgggttaagggggaacccctaagggttaccccgaacccggtttacccgtaaaacgggttcccgaaaccccggg

SEQ ID NO: 380200 - DNA, 664 bp, Homo sapiens
  misc_feature: GZ8MTXP01BWSP1.13.76.G10.1.454.CMB.2.raw
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagcccgccctcagtgtctggggccccagggcagagggtcaccatctcctgcactgggagcagctccaacagttgggcacattatgatgtacactggtaccagctagtttccaggagcgaggtcccagctcctcatcaatacgtaacaacaagtccggcccgacgacggggtccctggaccgtattcctcgtcgggctccgaggtctcggccacctccgacgtccccttcccgtaggtcctactcgacgttcggggccttaccggggaacgggtccgtagggacgggtaagtcggtaacgggtcgttaggtaacttttacgtttccgtcggtccccgtaaggttccccttaagttaccgggaccaaacggggtccaaccgggttcccgttagggtaacggtttccgggttaacccgggttttccggggttaacggggttttcccccggggggggaaccccgggggggttaaacccccgttaacggggg

SEQ ID NO: 380201 - DNA, 779 bp, Homo sapiens
  misc_feature: GZ8MTXP01AJD2E.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccggtcagtcacacctacatgagcgtcgggtccgccgaggccgtcccggagggggaagggggcgtgggagtgtcgttctttacttttattagtagtagtggtagtaccatactccgcacgaactccggtggacggggccgtattccacctactcctacccgaagacgaacctaaacgtttacccgaaaaggaaaccctccggtaccttttacggtttttacccttaaccggaaaaattaccggaaaccgtacggtaccccggttagggaaacggaccggaccccggtaagttccgggaaacccgtaccgggggtaccccgtttagttaaaccgtttaccgttggggtcggaaccgggaaagggttaacgggtaccggggttacccggggggaacccccaaaccgggttaaaccggtttacccgttaccggggtaaccttacgggttaacgggggaacccgggtttccggggttacccgggggggtaaccccgaaaaccggggggttaaccccccggg

SEQ ID NO: 380202 - DNA, 629 bp, Homo sapiens
  misc_feature: GZ8MTXP01ARU10.13.76.G10.1.454.CMB.2.raw
  modified_base (297)..(297): a, c, t, g, unknown or other
  modified_base (550)..(550): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtctggaggaggcttgatccagccgtgggggtccctgagactctcctgtgcagtcctctgggttcaccgtcagtcacacctacatgagcgtgggtcccncgaggcctccggaggggaaggggctgggagtgtcgttctttcttttattagtagttagtggtataccatactccgacagtaacctccggtggacggggtccgtacttccaaccctacttccgtacccgaagaacgtaacctaaacgttacccgaaaagtaaccaccggtctttagtttaccttaacaaaagttcgaaacgtacgccgttaggacgacgacccgaataccgacgtacggccgttgtaacttcgngtgaacgagaggcttcggggacccaggttaaccgttcacgtctagtcggacttcgggacggggaaccgaacgggtcccg

SEQ ID NO: 380203 - DNA, 612 bp, Homo sapiens
  misc_feature: GZ8MTXP01DUW11.13.76.G10.1.454.CMB.2.raw
  modified_base (515)..(515): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgtcttaattttaaaaggtgcccagtgtgaggtgcagcgtggtggagtcgtggaggaggcttgatccagccgtgggggtccctgagactctcctgtgcagcctctgggtcaccgtcagtcacacctacatgagcgtcgggtcccgccaggccgtccgaggggaaggggcgtggagtgtcgtctttacttttatttagtagtagtggtagtaccatactcgcacgaactcgtggacggggcctattccaccatcctaccagagaacaattccaaaagacacgtcttagtttctacaaaatgaaactcgccgtagacggacgaccgagtacgaaccgtacggtccgtattaacttacgtgnggaacgaaggacggtacggttccgggaacccctaagttaaccgtttacgacgtaacgtagtcgggaccgtcggacggggaaccgaacgggaaccccg

SEQ ID NO: 380204 - DNA, 606 bp, Homo sapiens
  misc_feature: GZ8MTXP01AS0BZ.13.76.G10.1.454.CMB.2.raw
  modified_base (478)..(478): a, c, t, g, unknown or other
  modified_base (527)..(527): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagctctcctgtgcagcctcgtgggttcaccgtcagtcacacctacatgagcgtcgggtcccgccgaggcctccggaggggacggggctgggagtggtcgttctttcttttattatagtagtggtagtaccatactccgcacgaaccgtcggtggacggggccgtacttccacctactcctaccgaagacgtaacctaacttaccaaagacctacggtctttagtttacctaagaaactcgaaacncgcctaggacgacggccgaatccggaccgtaccggtccgtagtattcgnggtgaacggtagaggtacgttccggggaccctaacgggttacgttcacgctagtcgacgtcgaggtaacggccgaacgg

SEQ ID NO: 380205 - DNA, 694 bp, Homo sapiens
  misc_feature: GZ8MTXP01D92VN.13.76.G10.1.454.CMB.2.raw
  modified_base (215)..(215): a, c, t, g, unknown or other
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctntagaaataatggcagataaatatacttctgtatcagcagagtcaggccagtcccctgtcgctggtcatctaatcaagactgaccaaggccggccctgacgggacctccccgtagacgcgtattcctactcggcctacccaaacttcgtaggggtaaactttccgacgtcccacttccgtacgacctacgtccgaacgggacccgggaacccagggtccttaggtgggtaacttcgggaacgggggtctttacggtaccttacgtttcgtacggtccggtacggggtaccgggttacggggaaaccctaaacggtacgggtccgggtcgggttccggtttcgggggtttcccgggggaccgggggtaaccggggtaacccgttaacgggtttcccgttaacggggtaaccccggtttcggtttaacggggttacccgaccgggttacccccgtaagggggttccccgtttccccccgggg

SEQ ID NO: 380206 - DNA, 614 bp, Homo sapiens
  misc_feature: GZ8MTXP01DRTZK.13.76.G10.1.454.CMB.2.raw
  modified_base (382)..(382): a, c, t, g, unknown or other
  modified_base (388)..(388): a, c, t, g, unknown or other
  modified_base (403)..(403): a, c, t, g, unknown or other
tcagtcacgtactacacgaccggtgctcgatttagtcactcatacaggggctgggagaggagcccagcactgggattccgaggtgtttccattcggtgatcaccactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggtcaccgtcagtcacacctacatgagctgggtccgccaggctccgaggggaaggggctggagtgcgtctcttttattatagtagtgtagtacatactcgcaagactccgtgagggccatcacntctcanagacatccaagaacncgcttgttactacgaaaatcgaaacacggggccctaggaacgacgacccgtaattcggaaccgaaccggggtcccgtaggttaactttaccgtggttcggacggttaggaaacggacggttaccgggggaccccaaacggttaacgtttaaccgtaacggaccgttaagtcggggaaccgttccggtaacgggggcccgtaaaaccggggg

SEQ ID NO: 380207 - DNA, 595 bp, Homo sapiens
  misc_feature: GZ8MTXP01BWDR5.13.76.G10.1.454.CMB.2.raw
  modified_base (508)..(508): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtctggaggaggcttgatcccgccgtgggggtccctgagactctcctgtgcagcctcgtgggttcaccgtcagtcacacctacatgagcgtgggtccgccgaggctccgaggggaggggcgtggagtgcgttcttcttttatttatagtagtggtacgtacatactccgcaacgactcgtgacgggtccgattccacctatctaccgagtacgaactaacttaccaaagaacctacgtcttcgtttacctacaaatacgaaactacggcctagacgacgccgatcgacgaccggtccgtagtattacgnggtaacgcggagaggacgtcgggggaccccacggttaaccttacgaacgctaagtcgggacgttcgggtaacggggcccgaacgggg

SEQ ID NO: 380208 - DNA, 567 bp, Homo sapiens
  misc_feature: GZ8MTXP01B1KGW.13.76.G10.1.454.CMB.2.raw
  modified_base (336)..(336): a, c, t, g, unknown or other
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctagaaataatggacagataaatatactctgtatcagcagagtcaggccagtcccctgtgctggtcatctatcaagatgaccaagccggccctagacgggacctcccgtgacgcgtatttcncgtcggcctacccaaactcgtagggaactcgacgccctactcctacgacctactccgaacgggccggggaaccccagggtctaagtggaattcggaaggggtctagtacttacgttaccgtgtcgaggtcgtgggacaggcaggccacgttcggcccttgttacgtcgttacgttcggaccgttaagggacccgtaaggtcccaccggttacctaaaggttccaaacccgg

SEQ ID NO: 380209 - DNA, 649 bp, Homo sapiens
  misc_feature: GZ8MTXP01AP374.13.76.G10.1.454.CMB.2.raw
  modified_base (531)..(531): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggtcaccgtcagtcacacctacatgagcgtcgggtcccgccgaggccgtccgaggggaaggggcgtgggagtgcgttctttcttttattagtagtagtggtagtaccatactccgacagtaacctcggtggacggggcctattccaccactctaccagacgaactaaacttaccgaaagactaccgtctttagtttactaacaaaagttcgaaacacggccgtaggaacgaccgaccgtaatcggaaccgaccgggtaccgttagtactttacgnggtcggaacggtaggaggtacggttccggggaacccctaacgggttaaacgttccgacggtccgttaaggtccgggtaaccgtcgggttacgggggtaacccgaacggggtaaccccg

SEQ ID NO: 380210 - DNA, 619 bp, Homo sapiens
  misc_feature: GZ8MTXP01D6GIO.13.76.G10.1.454.CMB.2.raw
  modified_base (425)..(425): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaggtgccagtgtgaggtgcagctggtggagtctggaggaggcttgatccagccgtgggggtccctgagactctcctgtgcagcctcgtgggttcaccgtcagcacacctacatgagcgtgggtccgcgaggctaccggaggggaaggggctgggagtgacgtcttgttttattagtagtagtggtatacatacctcgacagctccggtggacggggccattccactatctccagagactaattaccgaaagtaaccncgtacttacgtttactaacaaagtcgaaacgtacgccgtagacgacgcccgtaagtcggaaccgtccggtaccgttagttaagttcgtggtcgacggaacggttaggacgggtaccggggaaccccttaacggttaaaccgttaactaccggtaacgttaggtacgggttaccggtcgggaacgggggaacccg

SEQ ID NO: 380211 - DNA, 561 bp, Homo sapiens
  misc_feature: GZ8MTXP01D5OXT.13.76.G10.1.454.CMB.2.raw
tcagtcacgtactacacgaccggtgctcgatttagtcactcatacagggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagctgggtccgccaggctccgaggggaagggggctggagtgtcgtctttctttttatttatagtagtggtagtacatactcgcagaactccgtgagggccattcacatctccagagacaacttaccaaagaacacgtcttagtttctacaaatacgaacacgtccgtgagacgccgatggacacgggaccgtgttattacgtgtgcgtaagagagttcggggaccctaacggaacgttcacgtctagtcgggacgttcggacggggccgaaggggaacccg

SEQ ID NO: 380212 - DNA, 622 bp, Homo sapiens
  misc_feature: GZ8MTXP01AK70F.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgacgcgtgggtcccgccaggctccgaggggaaggggctgggagtgcgtcttcttttattatagtagtggtataccatactcgcagaactccggtggacggggcctatcaccatctacccgagagaacaattaccaaagaacacgtcttagttacttacaaatgaacagcctaggaacgacgacccgagtcgaaccgtacggtacccgttagttaacgttacgtgggtagaaccggtaaggacggtacgttaccgggggacccctaaacggttaacgttacgttaccgcgtaggtcggggaccggttcgggacgggggtaacccgaacgggggtaaccccg

SEQ ID NO: 380213 - DNA, 648 bp, Homo sapiens
  misc_feature: GZ8MTXP01COY5W.13.76.G10.1.454.CMB.2.raw
  modified_base (511)..(511): a, c, t, g, unknown or other
tcagtcacgtactacacgaccggtgctcgatttagtcactcatacaggggggagaggagcccagcactgggattccgaggtgtttccattcagtgatcagcactgaacacagaggactcaccatggagttgggactgagctggattttccttttggctattttaaaaggtgtccagtgtgaagtgcagctggtggagtcgtgggggagcttggtacagcctgggcaggtccctgagactctcctgtgcagcctctggattccacctttgatgattatgccatgcacgttcgggccgcaagccgtaccgaagggggaacggccgtgggaggttgggtctcgtaggttattggtaggaataggtggtagcaagtaagggctaagtgacggtactcgtggtaggaacggggcccgtatttccgaacctacgtcctaccgaacgacgaaaccgaaaccgaccgaaacgacccttccccgtagttacctcggtacgtaacctaaatacgaaaaccncggtaccgtggaaaggacgttcgagggacgaccgtaacggtcttaggttattagttacggtgaacgttaaaacgccttaaccccgtaaacccgtttaacgttaggttttggacggtttcggttaacgtaacccgggg

SEQ ID NO: 380214 - DNA, 547 bp, Homo sapiens
  misc_feature: GZ8MTXP01A1KZS.13.76.G10.1.454.CMB.2.raw
  modified_base (446)..(446): a, c, t, g, unknown or other
  modified_base (497)..(497): a, c, t, g, unknown or other
  modified_base (537)..(537): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagctgggtcccgccaggctccgagggggaaggggctgggagtgcgttcttcttttattatagtagtggtagtacatacctccgacagctccggtggacggggccgtattcacctatcctcagagacaattccaaagacacgctgtttctacaaatgaaacngcctagacgacgccgatcgaacgccggtccgtagtattcgtgtgcgagagngtcggggccccacggacgttaacacgctagtggacgtcgnggggaacccg

SEQ ID NO: 380215 - DNA, 688 bp, Homo sapiens
  misc_feature: GZ8MTXP01B8DU0.13.76.G10.1.454.CMB.2.raw
  modified_base (549)..(549): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagctgggtggagtctggaggaggcttgatccaggccgtgggggtccctgagactctcctgtgcagcctcgtgggtcaccgtcagtcacacctacatgagcgtcgggtccgcaggctccggaggggaggggctggagtcgtcgttctttctttttaatttagtagttagtggtaataccatactccgcacgaaccttcccgggtggacggggtcccgtacttccgaacctactcctacccaaggaacaaacctaacttaccgaaagaaccctacggtccttttagtttacctacaaagtcgaaacacggtctaggaacgaccgaccgtatcgaacgtccgggtaccgttagtaacttttacggnggtacggaacgggaaggttacgggtccgggttacccggggaaaccctaaccgggttaaaccgtttaccgaccgtaacggtaaggtccgggtaaccgggtccggggttaaccgggggaaccccggaaaccggggtccccg

SEQ ID NO: 380216 - DNA, 729 bp, Homo sapiens
  misc_feature: GZ8MTXP01A7EU0.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcacgcctcgtcgggttcaccgtcagtcacacctacatgagcgtcgggtcccgccgaggcctccggaggggaaggggcgtggagtggtcgtctttcttttatttatagtagtggtagtacctatactcgcagtaacctccggtgggacggggtccgtaacttccgacctactccgtacccaaggaacaacctaaattaccccgaaaaggaaacctacccggtttctttacgttttaacctaaactaaagttacgaaacgtacggtaccggtaagggaacggtaccgaccgaagtccggaacccggtaccgggtaccgttagttaaacgttacgtggtacggaacggaagggttacggtacgggttaccccggggaaccccgtaaacggttaaaccggttaccgttaccggtaacggttacggtaaccggggtacccgggtaccgggttaccgggggaaccccggttaaaccggggaaccccg

SEQ ID NO: 380217 - DNA, 583 bp, Homo sapiens
  misc_feature: GZ8MTXP01B1LIL.13.76.G10.1.454.CMB.2.raw
  modified_base (461)..(461): a, c, t, g, unknown or other
  modified_base (509)..(509): a, c, t, g, unknown or other
  modified_base (521)..(521): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtgggttcaccgtcagtccacaccctacatgagcgtgggtcccgccaggcctccggaaggggaaggggctgggagtgcgttcttcttttattagtagtagtggtagtacatactccgacagtctcggtggacggggccagttccactatcctccagagacaaacttacaaagacacgtcttagttacttacgaaatcgaaacngtcctaggacgacgccgaagttcgaaccgcgggtccttagtacttcgngtgacgtagagnggtacgggaccccttacggaaccgttaactacgctaggcggttacgtcgttcggggaacccg

SEQ ID NO: 380218 - DNA, 605 bp, Homo sapiens
  misc_feature: GZ8MTXP01A9RB4.13.76.G10.1.454.CMB.2.raw
  modified_base (249)..(249): a, c, t, g, unknown or other
  modified_base (502)..(502): a, c, t, g, unknown or other
  modified_base (520)..(520): a, c, t, g, unknown or other
tcagtcacgtactacacgaccggtgctcgatttagtcactcatacgaggggggagaggagcccagcactgggattccgaggtgtttccattcggtgatcagcactgaacacagaggactcaccatggtagttttggctgagcttgggttttccttgttgcttattttaaaaggtgcccagtgtgaggtgcagcgtggtggagtctggaggaggcttgatcagcgtgggggtcctgagactctctgtgcngcctcgtggttcacgtcagtcacacctacagtgagcgtcggtcccgcgaggcctccggaggggacgggcgtggagtcgtcgttctttactttttagttagttagttagtagtaagtacctagtaccgtccgacgacgaaccgttcggtggacggggtacctattaccactactctaccagacgaactactacaaagacacgtcttagttactacaaagtcgaacacgccgtagacgacgccgagtcgaaccgnggtacctgtactagtcgngaacgtagaggtacgttccggggaccaacggttaaacttcgaccgtgtacgtcggtacgcggttacgggaaccgaacgggtcccg

SEQ ID NO: 380219 - DNA, 577 bp, Homo sapiens
  misc_feature: GZ8MTXP01CK6SF.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtcgtggaggaggcttgatccagccgtgggggtccctgagactctcctgtgcagcctcgtgggttccaccgtcagtcacacctacatgagcgtcgggtccgccgaggctccggagggggaacgggctggagtgtcgtcttcttttattatagtagtgtagtacatacctcgacagctcgtggacgggccatcactactctaccagacgacaattacccaaagaaccacgtcttagtttacttaacaaattcgaaacacgtacctagacgacgaccgagtacgaaccgacgggtccgttagtattacgtgtgcggagaggacgtcggggacccacggttaaccgttaactacgctaggcggacgtcggcggggaacccg

SEQ ID NO: 380220 - DNA, 660 bp, Homo sapiens
  misc_feature: GZ8MTXP01DQ9OI.13.76.G10.1.454.CMB.2.raw
  modified_base (411)..(411): a, c, t, g, unknown or other
  modified_base (448)..(448): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctatttaaaaggtgcccagtgtgaggtgcagcgtggtggagtctggaggaggcttgatccagccgtgggggtccctgagactctcctgtgcagcctcgtggtcacgtcagtcacacctacatgagcgtcgggtccgcgaggcctccgagggaaggggcgtggagtgtcgtctttactttattagtagtagtgtacgtacatactcgacagtaaccgtcgtggacggggtcctacttacaccactcgtaccaganaacaagtaccaaagaacacgtcttagtttacctaaanaaagtcgaaacgacgtaccggtaaggacgacgaccgaagtacggaccggtaccggttaccgttagttacgttacgtcggacggaacggtaacggacggtaccgggttacccggggaaacccgtaaaccggttaaacggttccgttaacgtcgttaagggtcgggtaaccgggtcggggttaccggggaacccggttaacccggggtaacccg

SEQ ID NO: 380221 - DNA, 628 bp, Homo sapiens
  misc_feature: GZ8MTXP01B7C96.13.76.G10.1.454.CMB.2.raw
  modified_base (458)..(458): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtggttcaccgtcagtcacacctacatgagcgtcgggtcccgccgaggcctccgaggggaagggggctgggagtggcgttcttctttttatttatagttagtggtagtaccatactccgcagaacctccggtggacggggcctattccacctatctacagagacaacttccaaagaacacgcttagtttactacaaatcgaaacncgtccgtggagacgccgagtcgaccgacggtcccgtagttacttacgtcgtggaacggagacggtaggttaccgggggacccctaaccgggttaaacggtttaccgacggtcccgttaaggtcggggtaaccgttcgggttacgggggcccgaaacgggggtaacccccg

SEQ ID NO: 380222 - DNA, 598 bp, Homo sapiens
  misc_feature: GZ8MTXP01BI8PC.13.76.G10.1.454.CMB.2.raw
  modified_base (240)..(240): a, c, t, g, unknown or other
  modified_base (344)..(344): a, c, t, g, unknown or other
  modified_base (440)..(440): a, c, t, g, unknown or other
  modified_base (477)..(477): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcacgccgccctcagtgtcgtcggggccccagggcagaggtcaccatctcctgcacgtggggacncacggctaccaacgagttggggcacattatgatgtacacgtggaccagtctagtttccaggagcgacggtacccagtacctcctacatacaaataacgaacaanactccggacccgaacgacggggtcccagacccgtacttctcgtcggctccgagtctggccacctcaccgtcccctgtcactcgacgtcggctccgnggggcgtggagacgtgagtcgtagtatttacttcgtntacccgtgttcctagttcgacgttacgaccgtaacgttcccgttggttacgggttcggtccggtttcggggttaacggggttcccgggggacccggggggtcccaacgggttaaccccggg

SEQ ID NO: 380223 - DNA, 607 bp, Homo sapiens
  misc_feature: GZ8MTXP01CYBQC.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctatttaaaaggtgcccagtgtgaggtgcagctggtggagtctggaggaggcttgatccagccgtgggggtccctgagactctcctgtgcacgcctctgggttcaccgtcagtcacacctacatgagcgtgggtccgccgaggcctccgaagggggaaggggctgggagtgtcgtcttcttttattatagtagttggtatacatacctcgacagaacgtccgtgggacggggccgtatcaccatcctacgagagactaattccgaaagacacgtctagtttctacaaatcgaacgagtccctagacgacgtaccgagtacgacgcgggtacccgtgttacgttaacctggtcgacggagacggtaacggtccggggaaccccgacggttaaaccgtttaaccgtacggccttaagtcgggttaaccgtcggttcgggggtaaccccgg

SEQ ID NO: 380224 - DNA, 557 bp, Homo sapiens
  misc_feature: GZ8MTXP01BCTK6.13.76.G10.1.454.CMB.2.raw
  modified_base (365)..(365): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgccaggctccgagggaaggggctggagtgcgtctcttttattatagtagtcggtagtacatactccganagctccgtgaggggccattcacatctacagagacaatcaaagacacgctgttctacaaatgaacagcctgagacgccgtaagcgaccgaccggtcgttagtacgttcgtgtcgacggagagacggtccgggacccgttaacggttaaccgttaacgacgtcgtaggtcggttaccggtcggcggggaacccg

SEQ ID NO: 380225 - DNA, 580 bp, Homo sapiens
  misc_feature: GZ8MTXP01CKGWG.13.76.G10.1.454.CMB.2.raw
  modified_base (372)..(372): a, c, t, g, unknown or other
  modified_base (441)..(441): a, c, t, g, unknown or other
  modified_base (446)..(446): a, c, t, g, unknown or other
  modified_base (450)..(450): a, c, t, g, unknown or other
  modified_base (466)..(466): a, c, t, g, unknown or other
  modified_base (489)..(489): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgccagtgtgaggtgcagcgtggtggagtctggaggagcttgatcagcgtgggggtcctgagactctcctgtgcagcctcgtgggtcacgtcagtcacacctacatgagcgtcggtccgccgaggcctccggaggggaaggggcgtggagtgtcgttctttactttttagtttatagttaggtaggttagtaccatactccgnagccgtcgtggaggggccattccacactctaccagagacaattccaaagacacgtcttgttacctaaanaaagnaacngacgagagacgacgancgacgacggtctagtattcgtgnggaacgtaaggacgtacggaccgggaaccctaacgttaccgttcgacgtaacgtagtcggacgtcgggaccgggaaccgaacgggtaaccg

SEQ ID NO: 380226 - DNA, 541 bp, Homo sapiens
  misc_feature: GZ8MTXP01DJ4QM.13.76.G10.1.454.CMB.2.raw
  modified_base (364)..(364): a, c, t, g, unknown or other
  modified_base (375)..(375): a, c, t, g, unknown or other
  modified_base (388)..(389): a, c, t, g, unknown or other
  modified_base (391)..(391): a, c, t, g, unknown or other
  modified_base (396)..(396): a, c, t, g, unknown or other
  modified_base (408)..(408): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtgggttcaccgtcagtcacacctacatgagcgtcggtccgccaggctccggagggaaggggcgtggagtgtcgttctttcttttattatagtagtggtagtcgcatcncgcaagctcgngagggccatcacnncncaganacatacaagacncgtcttgttctacaaatgaacaggcctagagacgccgatcgacgacggtcgtgtacttctggtgcgagcggagtccggggacccaacggttacgttaccaagctaagtcggacgttcgtggggcccgaacggg

SEQ ID NO: 380227 - DNA, 621 bp, Homo sapiens
  misc_feature: GZ8MTXP01DKOOL.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtgggtccgccaggcctccgagggaaggggctggagtgcgtcttcttttattatagtagtggtataccatactcgcagaacctccgtggacgggcgattcaccatctccagagacaacttccaagaaccacgtcttgtttctacaaatgaaacacgaccgtggagacgcccgagtcgacgaccgggtaccgttggttaatttaccgtggtcgaacggaaggacggacggttccggggggaacccccaacgggttaaaccgtttccgttaaaccggtcttaaggtcgggtaacggtccgggttacgggggtaaccccgaaacgggggtaacccccg

SEQ ID NO: 380228 - DNA, 595 bp, Homo sapiens
  misc_feature: GZ8MTXP01EDRLP.13.76.G10.1.454.CMB.2.raw
  modified_base (172)..(172): a, c, t, g, unknown or other
  modified_base (215)..(215): a, c, t, g, unknown or other
  modified_base (295)..(295): a, c, t, g, unknown or other
  modified_base (308)..(308): a, c, t, g, unknown or other
  modified_base (330)..(330): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctnagtgtcccgtgtccccaggacagacagccagcatcacctgctntaggaaataatggcagataaatatacttctggtatcagcagaagtcaaggccagtcccctgtgcctggtcatcatcaagntgccaagcgcctnagggatccccctgagcgattcncctggctcaactcgtagggaactcacgccacgtctggacccatcgagccgggaccccagggccttagcggataggacggtctacggtaaccttattaacgttcgtaaccgggtgggtacggtagggaccgtaggacgaacgcccgtaaccgtccgttacccgttacgttacgttcggttaccggttaaccgggttaccgggttaaccggggtaacccgtaacggtcccgtacccgtaccgttaacgtaaccgaacccgaaccccg

SEQ ID NO: 380229 - DNA, 575 bp, Homo sapiens
  misc_feature: GZ8MTXP01AHOLD.13.76.G10.1.454.CMB.2.raw
  modified_base (435)..(435): a, c, t, g, unknown or other
  modified_base (507)..(507): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataatggacagataaatatactctgtatcagcagagtcaggccagtcccctgtgctggtcatctatacaagtatcgacctaacggccggcccctaggacgggtacctccccccgtaggacgtcgtacttcgtaccgtcgggccttacctaaacgtcgtacgggaacctcgacgtcccactctcgaccatccgacggaccgggacccaggtacgtagngatggacggtctacgtaacttagttacgtcggtcgacgggtcggtacggactgacacgcaacgtcgaccgtnttacgtcgttcgttcgggacgttcggaaccgacggtccgaccgtcgttaacgtccgaaccgaaccccg

SEQ ID NO: 380230 - DNA, 706 bp, Homo sapiens
  misc_feature: GZ8MTXP01C2RV9.13.76.G10.1.454.CMB.2.raw
  modified_base (237)..(237): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccgagccgtgggggtcccngagactctcctgtgcacgtcctcgtcgggttcaccgtcagtcacacctacatgagcgtcggtcccgcgaggctccggaggggaggggctgggagtcgtcgttctttacttttatttagtaggttaggtaggttaacgtactacgttaccctacccgaaaccgtaacgtcccgttccgggtacggggacgggggtacccgtacgtttacccaaccctacttcccgttacccgaaaggtaaccgaaacctaaaccgttaacccgaaaagtaaccctaccgttctttacgtttacttaacaaaagttcgaaacgacgtccgtaggacgaacggcccgaagtcgaaccgtaccgggtccgttagtaacttacggtggtcggacggaagacggtacgggtcggggaaccccgttaaggttaaaccgtttaaccgacgtcgttaggcgggttaccgttcgggcggggaaacccgg

SEQ ID NO: 380231 - DNA, 577 bp, Homo sapiens
  misc_feature: GZ8MTXP01EZ3AA.13.76.G10.1.454.CMB.2.raw
  modified_base (411)..(411): a, c, t, g, unknown or other
  modified_base (442)..(442): a, c, t, g, unknown or other
  modified_base (452)..(452): a, c, t, g, unknown or other
  modified_base (492)..(492): a, c, t, g, unknown or other
  modified_base (505)..(505): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctctgggttcaccgtcagtcacacctacatgagcgtgggtcccgccaggcctccggaggggaagggggctgggagtgcgttctttctttttattatagtagtggtagtaccatactccgcagaacctcgtggacggggccattccaccatctaccaganaacaataccaaagaacacgtcttgtttctanaaatgaaacngccgtgaagacgccgatcgaacgcggccgtagtattacgngtggcgtagaggngttcggggaccccaaggttaaccgttcacgctagtcggacggtcggacgggggaacccgaacggggaacccg

SEQ ID NO: 380232 - DNA, 636 bp, Homo sapiens
  misc_feature: GZ8MTXP01BY1KQ.13.76.G10.1.454.CMB.2.raw
  modified_base (256)..(256): a, c, t, g, unknown or other
  modified_base (610)..(610): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagcttgggttttccttgttgcttattttaaaaggtgccagtgtgaggtgcagcgtggtggagtcgtggaggaggcttgatccgagtccgtgggggtccctgagactctctgtgcncgcctcgtcggtcaccgtcagcacacctacatgagcgtcggtccgccgacggccgtaccggagggggaaggggtcgtgggtagtcgtcgtttcctttagtttttaagtttaagtaggttaggttacggttaagtactaacgtacctcccgaacaacgtccgtccggtagggacggggaccctaagttcccaactactaccctaccaagaacgactaaacttacccgaaaagactacggtcttacgtttactaacaaaagtcgaaacgacgtccgaagacgacgcgtatcgaaccgtacgggtcctagtactgtggtgcgaagcgacggtcgggacccttacgttaacgtcacgntacgtcggaccgtcggcgggaacccg

SEQ ID NO: 380233 - DNA, 669 bp, Homo sapiens
  misc_feature: GZ8MTXP01BCNMN.13.76.G10.1.454.CMB.2.raw
  modified_base (554)..(554): a, c, t, g, unknown or other
  modified_base (618)..(618): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccgagccgtgggggtcctgagactctcctgtgcagcctcgtgggttcaccgtcacgtcacacctacatgagcgtcgggtcccgccgaggctccgaggggaggggctggagtgtcgtctttcttttattatagtagtgtagtacctatactccgcacgtaacctccggtggacggggccgtattaccacctactctacccgaagaacgaacctaaacttaccgaaaacgaaacgtaccgtactttgtttaaccttacaaaagttcgaaacgcggtaccttaggaacgtacggacccgaagtccggaaccgaccgggtcccgtttagttaaacttacggnggttcggcgtaaagggacggtacggttccgggggaaccctaacgggttaaacgtttccacggtntaaacgtcggggtacccgtcggaccgggggaacccgaacggggtaaccccg

SEQ ID NO: 380234 - DNA, 562 bp, Homo sapiens
  misc_feature: GZ8MTXP01AT6QA.13.76.G10.1.454.CMB.2.raw
  modified_base (525)..(525): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgcaggctccgagggaggggctggagtgcgtctcttttattatagtagtggtagtacatactccgcagaactccgtgaggggcccgattccaccatcctccagacgacaattccaaagaacacgcttgttacttacaaatgaactagacctgaagacgccgaatcgaaccgcggtacccgtgtaattactggtgcggaagacgagttcggggcccaacggttacgttcttacgntagtcggacgtcggttacggggccgttaaggggcccg

SEQ ID NO: 380235 - DNA, 624 bp, Homo sapiens
  misc_feature: GZ8MTXP01AXEIU.13.76.G10.1.454.CMB.2.raw
  modified_base (170)..(170): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtcgtccgtcgtccccaggacagacagccagcatcacctgctactaggaaataattggacaagtataaatatacttcctaggtatcagacagaagtcaggccagtcccctgcgctggtcatctatacgaagatcgccaacggccggccctacgacggtactcccccgtaggacgcgtattctacgtcggcctaccctaaactcggtacgggaacctcgacgtcccactctacggacctacgtccgacggaccgggacccgaggtaccgtaaggttcgggatacgggagggtactacggtactttaagttaccgtggtccgaagggtcgggtacgggacgtacgccgaacgccgtaacgtccggcccgtacgttacgtcggtaccggttacgggacggttaccgggtaacccaaggtcccgtaccgtaccgttaacgtcccgaacggaaccccg

SEQ ID NO: 380236 - DNA, 677 bp, Homo sapiens
  misc_feature: GZ8MTXP01BVTYM.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggtcacgtcagtcacacctacatgagcgtcgggtccgccaggcctccgaggggaggggctggagtgcgttcttcttttatttatagtagtggtagtaccatactccgcagaactccgtggacggggccgtattccacctatcctccgaagacgaacctaaattcccgaaaagaaccctacggtctttagttttacccttaaacaaaacgttcgaaacgtacggtccggtaaggaacggtaccgaccggtaagtccggaaccgtaccgggtccgtttagttaacgtttacggtgggtcggaacggtaaggacggtacgggttacccggggtaacccctaaacgggttaaccgttacgaccggtaacttacgggtcgggtaccggtccgggttacgggggaaccccgttaaacgggggtcccc

SEQ ID NO: 380237 - DNA, 573 bp, Homo sapiens
  misc_feature: GZ8MTXP01EO5PH.13.76.G10.1.454.CMB.2.raw
  modified_base (433)..(433): a, c, t, g, unknown or other
  modified_base (444)..(444): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtcccagagactctcctgtgcagcctctgggttcaccgtcagtcacacctacatgagcgtgggtcccgccaggctccgaggggaaggggctgggagtgcgtcttcttttattatagtagtggtagtacatactccgacagctcgtggaggggcctattcacatctaccagagacaattccaaagaaccacgtctgttacttanaaatgaaacgngtcctgagagccgatcgaacgacggtccgtagttacttactggtgacgaggttagacggttcggggacccgaacggttaaccgttaacacggtccttaggtgggttaccgtcgggttcggggaacccgg

SEQ ID NO: 380238 - DNA, 579 bp, Homo sapiens
  misc_feature: GZ8MTXP01AZPP5.13.76.G10.1.454.CMB.2.raw
  modified_base (298)..(298): a, c, t, g, unknown or other
  modified_base (478)..(478): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcacgccaccctcagtcgtccgtcgtccccaggacagacagccagcatcacctgctctagaaataatggacagataaatatactctggtatcagcagaagtcacggccacgtcccctgtcgcgtggtcatctatacaagntcgaccaaggccggcctacgagggctcccccgtgacgtcgtattctcgtcggtcctaccgaactcgtacgggaactcgacgccactctacgaccagtcgacggccgggaacccgaggacctagtcggatggacggtcgtacggtacttagttaccgtggtaccgagggtcgtaggggacnggacacgccaacgtcgcccgtcttacgtcgtcggttacgggaccgttcggggaaccctacgggtccgacccggttaccgttacgtccgaaccgaaccccgg

SEQ ID NO: 380239 - DNA, 739 bp, Homo sapiens
  misc_feature: GZ8MTXP01CMYG7.13.76.G10.1.454.CMB.2.raw
  modified_base (284)..(284): a, c, t, g, unknown or other
  modified_base (624)..(624): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagcgtggtggagtctggaggaggcttgatccagccgtgggggtccctgacgactctcctgtgcacgcctcgtcggtcaccgtcacgtcacacctanatgacgcgtcgggtcccgcgacggccgtaccggaggggaacgggggcgtagggtacgtcggtccgtttcttttacgtttttaagttttaagttaaggttaaggttgggttaacgttaaccgtaacttaccgtcccggaccgtaacggtaaacccggttccggtcggggacgggggtaccccgttacttacccaccctaacttcccctacccgaaagaacgtaaacctaacttacccgaaaacggaacctacgtctttagtttaacctaacgaaagtacgaaacacggtcgtacggaagccgaccgagtaccgaaccgcggttaccttagttactttacgnggtcgggaactaagggcggtacgggttcccggggaaacccctaaggttaaccgtttcacggtaacgtacgtaacgggtccgacgggttcggggaaccgttaacggggtaaccccg

SEQ ID NO: 380240 - DNA, 617 bp, Homo sapiens
  misc_feature: GZ8MTXP01CEAHJ.13.76.G10.1.454.CMB.2.raw
  modified_base (370)..(370): a, c, t, g, unknown or other
  modified_base (443)..(443): a, c, t, g, unknown or other
  modified_base (452)..(452): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctctgggttcaccgtcagtcacacctacatgagcgtcgggtcccgccaggcctccggaggggaaggggctgggagtcgcgttctttcttttatttagtagtagtggtagtaccatacncgcagaactccggtggacggggccgattcaccatctccagagacaatccaaagacacgtcttagtttcctaanaatcgaacngcgagacgcgacgagtcgaccgtcggtcgttagttacttcgtggtcggaacggtaaggacgggtacgggttacccggggaacccctaacggttaaccgttcgacggtccgtacgtaacgggtccgggtaccgggttccgggtaaccgggggaacccgtaacgggg

SEQ ID NO: 380241 - DNA, 568 bp, Homo sapiens
  misc_feature: GZ8MTXP01A59CN.13.76.G10.1.454.CMB.2.raw
  modified_base (494)..(494): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataaattggcagataaatatacttctggtatcagcagagtcaggccagtcccctgtgctggtcatctatcaagatgaccaagccggccctgagggactccccctgagcgtattctcgtcggcctaccaaacgttccgtacggggaacctcgaacgtccctacgtctacgaccagtccgaacggccgggacccaggtcctagtgggaatggacggcgtgtaacttacgttacgtcgtcgaggtcggtaggggacaggcacggctaacgtcgcccgtnttcgtcggttccgttacggaccgttcgggaacccagggtccaacccggtccgttaacgtccgaacgtaaccccg

SEQ ID NO: 380242 - DNA, 544 bp, Homo sapiens
  misc_feature: GZ8MTXP01CXPNJ.13.76.G10.1.454.CMB.2.raw
  modified_base (357)..(357): a, c, t, g, unknown or other
  modified_base (367)..(367): a, c, t, g, unknown or other
  modified_base (374)..(374): a, c, t, g, unknown or other
  modified_base (386)..(386): a, c, t, g, unknown or other
  modified_base (396)..(396): a, c, t, g, unknown or other
  modified_base (406)..(406): a, c, t, g, unknown or other
  modified_base (409)..(409): a, c, t, g, unknown or other
  modified_base (436)..(436): a, c, t, g, unknown or other
  modified_base (462)..(462): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcgtggtttcgtgtaggctattttaaaaggtgcccagtgtgaggtgcagctggtggagtctggaggaggcttgatccagcctggggggtccctgagactctcctgtgcagctctggtcaccgtcagtcacacctacatgagctggtccgccaggctccgagggaaggggcgtggagtgcgtcttcttttatttattagtagtgtagtacatactcgcngaactcgtgngggcggntctacatctcanagacatacanaacaacgctnttntctaatagacagccgtgagagccgagngacgacggccgtcgtgttaatgttgngagaggaacgttgggaccgacgttacgttacgttacgccgtaagtgggtacgtcggttcgggtccggaacgggtaacccggg

SEQ ID NO: 380243 - DNA, 593 bp, Homo sapiens
  misc_feature: GZ8MTXP01EGMSG.13.76.G10.1.454.CMB.2.raw
  modified_base (352)..(352): a, c, t, g, unknown or other
  modified_base (367)..(367): a, c, t, g, unknown or other
  modified_base (419)..(419): a, c, t, g, unknown or other
tcagtcacgtactacacgaccggtgctcgatttagtcactcatacagggggcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggtcaccgtcagtcacacctacatgagctgggtccgcaggctcgaggggaagggctggagtgcgtcttctttttattagtagtgtgtagtacatactccccgnagactcgtgagggcntcacatctccagagacaagttaccaaagaacacgtcttagtttaccttaaanaaatacgaaacacgtactagacgacggacgagtacgaccgacggtcgttattacttacgtgtcgacgagaggtaacggtaccgggaccctaaacgttaaaccgttacgacgttagttacggttacggtaacggtcggaacgggacccgaacgggacccgtccggttccctcccg

SEQ ID NO: 380244 - DNA, 702 bp, Homo sapiens
  misc_feature: GZ8MTXP01CUEJG.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtcgggttcaccgtcagtcacacctacatgagcgtcgggtcccgcgaggccgtccggaggggaacggggctggagtcgtcgtttctttctttagtttagtagttaggtaggtagtaccactactccgacacgtaccgtccggtggacggggtccgtattccgacctactcctacccgaagaacgtaaacctaacgttacccaaaaggtaaaccctcgttccgtttaggtttacccttaacgaaaattcggaaacacggtcccgtaaggaacggaacgcccggtaaatacggaaacccggtcgggtaccgtttgtaaacgtttccggcgggtacggaacggtaagggacgggtaccgggttacccgggaaccctaaacggttaccgttcgaccggtcgtagggtccgggtaccggtacgggaccggggtaacccgaacgggtaacccg

SEQ ID NO: 380245 - DNA, 581 bp, Homo sapiens
  misc_feature: GZ8MTXP01AIJPI.13.76.G10.1.454.CMB.2.raw
  modified_base (437)..(437): a, c, t, g, unknown or other
tcagtcacgtactacacgaccggtgctcgatttagtcactcatacaggggggagaggagcccagcactgggattccgaggtgtttccattcggtgatcagcactgaaaacagaggactcaccatggagttttggctgagctgggttttccttgttgctattttaaaggtgcccagtgtgaggtgcagctggtggagtctggaggaggcttgatccagccgtggggggtccctgagactctcctgtgcagcctctgggttcaccgtcagtcacaccacatgagcgtgggtcccgccgaggctccgagggggaagggcgtggagtgcgtcttcttttattatagtagtggtagtacactactcgcagactccgtgcggggccattcaccatctcagagacaattccaaagacacgcttgtttactacaaattcgaaacngcctaggggagacgccgaatggaaccgcggccgttagtacttaccgtggtgcggtaagagcggtcgggggacccctaaggtaaaccgttcgacggctaagcgggtaacgttcggagggggacccaaagggggcccctaaccggg

SEQ ID NO: 380246 - DNA, 592 bp, Homo sapiens
  misc_feature: GZ8MTXP01DQBPY.13.76.G10.1.454.CMB.2.raw
  modified_base (371)..(371): a, c, t, g, unknown or other
  modified_base (376)..(376): a, c, t, g, unknown or other
  modified_base (448)..(448): a, c, t, g, unknown or other
  modified_base (468)..(468): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagcgtgggttttccttgttgctattttaaaaggtgccagtgtgaggtgcagctggtggagtctggaggaggcttgatccgagccgtgggggtcctgagactctcctgtgcacgcctcgtgggttccaccgtcagtccacacctacatgagcgtgggtcccgccgaggcctccggagggggaacggggcgtgggagtgtcgttcttacttttattagtagtagtgtagtanatacnccgacacgtcgtcggtggacgggccattcactatctacagacgactaattcaaagaacacgtcttgttacanaaatcgaacagcctagacgnccggatcgaacgcggtacgtgtacttacgtgtcgacggagttaacgcggtccggggacccttaacggttaaccgttaacgtaaccgcgtttaaggcgggttaccgtcggttcgggggaaacccg

SEQ ID NO: 380247 - DNA, 625 bp, Homo sapiens
  misc_feature: GZ8MTXP01CV95F.13.76.G10.1.454.CMB.2.raw
  modified_base (403)..(403): a, c, t, g, unknown or other
  modified_base (408)..(408): a, c, t, g, unknown or other
  modified_base (445)..(445): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtcgggtcccgccgaggcctccggaggggaagggggcgtgggagtgcgttctttcttttattatagtagtggtagtaccatactcgacagaacctcgtggacggggccatcacatcncaganacaatccaagacacgtcttgttctacaaatcgaaacncgccgtaggacgtacgaccggtatcggaaccgtacgggtcccgttagttaactttaccggtggttcggaacgtaaggacggtacggttccgggggaaccccaacggttaaaccgtttacgacgtcgttaaggtcgggtaaccggttcggttacgggggaacccgaacgggggtaaccccg

SEQ ID NO: 380248 - DNA, 590 bp, Homo sapiens
  misc_feature: GZ8MTXP01AUSPJ.13.76.G10.1.454.CMB.2.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctagaaataatggcaagataaatatacttcctggtatcagcagaagtcaggccacgtcccctgtcgctggtcatctatacaagatcgccaagccgcctcgacggctcccccgtgagcgtacttctcgtcggctacctaacgtcgtacgggaacacacgaccctactcgtacgacactcgacggaccgggacccgaggtccgtggtaggagttggaacggtcgttacgtaacgttaagtttaccgtggttaccgagggtcggtacgggacaacggcgtacggccaacgtcgttccgtaccgttacggaacggtcgggaaccgaacggttccgtaaccgtccgtaacggtaccgaccgacccgaaccggccctaaaccccg

SEQ ID NO: 380249 - DNA, 556 bp, Homo sapiens
  misc_feature: GZ8MTXP01C60I9.13.76.G10.1.454.CMB.2.raw
  modified_base (291)..(291): a, c, t, g, unknown or other
  modified_base (415)..(415): a, c, t, g, unknown or other
  modified_base (418)..(418): a, c, t, g, unknown or other
  modified_base (424)..(424): a, c, t, g, unknown or other
  modified_base (432)..(432): a, c, t, g, unknown or other
  modified_base (479)..(479): a, c, t, g, unknown or other
  modified_base (482)..(482): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcgtggtttcctgttagctatttaaaaggtgcccagtgtgaggtgcagctggtggagtctggaggaggcttgatccagcctggggggtccctgagactctcctgtgcagcctctgggttcaccgtcagtcacacctacatgagctgggtcccncaggctccgaggggagggggctggatgcgttctttcttttatttatagtagtggtagtaccatactcgcagaacctcgtgaggggccattcaccatcgtcagagacaagtccaaagacacgttnttnttacanaatcaacncgacgtagacgacgaccgtatcggaccgtacggtcttgttatcgtgnggngagagacgcggaccgtacgttacgttacgttacgtcgtagtcggcggtcggttacgggtaacggaacggaaccg

SEQ ID NO: 380250 - DNA, 632 bp, Homo sapiens
  misc_feature: GZ8MTXP01EEY92.13.76.G10.1.454.CMB.2.raw
  modified_base (490)..(490): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatccagccgtgggggtccctgagactctcctgtgcagcctcgtgggttcaccgtcagtcacacctacatgagcgtgggtccgccaggcctccggaggggaagggggctgggagtggtcgttctttacttttatttattagtagtggtagtaccatactccgcacgaactccgtggacgggccattccaccatctaccagacgaacaactaccaaagactaccgtctttagtttacctacaaaatcgaaacaggcctaggagacgccgatcggacncggcttagtattacgtggtgcggtaagcggtacggttcgggggaacccccaaacggttaaaccggtttccttaaccggtcttaaggtcggggtaacccggttcgggttacggggggaaccccgaaacggggggtaacccccg

SEQ ID NO: 380251 - DNA, 561 bp, Homo sapiens
  misc_feature: GZ8MTXP01DOGLO.13.76.G10.1.454.CMB.2.raw
  modified_base (442)..(442): a, c, t, g, unknown or other
  modified_base (479)..(479): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggtcaccgtcagtcacacctacatgagcgtcgggtccgccgaggctccgagggaggggctggagtgcgttcttcttttatttatagtagtgtagtaccatactcgcagaactcgtggagggccgtatcaccatctccagagaactaactaccaaagaacacgtctttcgtttactacaaatgaaacncgcgtgagacgccgatcgacgacggtctgtattacgngtgaacgagagtacggttcggggacccaggttaacgttcacgctaagcgggtacgtcggttcggggcccgaaggggaacccg

SEQ ID NO: 380252 - DNA, 663 bp, Homo sapiens
  misc_feature: GZ8MTXP01DT8N3.13.76.G10.1.454.CMB.2.raw
  modified_base (461)..(461): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgcttattttaaaaggtgcccagtgtgaggtgcagcgtggtggagtcgtggaggaggcttgactccgagccgtgggggtccctgagactctcctgtgcacgtcctcgttcgggtccaccgtcacgtcacacctacatgagcgtcgggtcccgcgaggccgtaccggaggggaagggggcgtggagtcgtcgttctttacttttattatagtagtggtagtacatactcgcacgaactcgtgggacgggcctatccacctactctacagacaactaataccaaagaaccacgtcttgttttaccaaanaaagtcgaaactcgacggtagacgacgacgagtacgaccggtacggtacgttagttaacgttacggtggacggaacggtaaacggacgggtaccgggttacccggggaaacccctaaacgggttaaaccgttaccttaccggtaacgtaaggtccggggtaccggtacggggttaccggggtaacccgaaacggggtccccg

SEQ ID NO: 380253 - DNA, 580 bp, Homo sapiens
  misc_feature: GZ8MTXP01B8IDI.13.76.G10.1.454.CMB.2.raw
  modified_base (433)..(433): a, c, t, g, unknown or other
  modified_base (443)..(443): a, c, t, g, unknown or other
  modified_base (499)..(499): a, c, t, g, unknown or other
  modified_base (534)..(534): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtgggtccgtcgaggctccgaggggaaggggcgtggagtgtcgtctttcttttattatagtagtggtatacatactcgcagactcgtggacgggccgtattcaccatctaccagacgactaatccaagaaccacgtcttgtttactanaaatgaaacngccgtgagtaccgccgatcgaaccgacgggtccgttagtattacgtggtgcgaagnggagttccggggaccctaacggacgtttcaccgtntaggtcgggtaccgtggttcgggggaacccttaacggggaaccccg

SEQ ID NO: 380254 - DNA, 582 bp, Homo sapiens
  misc_feature: GZ8MTXP01AUS39.13.76.G10.1.454.CMB.2.raw
  modified_base (402)..(402): a, c, t, g, unknown or other
  modified_base (483)..(483): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctcgtgggttcaccgtcagtcacacctacatgagctgggtccgcaggctccgaggggaaggggctgggagtgcgtcttcttttatttatagtagtggtagtaccatactcgcagactccgtgagggccgatcacatctcagagacatccaanacacgcttgtttctacaaatcgaacagccgtggagacgtccgatcgacgacggtccgttagtacttacgtggtgcggaagnggacggttccgggggacccctaacggttaaccgtttcttacggtccttaaggtcggggtaccgtcggttacgggggaacccaaacggggggtaaccccg

SEQ ID NO: 380255 - DNA, 618 bp, Homo sapiens
  misc_feature: GZ8MTXP01EE4TQ.13.76.G10.1.454.CMB.2.raw
  modified_base (375)..(375): a, c, t, g, unknown or other
  modified_base (410)..(410): a, c, t, g, unknown or other
  modified_base (469)..(469): a, c, t, g, unknown or other
  modified_base (492)..(492): a, c, t, g, unknown or other
  modified_base (517)..(517): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctatttaaaggtgccagtgtgaggtgcagctggtggagtcgtggaggaggcttgatccagccgtgggggtccctgagactctcctgtgcagcctcgtgggttcaccgtcagtcacacctacatgagcgtcgggtccgccgaggccgtccggaagggggaagggggcgtgggagtggtcgttctttacttttattagttagtagtggtagtaccatacnccgcagaacctcggtggacggggcctattcacctntctaccagacaactaataccaaagaactacgtctttagtttacctaacaaatcgaaacncgaccgtaggacgacgaccgtancgacgaccgggtctagtacttacgnggtgaacgaggacggacggttcggggacccctaacggttaaccgttcacgtcgtagtcgggtaacgtcgggttacgggggaacccgaacggggtaaccccg

SEQ ID NO: 380256 - DNA, 625 bp, Homo sapiens
  misc_feature: GZ8MTXP01BKVAS.13.76.G10.1.454.CMB.2.raw
  modified_base (252)..(252): a, c, t, g, unknown or other
  modified_base (339)..(339): a, c, t, g, unknown or other
  modified_base (387)..(387): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgcttaattttaaaaggtgcccagtgtgaggtgcagctggtggagtcgtggaggaggcttgatccagccgtgggggtccctgagactctcctgtgcngcctcgtggtcaccgtcagtcacacctacatgagcgtcgggtcccgcgaggcgtccggaggggagggcgtggagtcgtcgttctttntttttattagtagtagtggtagtaccatacgtccgcagaaccgtcggnggacggggccgacttccacctatctaccagtagaacctaaactccaaagacacgtctttgttactaacaaaagtgaaacctagccgtagaacggacgccgaagtccgacgccggtcgttagttaacttcgagtgcggtaagaggtacgttccggggaacccctaacggttaaaccgtttcaccgtcgttaggtaacgggccggttcgggaccgggggaacccgaacggggtaaccccg

SEQ ID NO: 380257 - DNA, 673 bp, Homo sapiens
  misc_feature: GZ8MTXP01D0DLM.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggtatttttggctgagcgttgggttttccttgttgctattttaaaaggtgccagtgtgaggtgcagcgtggtggagtcgtggaggaggcttgatccagccgtgggggtccctgagactctcctgtcgcagcctcgtgggttcaccgtcacgtcacacctacatgagcgtcggtcccgccgaggccgtaccggaggggaggggcgtagggagtgtcgtttctttactttttaagtttagttaggttaggttaggtaacgtaacccattaccgtccgctacggtaaccctccgggtgggacggggtcctaactttcccaacctagttcctaccgaagaacaactaaactaccaaagaaacctacgtctttagtttactaacaaatacgaacacgaccgtagaacgacgccgtaagtcgaaccgacgggtaccgttagtaacgtttacgtggtcgaacggtagaacgggtcggttaccgggggaccctaaacggttaacgttcgacgtcgtaggtcgggacggtcggacggggtaaccgaacgggaaccccg

SEQ ID NO: 380258 - DNA, 692 bp, Homo sapiens
  misc_feature: GZ8MTXP01AMCDI.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtcgtggaggaggcttgatccagccgtgggggtccctgagacctctcctgtgcagcctcgtgggttcaccgtcagtcaccacctacatggacgcgtcgggtccccgccgacggcctccggagggggaaggggcgtgggagttcgcgtttctttctttttatttagtagtaggtaggtacgtaccactactccgacgagtaaccgtcccggtgggacgggggtccctacgttccaaccgtactcctacccgaagaacgtaaacctaaacgttacccgaaagtaacccgaccggttctttacgttttaaccttaaccaaaagttcgaaaccgtacgtaccggtagaaggtaccgacccgtaagtcgaaccgtaccgggtccttagttacttacgtggtaggcgaaggttacggacggttaccggggaccctaaacggttaccgttaacttacgcttagaacgggtacgtcggacgggaaccgaacggggtaaccccg

SEQ ID NO: 380259 - DNA, 712 bp, Homo sapiens
  misc_feature: GZ8MTXP01BOJPA.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggtcaccgtcagtcacacctacatgagcgtgggtcccgccaggcctccgaggggaaggggctggagtgcgtcttctttttattatagtagtggtagtaccatactccgcagaactccggtggacgggggcccgtattccgacctactcctacccgaagacgaacctaaattcccaaaaggaacctaaccggtctttacgttttaccttacaaaattcggaaacacggtccgtaggaaggacgacccgaagtcgaaccgtaccgggtacccggtttagttaacgtttaaccgtgggttcgggaaccggtaaaggaacggggtaacggttccggggggaaacccccctaacggggttaaaacccggtttaccgttaaacccgggtcttaaacgggttccggggaaccgggtttcccgggttacggggggtaaccccgttaaacgggggtaacccccggg

SEQ ID NO: 380260 - DNA, 620 bp, Homo sapiens
  misc_feature: GZ8MTXP01A0APT.13.76.G10.1.454.CMB.2.raw
  modified_base (304)..(304): a, c, t, g, unknown or other
  modified_base (474)..(474): a, c, t, g, unknown or other
  modified_base (536)..(536): a, c, t, g, unknown or other
  modified_base (561)..(561): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgcttaattttaaaaggtgcccagtgtgaggtgcagcgtggtggagtcgtggaggtaggtttgatccaggccgtgggggtccctgagactctcctgtgcagtcctcgtgggttccaccgtcagtcacacctacatgagcgtcgggtccnccgaggcctaccggagggggagggctgggagtgtcgttctttcgtttttattagtagtagtaggtacgtaactactacctcgacacgaccgtccggtgggcgggggcctacttccaccatctaccaggacaactaacttacgaaaacgtaaacgtctttagtttcttaanaaatgaacacgcgtagaggacgccgaagtcgacgtacggtcgtagtacttcgtgtcgcgagngtggcgggacccaggtaaccgttanacggttcttaggtcgggtactcgggtcggggacccgacgggaacccgttcgggtaaccc

SEQ ID NO: 380261 - DNA, 630 bp, Homo sapiens
  misc_feature: GZ8MTXP01BFSDT.13.76.G10.1.454.CMB.2.raw
  modified_base (276)..(276): a, c, t, g, unknown or other
  modified_base (309)..(309): a, c, t, g, unknown or other
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctgaaataaattggcagataaatatacttctggtatcagcagaagtcaggccagtcccctgngctggtcatctatcaagatgccaagcggccctnacgggactcccctgagcgattctctggctccgaaactcgtaggggaactcacgcccactctacgacccaatccgaacggccggggaccccagggcctagtgggaattcgggaagggggtcctagggtaaccttaactttaacgtcggttccgaaggggtccggttagggggaccaaggccgaaagcccgtaacgttcggacccccggattaaacgtcgggttaccgtttccggggaaaaccgtttaaccggggggtaaaccccaaaagggggtttccccaaacccgggtttacccgtaaaacgggttccctaaaccccggg

SEQ ID NO: 380262 - DNA, 698 bp, Homo sapiens
  misc_feature: GZ8MTXP01CY1KX.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaggtgcccagtgtgaggtgcagcgtggtggagtcgtggaggaggcttgatccagccgtgggggtcctgagactctcctgtgcagcctctgggtcaccgtcagtcacacctacatgagcgtcggtccgccaggcctaccggaggggaacggggcgtgggagtcgcgttctttcgtttatttagtagtagtgtagtacctatactcgcagaacctccgtggacggggccgtaattcaacctactcctacccgaagtacaactaaacttaccaaagaacctacgtctttgtttaccttaacaaaagttcgaaactacgtcccggtaggaacggacgacccgagtacggaacccgtacgggtacccggttagttaaacgttccgtcgggtggaacccggtaagggaacgggtacggttccgggggaaccccccgtaaaggttaaaccccggttttacgaccggtaacccgttaaggtcccgggggtaccggtttaccggacggggggtaacccccgaaaagggggtaaccccccggg

SEQ ID NO: 380263 - DNA, 551 bp, Homo sapiens
  misc_feature: GZ8MTXP01CSTXH.13.76.G10.1.454.CMB.2.raw
  modified_base (288)..(288): a, c, t, g, unknown or other
  modified_base (373)..(373): a, c, t, g, unknown or other
  modified_base (396)..(396): a, c, t, g, unknown or other
  modified_base (441)..(441): a, c, t, g, unknown or other
  modified_base (452)..(452): a, c, t, g, unknown or other
  modified_base (479)..(479): a, c, t, g, unknown or other
  modified_base (481)..(482): a, c, t, g, unknown or other
  modified_base (486)..(486): a, c, t, g, unknown or other
  modified_base (515)..(515): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatcagcctggagggtccctgagactctcctgtgcagcctctgggtcacgtcagtcacactacatgagctggtccncaggctccgaggggacgggctggagtgcgttcttacttttattagtagtagtggtacgtacatacctccgacaacgacttccggnggacggggcctatccactatccncagacacaattccaaagacacgtctgtttactacaaatcgaaacncggactagganacgcatcgacacgggctagtattacgngnngagngcgtacggcccaaggttacttacaacgtntaacggtcggacgttcggtaacggggaaccgaacgg

SEQ ID NO: 380264 - DNA, 765 bp, Homo sapiens
  misc_feature: GZ8MTXP01BHFSF.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagcgtgggtctttccttgttgcttaattttaaaaggtgcccagtgtgaggtgcagctggtggagtcgtgggaggaggtcttgactccgaggtccggtcggggggtccctgacgtactctcctgtgcacgtcctcgtgggttccaccgtcagtccacacctacatgagtcgtcgggtcccgccgaggcctaccggagggggaacggggctgggagtcgtccgtttctttactttttaatttagtaggttaggtggtaacgtactattaccgtcccgactaaacggtacccgtccgggtagggaccgggggccctactttccaacctattcccaccgaaggaacgtaaactaaaccttaaccgaaacgtaaaccgtaccggttctttacgtttaccttaaacaaaagttacgtaaaccgaccgggtccgttaagggaacgaccgggacccgtaaagtccgggaaaccggtacccgggtaccgttaggtttaaactttccggtgggtaacggaacgggttaggaacggacgggttacccggggaaaccccttaacgggttaacctttaacccgtcggtacgttaacggtacgggtccggttaccgggtccgggggaaccgtaacccgggg

SEQ ID NO: 380265 - DNA, 678 bp, Homo sapiens
  misc_feature: GZ8MTXP01B0GZY.13.76.G10.1.454.CMB.2.raw
  modified_base (519)..(519): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtctggaggaggcttgatccgagccgtgggggtcctgagactctcctgtgcagcctcgtggtcaccgtcagtcacacctacatgagcgtcgggtcccgccgaggccgtaccggaaggggaagggggcgtagggagtcggtccgtttctttactttttaagtttagttaaggttaggttaggtaacgttaaccctacgttacctcccgacacggtaacccgttccgggtgggacgggggaccctacttccaacctactcctacccaaggactaactaaattaccgaaagaacctacgtctttacgtttactaacaaatgaaacncgccgtaggaacgacgacccgatcgaaccgtacggccgttagtaacgttactggcgaagaagaggtacgttccggggaaccctaacggttaaaccgtttcaccggtaactaaggtcgggaaccgttcgggacggggaaccgttaaacgggggtaacccg

SEQ ID NO: 380266 - DNA, 628 bp, Homo sapiens
  misc_feature: GZ8MTXP01CWLT7.13.76.G10.1.454.CMB.2.raw
  modified_base (587)..(587): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtcgtggagggaggcttgatccagccgtgggggtccctgagactctcctgtgcagcctcgtcgggttcaccgtcagtcacacctacatgagcgtgggtcccgccaggcctccgagggaaggggctggagtgcgttctttctttatttagtagtagtggtagtaccatactccgacacgaacgtccggtggacgggggcctaagtttcccaacctactcctacccaagaacgaactaaacttaccaaacgaaaccaacggtcctttagtttaccttaacaaaactgaaacacggccgtaggaaggcgaccgaatcgaaccgtacggtacccgtgttaacttacgtgtgaacgaaggagacgttcgggggacccaagttaaccgttcgacgtntaggtcggcgtcggttacggggaaccgttaagggaaccccg

SEQ ID NO: 380267 - DNA, 576 bp, Homo sapiens
  misc_feature: GZ8MTXP01B53DO.13.76.G10.1.454.CMB.2.raw
  modified_base (238)..(238): a, c, t, g, unknown or other
  modified_base (273)..(273): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataatggacagataaatntacttctgtatcagcagaagtcaggccagtccccngtgctggtcatctatcaagatgacctaaggccggccctcgaggggactcccccgtaggagcgacttctctggcctccaaacgtcgtacggggaaccttcgaacgccctacttcagaccatccagggcccgggaacccaggtcctaaggtgagtaggacgtcgtacgtacttacgttacgtcggtcgacgggcggtacggactacggacgtacgctaacgtcggccgtcgttacgtcgtcgttacggttacgttacgggtaaccgtacggtccgtaccgtacgttacgtccgaaccgtaacccg

SEQ ID NO: 380268 - DNA, 595 bp, Homo sapiens
  misc_feature: GZ8MTXP01C8H55.13.76.G10.1.454.CMB.2.raw
  modified_base (458)..(458): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtgggttcaccgtcagtcacacctacatgagcgtgggtcccgccaggcctcggaggggaaggggcgtggagtgtcgttctttcttttatttagttagtagtggtagtaccatactcgcagacctcgtggacgggccgattcaccatctaccgagaagactaattcccaaagacacgttccttgtttactacgaaaatgaaacngacctggagacggccatcgacgacgggtcctgttaattactggtcgaacggagaggacggttcggggaccccaaggttaaaccgttcacggtctaaggtcggtacggtcggttacgggggaaccaacggggtaaccc

SEQ ID NO: 380269 - DNA, 535 bp, Homo sapiens
  misc_feature: GZ8MTXP01AEQON.13.76.G10.1.454.CMB.2.raw
  modified_base (188)..(188): a, c, t, g, unknown or other
  modified_base (235)..(235): a, c, t, g, unknown or other
  modified_base (396)..(396): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagcccgccctnagtgtctcggggccccagggcagaggtcacatctctgcacgtgggancagctccaacattggggcacattatgatgtacactggtaccagctagtttccagagcgaggtcccagactcctcatacaaataacgtaacaaacaagtccggacccgacggaaccgggtccctacgaccgtattcctcgtggctccgcgttcgtggccccncctccgccgtcccgtccgtcgtctactcgtcgtcgtcgtcggcgtcgtgaggagtgcgtcgtagtattcttctcgtcgtcgtcttcgtacgcgacgcgcgcgttcgtgtcgtcgtcggtcggttcgggtccgggcgtcg

SEQ ID NO: 380270 - DNA, 550 bp, Homo sapiens
  misc_feature: GZ8MTXP01C0LGW.13.76.G10.1.454.CMB.2.raw
  modified_base (368)..(368): a, c, t, g, unknown or other
  modified_base (371)..(371): a, c, t, g, unknown or other
  modified_base (394)..(394): a, c, t, g, unknown or other
  modified_base (397)..(397): a, c, t, g, unknown or other
  modified_base (402)..(402): a, c, t, g, unknown or other
  modified_base (414)..(414): a, c, t, g, unknown or other
  modified_base (472)..(472): a, c, t, g, unknown or other
  modified_base (481)..(481): a, c, t, g, unknown or other
  modified_base (483)..(483): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctaagctgggttttccttgttgctattttaaaggtgcccagtgtgaggtgcagctggtggagtctggaggaggcttgatccagccgtgggggtccctgagactctcctgtgcagcctctggggttccaccgtcagtcacacctacatgagcgtcgggtcccgccgaggctcccgagggggaaggggctgggagtgcgtctttctttttattatagtagtggtagtacactacncgnagacctccgtgcggggcatcacntcncaganacatacaagacncgcttgtttctacaaatcgaacagcctggagcgccgatgacgcggtcgtgtattacgngtgcgaagngngtcggggccacggtaacgttacgcgctaagtgggaacgtcgtgggggaccaacgggccgtaaccggg

SEQ ID NO: 380271 - DNA, 492 bp, Homo sapiens
  misc_feature: GZ8MTXP01CAVJJ.13.76.G10.1.454.CMB.2.raw
  modified_base (410)..(410): a, c, t, g, unknown or other
  modified_base (428)..(428): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggcagataaatatacttcctggtatcagcagaagtcaggccagtcccctgtgctggtcatctatcaagatgccaagccggccctgagggactcccccgtgagcgattctctcggctccaaactctgggaactcagccactctgaccatcagccgggacccaggcagtgatgaggctgactattacngtcaggcgtgggacagcngcaactcgccgcttagtgtcttcggacttgggaaccaggtcaccggtcaagtcaacgaaccccg

SEQ ID NO: 380272 - DNA, 596 bp, Homo sapiens
  misc_feature: GZ8MTXP01CE3EV.13.76.G10.1.454.CMB.2.raw
  modified_base (231)..(231): a, c, t, g, unknown or other
  modified_base (372)..(372): a, c, t, g, unknown or other
  modified_base (566)..(566): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtcccccaggacagacagccagcatcacctgctctaggaaataaattggaanataaatatactctggtatcagcagaagtcaggccagtcccctgtgctggtcatctagtagggataacgtaacccggccctcgtgggacttcccgtgaccgtatttcccctctggcctacccgaacgtaccgggggaaaccnccggacccacccgtgacccataccaaacacgacgacccgaaggacgggataggagactagaacttattagttgtacgaggtggtagggggacacgcgaccgacggtgagtacgttcgggcggtccgggaccgagccgtcggacccgttccgtacggttccgacggccccgaggccgttccgccccgtcggtccncgttccttccgttccccgaacccgttcccg

SEQ ID NO: 380273 - DNA, 592 bp, Homo sapiens
  misc_feature: GZ8MTXP01EW74X.13.76.G10.1.454.CMB.2.raw
  modified_base (238)..(238): a, c, t, g, unknown or other
  modified_base (244)..(244): a, c, t, g, unknown or other
  modified_base (273)..(273): a, c, t, g, unknown or other
  modified_base (285)..(285): a, c, t, g, unknown or other
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctagaaataatggacagataaatntactcngtatcagcagagtcaggccagtcccctgngctgtcatctancaagctgaccaagccgcctcgacggacctcccgtagacgtcgtacttcctcgtcggtcctacccgaacgttcgtacgggaactcgacgtccctacttcacgacctagtcgaacggccgggaccagggtactagtgggaattgggaacgggtctaggaacttacgttacgtcgtcggaggtcgggaggtacgacgcgaacggctacgttccggccccgttgtacgttcggttaccgttcgggaaccggttccgggaaacccgtaacggtacccgtacccggttacctaaaccggttccgaaaccccgg

SEQ ID NO: 380274 - DNA, 579 bp, Homo sapiens
  misc_feature: GZ8MTXP01DE6BZ.13.76.G10.1.454.CMB.2.raw
  modified_base (250)..(250): a, c, t, g, unknown or other
  modified_base (382)..(382): a, c, t, g, unknown or other
  modified_base (455)..(455): a, c, t, g, unknown or other
  modified_base (507)..(507): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatccagccgtgggggtccctgagactctcctgtgcngcctcgtgggttcaccgtcagtcacacctacatgagcgtcgggtcccgccgaggcctccggaggggaaggggcgtggagtgtcgttctttcttttattatagtagtgtagtaccatactcgcagaacctcgnggacgggccgattcaccatctccagagaacaattaccaagaaccacgtcttgtttacctacaaagtcgaaacncgcgtagagacgccgatcgaccgtcggtccgtgtacttacgtgtgaacgagnggacgttcggggaccctagttaacgttcacgtctagcgggtacgtcggacggggaaccgaacgggtaacccg

SEQ ID NO: 380275 - DNA, 674 bp, Homo sapiens
  misc_feature: GZ8MTXP01CE5S2.13.76.G10.1.454.CMB.2.raw
  modified_base (472)..(472): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgactccaggccgtgggggtccctgagactctcctgtgcagcctcgtggtccaccgtcacgtcacacctacatgagcgtcgggtcccgcgaggcctaccggaggggaagggggcgtgggagtgtcgtttctttcttttatttatagtagtggtatacccatactccgcacgtaacgtccggtggacggggtccgtacttccacctactctaccagtacgaactaacttacccaaagaaccacgtctttagtttacctaanaaactgaacacggtccgtaggaacgtacggacccgaagtccggaaccggaccgggttccggtattaacgttacgtggtggaaccggtaggacggtacgggttccgggaaaccccgtaacggttaaacccgttccgaacggtctaacgggtccggggtaacgtccgggttaccgggggaaccgttaaaccgggggtaaccccg

SEQ ID NO: 380276 - DNA, 576 bp, Homo sapiens
  misc_feature: GZ8MTXP01BU1Y0.13.76.G10.1.454.CMB.2.raw
  modified_base (391)..(391): a, c, t, g, unknown or other
  modified_base (399)..(399): a, c, t, g, unknown or other
  modified_base (436)..(436): a, c, t, g, unknown or other
  modified_base (531)..(531): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctctgggtcaccgtcagtcacacctacatgagcgtgggtcccgccgaggcctaccgaggggaaggggcgtggagtgcgtcttcttttattatagtagtggtataccatactcgcagaactcgtggacgggccattcactntctcaganacaatccaaagacacgtcttgttctacaaatgaaacngcctaggagacgccgatcgacgacgggccgttagtacttacgtggtgcggaagcgggacgttccggggaacccaaggttaaaccgttcgaccgtntagtcgggaccgtcggttacgggggaacccttaaggggaaccccg

SEQ ID NO: 380277 - DNA, 567 bp, Homo sapiens
  misc_feature: GZ8MTXP01BYBD3.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgaggggaggggctggagtgcgtcttcttttatttatagtagtggtagtacatactccgcagaactccgtgaggggccattcacatctccagagacaatccaaagacacgcttgttctacaaatgaaacagccgtgacgagccgatcgacacggccgtgtattactggtgcgaagaggagttcgggggacccaacggttaaaccgttcgacggtctaagtcggggtaaccgtcggttacgggggtaacccgaaagggggtaaccccg

SEQ ID NO: 380278 - DNA, 563 bp, Homo sapiens
  misc_feature: GZ8MTXP01BB53P.13.76.G10.1.454.CMB.2.raw
  modified_base (330)..(330): a, c, t, g, unknown or other
  modified_base (484)..(484): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggtcaccgtcagtcacacctacatgagcgtgggtcccgccaggctccgaggggaggggctgggagtgcgtcttntttttattatagtagtggtagtacatactccgcagaactcgtggacgggccgattcaccatctccagagacaagttccaaagaacacgtcttagtttactacaaaatgaaacagtccgtaggaagaccgaccgagtacgaccgacggtccgttnttacgttactgggtgcgaggagcgttcggggacccaagttacgttcacgctagcgggactggacggggcgaacgggccc

SEQ ID NO: 380279 - DNA, 691 bp, Homo sapiens
  misc_feature: GZ8MTXP01EIFZJ.13.76.G10.1.454.CMB.2.raw
  modified_base (478)..(478): a, c, t, g, unknown or other
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagcccaccctcagtcgtccgtgtccccaggacagacagccagcatcacctgctctagaaataatggacagtaataaatatacttctggtatcagacagaagtcaggccacgtcccctgtgctggtcatctaatcaaagactgaccaaggccggaccctacgacgggtaccctcccgtaggacgaccgtactttcctccgtcgggacccttacccgaaaccgttccggtaacggggtaaaccctcaaccggtccctaacgttccacgaaccctagtaccggaacggacccggggaaccccgtaggtaccgttaagngggaagttcgggaacgggggtcttacggtaaacctttacgttacggtacgtaccggtaggggtacccgggtaggggaacctacggaccgacgaaccgtccgttccggtccccggttattaacgttcggttaccgtttaccgggaaccgttaacgggggaaacctaacgggttacccgaacccggttaccctaacgggttcccgaaaccccggg

SEQ ID NO: 380280 - DNA, 631 bp, Homo sapiens
  misc_feature: GZ8MTXP01DV524.13.76.G10.1.454.CMB.2.raw
  modified_base (387)..(387): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagctctcctgtgcagcctcgtgggtcaccgtcagtcacacctacatgagcgtcgggtccgccgaggctccgaggggaaggggcgtggagtgcgttcttcttttattatagtagtgtagtacatactcgcagaactcgtggacgggcattcaccntctcagagacaatccaaagacacgtcttagtttctacaaatcgaaacagccgtaggacgacgccgaatcgaaccgtacgggtcccgttggttaactttaccgtgggtcggaaccgggtaaaggacgggtacgggttccggggggaaccccctaacggggttaaaccgtttacccgttaacggtccgttaaagtcggggtacccggtcggttacggggggtaacccgaaacgggggtaacccccg

SEQ ID NO: 380281 - DNA, 592 bp, Homo sapiens
  misc_feature: GZ8MTXP01BD319.13.76.G10.1.454.CMB.2.raw
  modified_base (333)..(333): a, c, t, g, unknown or other
  modified_base (377)..(377): a, c, t, g, unknown or other
  modified_base (436)..(436): a, c, t, g, unknown or other
tcagtcacgtactacacgaccggtgctcgatttagtcactcatacagggggggagaggagcccagcactgggattccgaggtgtttccattcggtgatcagcactgaacactgaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtgggtcccgccaggctccgaggggaagggggctggagtgcgtcttnttttattagtagtagtgtagtaccatactcgcagaactccgtgnggggccattcacatctcagagacaatccaaagacacgtcttgttcttacaaatgaaacngccgtgagaacgccgatcgaaccgacggtcccgtagtatttacgtggtcgcggtaagacggcggttaccgggggccctaaacgggttaaaccgttacgttacggtaacctagtcgggacgtcggttacgggggaacccgaaacgggggtaaccccg

SEQ ID NO: 380282 - DNA, 603 bp, Homo sapiens
  misc_feature: GZ8MTXP01DNCRT.13.76.G10.1.454.CMB.2.raw
  modified_base (401)..(401): a, c, t, g, unknown or other
  modified_base (452)..(452): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgcttaattttaaaaggtgcccagtgtgaggtgcagcgtggtggagtcgtggaggaggcttgatcagccgtgggggtcctgagactctctgtgcagcctcgtgggtcaccgtcagtcacacctacatgagcgtgggtcccgcgaggcctccggaggggaaggggcgtggagtgtcgttctttcttttatttatagttagtggtagtaccatactcgcacgactcgtggacggggccatcaccatcnccaagacaactaactccaaagaacacgtcttgtttactaacaaatgaaacngccgtagagacgccgaatcgaccgacggtccttgtaacttacgtggtgcggaagaggtacggttcgggggacccctaaggttaaaccgtttcacggtcttaaggtcgggtaccggtcgggttacggggaaccccgaaagggggtaaccccg

SEQ ID NO: 380283 - DNA, 654 bp, Homo sapiens
  misc_feature: GZ8MTXP01CXE79.13.76.G10.1.454.CMB.2.raw
  modified_base (555)..(555): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggtcaccgtcagtcacacctacatgagcgtcgggtcccgcgaggcctccggaggggacgggggcgtggagtgtcgttctttctttagttatagtagtggtagtaccatactcgcacgtaacctccggtggacggggcccgtattccgacctactcctacccgagaacgaactaaacgttacccgaaagtaaacccgccggttactttacgttttaccttaaccgaaaatcggaaaactacggcctaggaacggtacgcccgtaagtcgaaccgccgggtaccgtttagtacgtttacgnggtcgaacggtagacggtacgttcggggaccccaacgttaacgtttccgacgtctaacggtcgggacgtcggacgggggtaacccaaggggtaaccccg

SEQ ID NO: 380284 - DNA, 771 bp, Homo sapiens
  misc_feature: GZ8MTXP01EUI8T.13.76.G10.1.454.CMB.2.raw
  modified_base (201)..(201): a, c, t, g, unknown or other
  modified_base (507)..(507): a, c, t, g, unknown or other
  modified_base (708)..(708): a, c, t, g, unknown or other
  modified_base (732)..(732): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggtagttttggctgagcttgggttttccttgttgtcttaattttaaaaggtgcccagtgtgaggtgcagctggtggngtcgtggaggaggtcgagtactccgacggtccggttcggggggttcccgtggacggtaccttccgttcccgtggtcgcctacggtcccgttcgttcggggttccaccgtcacgtccaacacctacatgacgcgtcgggtcccgccgacggccgtaccggaaggggaacgggggcgtggacggttcggtccgtttcaacgtttttttaagtttaagttaggttacggttggttaagttaacccctacgttacgtacccgcgtaacggtaaccgttcccgggtcgggaacgggggtcccacttacccnctaactccaaacgtacgaacgtaaacctaaacttaacccgaaacgaaccgtaaccgtcttgttttaaaccttaacaaaactacggtaaaccgagtcccggggatcggggaaacgcccgtaaagtccggaaccggtaaccgggtccgttaagttactacgtggtaggaacggaaggttacggcgttcggggaaacccctaanccccggttaaaagttccgtaacgngtaacgtacggtcgggttaccggtcgggaaccggaaccg

SEQ ID NO: 380285 - DNA, 632 bp, Homo sapiens
  misc_feature: GZ8MTXP01C0KG7.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctggattcactttgatgattatgccatgcacgtgggtccgcaagctccgaggggaacggcctgggagtgggtctcgaggttattagttggaatacggtggtagcagtaggcttatgcggtactcgtggtagaagggccgattccactatctaccagaacgaacaaccgaccaaacgacctacccgtagtactccgtaggaacctaaaagtacgaaacgacgacccgtaggaggaaacgccgtagggaacgggaccgaccggggtcctttaggttatttaagttggttaagaacgttaaaaacgttccttaaccctaaacccccgtttaggttaagtttttagggaggtttacgggtttaacgttaacccgggttaagggg

SEQ ID NO: 380286 - DNA, 710 bp, Homo sapiens
  misc_feature: GZ8MTXP01EPZRS.13.76.G10.1.454.CMB.2.raw
  modified_base (575)..(575): a, c, t, g, unknown or other
  modified_base (601)..(601): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcacgcctcgtgggtccaccgtcacgtcacacctacatgagcgtcggtccgccgaggcctccggaggggagggggcgtagggagtcggtcgttctttactttttagtttagtagttaggtggttaagtaccctactaccgtccgacacggtaaaccctccgggtgggacgggggtacccgtactttcccaaccctactcctacccgaaaggacaaacctaaacttacccgaaaaggaacctacgtacctttttagtttacccttaaacaaaagttcgaaaacctggtcccgtaggaacgacgcccgaattcgacccacgggtccgttnttaaccgttatgggtcgaaggaaggngacggttacgggggaccccctaaggggttaaaccttttcccgacggtaacttaacggtcgggtaacccggttcgggaccggggggaacccttaaaggggggaacccccg

SEQ ID NO: 380287 - DNA, 721 bp, Homo sapiens
  misc_feature: GZ8MTXP01DMIED.13.76.G10.1.454.CMB.2.raw
  modified_base (292)..(292): a, c, t, g, unknown or other
  modified_base (536)..(536): a, c, t, g, unknown or other
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctatttaaaggtgccagtgtgaggtgcagctggtggagtcgtggaggaggcttgatccgagccgtgggggtccctgagctctcctgtgcacgcctcgtggtcaccgtcagtcacactacatgagcgtcggtccnccgaggccgtaccggagggggaacggggcgtagggagtcgtcgtttctttactttttagtttaagttaggttaggttaggttaacgtactacgttaccgtcccgacgtaaacggtaccgttccgggtagggacgggggtaccctaacgttacccaacctacttaccgtacccaagaacgtaaacaaactttaaccgaaaagaaccgtaacggtctttacgtttactaacgaaacgtagaaaccncgggtacccgtaggaacgacgaccgtaacgtcggaaccgtaccgggtaccgtttgtaactttacgtggtaacggacggaggtaacggacgggtaccggggaccccttaaagggttaccgttaaccgtaacggtaccgttgtaccggggcggtttacgggtaaccggggaacccggtaaaccgggg

SEQ ID NO: 380288 - DNA, 627 bp, Homo sapiens
  misc_feature: GZ8MTXP01DW651.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtgggtcaccgtcagtcacacctacatgagcgtgggtcccgccaggctccgaggggaggggctggagtgcgtcttctttattatagtagtgtagtacatactcgcagaactcgtggacgggccgatcaccatctccagagacaatcaagaacacgtcttgttctacaaattgaaacacgccgtagaacgacgcccgaagtacggaccgtaaccgggtccgttagttaacgtttaccgtcggtggaaccggtaaagggacggtaacggttccggggggaaccccctaaacggggttaaaccgtttaccgttaaccggtccgttaagtcgggtaaccggtcggttacgggggtaacccgaaacgggggaaccccg

SEQ ID NO: 380289 - DNA, 666 bp, Homo sapiens
  misc_feature: GZ8MTXP01C1XIH.13.76.G10.1.454.CMB.2.raw
  modified_base (362)..(362): a, c, t, g, unknown or other
  modified_base (618)..(618): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttcctgttgctattttaaaaggtgccagtgtgaggtgcagcgtggtggagtctggaggaggcttgatccagccgtgggggtcctgagactctcctgtgcagcctcgtgggttcacgtcagtcacacctacatgagcgtcggtccgcaggctcgaggggaaggggctggagtgtctctttacttttattatagtagtggtagtaccatactccganacgaactccggtggacgggggacctattccaccactacctcccgaaaggaacaacctaaaacttaccccaaaaggtaaccctaaccgggttccttttaggtttaccccttaaaaagaaacgtacgaaactacgtccggtaggaacggaccgtaccgagtaccgaaccgtaccgggtcgttagttaacttacggtggcggaacggaaggacggtacggttacccgggaaccctaaacgggttaaccgttacgacgtnttaggtccggtaccgttcggggaccgggaaccggaaacccgggtcccg

SEQ ID NO: 380290 - DNA, 710 bp, Homo sapiens
  misc_feature: GZ8MTXP01D0PAW.13.76.G10.1.454.CMB.2.raw
  modified_base (298)..(298): a, c, t, g, unknown or other
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctatttaaaaggtgccagtgtgaggtgcagctggtggagtcgtgggaggaggcttgatccgagccgtgggggtccctgagactctcctgtgcagcctcgtgggtccaccgtcagtcacacctacatgagcgtcgggtccnccgaggccgtccggagggggacggggcgtggagtgtcgttcttcttttattagtagtagtgtacgtacatactccgcaacgactcggtaggacggggccgtattccacctatcctaccaagaacgaactaaacttacccgaaaagaaacctacgttcttacgttttacctaacaaaaagttcggaaaccagggtacccgttaggaaacggtacgacccgtaagtacggaaccgtaaccggggtccgttaggttaaacttacgtggtaacggacgaagggaacggttcggtacccgggggaaccccttaaacgggttaaacccggtttaaccgtaaccgggtaccgtttaaagggttccgggggaacccggtttacgggtaacccggggggaaaccccgtaaaacccgggggg

SEQ ID NO: 380291 - DNA, 588 bp, Homo sapiens
  misc_feature: GZ8MTXP01BU6TN.13.76.G10.1.454.CMB.2.raw
  modified_base (416)..(416): a, c, t, g, unknown or other
  modified_base (447)..(447): a, c, t, g, unknown or other
  modified_base (463)..(463): a, c, t, g, unknown or other
  modified_base (468)..(468): a, c, t, g, unknown or other
  modified_base (506)..(506): a, c, t, g, unknown or other
  modified_base (508)..(508): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggtagttttggctgagtcttgggtttttccttgttgtcttaattttaaaaggtgccagtgtgaggtgcagcgtggtggagtcgtggaggaggcttgatccgagccggtgggggtccctgagtactctcctgtgcagcctcgtggtcaccgtcacgtcacacctacatgacgcgtcggtccgcaggctaccggaggggaggggctgggagtcgtcgttctttcttttatttatagttagtgtaacgtacactactccgcagaacctcggtggacggggcctattccacactcnccagtaacgactaaattacaacgaacacgtnttcgttactacaaatnaaacncgtcagagacgccatcgacctggtcctgtactttacgngngaagagagtcggaccggaacccgtaacgttacgttcacgtcgtaggtcggacgtcgggaccgggaaccgaacgggtcccg

SEQ ID NO: 380292 - DNA, 575 bp, Homo sapiens
  misc_feature: GZ8MTXP01A0NBX.13.76.G10.1.454.CMB.2.raw
  modified_base (360)..(360): a, c, t, g, unknown or other
  modified_base (372)..(372): a, c, t, g, unknown or other
  modified_base (389)..(389): a, c, t, g, unknown or other
  modified_base (399)..(399): a, c, t, g, unknown or other
  modified_base (430)..(430): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtcgtggaggaggcttgatccgagccgtgggggtccctgacgactctcctgtgcagcctgtggtcacgtcagcacacctacatgagctgggtccgccaggctccgagggggaagggctggagtgcgttcttacttttattatagtagtcggtatacatacncgacagctccgngggacgggccatcaacntctacagganaacaattcaaagacacgtcttgttacctaanaaatacgaacgtgacgtagagacgcgtaagcgaaccgcggtcgttagtacgttcgtgtcggaggagacggtacgggtaccgggaaccccttaaacggttaaccgttaacgacgcgttaggtcgggacgtcgggaacggggaaccg

SEQ ID NO: 380293 - DNA, 637 bp, Homo sapiens
  misc_feature: GZ8MTXP01EILX9.13.76.G10.1.454.CMB.2.raw
  modified_base (340)..(340): a, c, t, g, unknown or other
  modified_base (388)..(388): a, c, t, g, unknown or other
  modified_base (469)..(469): a, c, t, g, unknown or other
  modified_base (482)..(482): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatccgagccgtgggggtccctgagactctcctgtgcagcctcgtgggtcaccgtcagtcacacctacatgagcgtcggtccgccgaggcctaccggaggggaaggggctgggagtgcgttctttntttttaattagtagtagtgtagtacatactcgacagaaccgttccggnggacggggacctacttaccacctatcctaccaaggaacaacctaaacttccaaaagacctacgtctttacgttacctaaanaaacgtacgaacncgtaccgtaggacgacgacgtagtaccgaccgtacggtacgttagttacttacgtggtagaacggaaggacggtacggttacccgggaaccctaacggttaacgttcacgtaagtggtaacggacgtcgggacgggaaccgttaacgggaacccg

SEQ ID NO: 380294 - DNA, 642 bp, Homo sapiens
  misc_feature: GZ8MTXP01DY6VS.13.76.G10.1.454.CMB.2.raw
  modified_base (485)..(485): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatccagccgtgggggtccctgagactctcctgtgcagcctcgtgggttccaccgtcagtcacacctacatgacgcgtcgggtcccgccgaggccgtccggaggggagggggcgtgggagtgtcgttctttcttttatttatagtaggtgtacgtaccatacgtccgcacgaaccgtcgtggacggggccgtactccaccatcctcccaagacgtaacaaacttaccgaaagaacctacgttcttagttttacctactaaaatcgaaaacncgtccggtaagacgaacgccgaagtcgaaccgacgggtaccttgttaacttacgtgtggaacggtaggacggcggttccggggaccctaaacgttaaccggtttacacgcgttaagtcgggacggttcggcgggggtaaccgaacggggtaaccccg

SEQ ID NO: 380295 - DNA, 709 bp, Homo sapiens
  misc_feature: GZ8MTXP01D3756.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatccgagccgtgggggtccctgagactctcctgtgcagcctctgggttcaccgtcagtcacacctacatgagcgtcgggtcccgccgaggccgtaccggagggggaacgggggcgtggggagtcgtcgtttctttctttttaatttagttagttagtggtacgtaccatactccgcacgtaacccgttcggtgggacggggcccgtattccaaccgtactcctacccaaggactaacctaaacttaccccgaaaagtaaccgtaccggttacttttcgttttaaccttaacgaaaacttcgggaaaaacctccgggtacccgttaaggaaccgacggtaccccgtagtacccggaacctacggggtacccgtttgttaaccttttaacgggcggtaggaacggtagacgggtacggttaccgggaaccctaagttaaccgttcgacgtaacgttaggcggtacggtcgggttacgggaacccgttaacgggcccg

SEQ ID NO: 380296 - DNA, 628 bp, Homo sapiens
  misc_feature: GZ8MTXP01BKCOC.13.76.G10.1.454.CMB.2.raw
  modified_base (445)..(445): a, c, t, g, unknown or other
  modified_base (477)..(477): a, c, t, g, unknown or other
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagcccaccctcagtcgtccgtgtccccaggacagacagccagcatcacctgctctaggaaataatggacagtataaatatacttctgtatcagcagagtcaggcctacgtcccctgtcgctggtcatctatacaagatcgaccgaaggccggaccctgacgggtacctcccgtaggacgtcgtacttcctcgtcggtcctacccgtaacgtcgtacggggaaccttcgaacgccctactacctcgaacccagtccgacggcccgggtacccagggtactagnggagtcgggacgggcttagaacttacttacgnggtacgagggtcgtaggggacacggacgtacgccgtccgttccgggtaccccttcgttacgttcggttaccgtttaccggggaacgtccgggggtaaacccgtaacgggtcccctacccggttaccgtaaaccggttcccgaaaccccggg

SEQ ID NO: 380297 - DNA, 661 bp, Homo sapiens
  misc_feature: GZ8MTXP01AWQ42.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagcttgggttttccttgttgctattttaaaaggtgtccagtgtgaagtgcagctggtggagtcgtgggggaggcttgggtacagcctggcaggtccctgagactctcctgtgcagcctctggattcactttgatgattatgccatgcacgtgggtccgacaagctccgagggggacgggcctgggagtgggtctcgaggttattaggtggaatagtggtagctaatagggctagtggcgggtactcgtggtaggaaacgggcccgtattccaccatcctacccaggaacgaaccaaaccgacccgaaacgtaaacctccccgttagtaacgtccttaggacctaaaagttacggaaaccaacggcccgtaggaaggtaccggacgttagggaacggaaccgaaccggggttccttttaggttatttaagttagttacggaaccttaaaaacgtaaccttacccctaaacccccgtttaggttaacgttttttacggggtaacggttaagggtttaaaccgg

SEQ ID NO: 380298 - DNA, 612 bp, Homo sapiens
  misc_feature: GZ8MTXP01B7YOH.13.76.G10.1.454.CMB.2.raw
  modified_base (378)..(378): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttcctgttgctattttaaaggtggccagtgtgaggtgcagctggtggagtctggaggaggcttgatccagccgtgggggtccctgagactctcctgtgcagcctctgggttcaccgtcagtcacacctacatgagcgtgggtcccgccaggcctccggaggggaggggctgggagtgtcgttctttctttattatagtaggtgtagtaccatactccgcagtacctccggnggacggggccctagttccacctactctacccgaagacgaactaaacttaccgaaacgaactaacgtcttgtttaccttacaaattacgaacagccgtagaaggtacgccgaatcgaaccgacggtccgtagtacttacgtgtgaacgagacggtacgttcggggacccaacggttaaccgttacgacggtctagtcggtacgtcggttacggggtaacccgaagggtaaccccg

SEQ ID NO: 380299 - DNA, 577 bp, Homo sapiens
  misc_feature: GZ8MTXP01BOG24.13.76.G10.1.454.CMB.2.raw
  modified_base (368)..(368): a, c, t, g, unknown or other
  modified_base (379)..(379): a, c, t, g, unknown or other
  modified_base (447)..(447): a, c, t, g, unknown or other
  modified_base (490)..(490): a, c, t, g, unknown or other
  modified_base (533)..(533): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggtcaccgtcagtcacacctacatgagcgtcgggtccgccgaggccgtaccgaggggaaggggcgtgggagtgcgttcttcttttattatagtagtggtagtacatactccgnacgaacctcgnggacggggccgtattcacatctaccagagacaattccaaagacacgtcttgtttctacaaatgaaacngcctaggacgagcccgatcgaacgacggtccgtgtacttacgngtgcgagagacggttcggggacccctaaggaaccgttcacgtntagtcggtacgtcggttacggggaacccgttaaggggaaccccg

SEQ ID NO: 380300 - DNA, 723 bp, Homo sapiens
  misc_feature: GZ8MTXP01EA88J.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgcttaattttaaaaggtgcccagtgtgaggtgcagcgtggtggagtcgtggaggaggcttgatccgagccgtgggggtccctgagactctcctgtgcagcctcgtgggttccaccgtcagtcacactacatgacgcgtcggtcccgccgaggccgtccggaggggaaggggcgtggagtgtcgttctttctttttaatttagtagttaggtggtagtacctatactccgacacgtaaccgtccggtgggacggggtccctagttccaaccctactcctacccgaaagacgtaaacctaaacgttacccgaaaagtaacccgtaacgtccttttacgttttacctaactaaaacgtcggaaacctacggtccgtaaggaacggaccgacccgtaagtccgaaccggtaccgggttccgttaagttaacgtttacgtgggtcggaacggtaaggttacggtaacgggttccgggggaaccccttaaacgggttaaacccgtttacttaccggtaacgttaggtcggtaaccggttcgggacgggggtaacccgaacggggtaacccccg

SEQ ID NO: 380301 - DNA, 549 bp, Homo sapiens
  misc_feature: GZ8MTXP01AQRAT.13.76.G10.1.454.CMB.2.raw
  modified_base (375)..(375): a, c, t, g, unknown or other
  modified_base (412)..(412): a, c, t, g, unknown or other
  modified_base (419)..(419): a, c, t, g, unknown or other
  modified_base (470)..(470): a, c, t, g, unknown or other
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctgtgggttcaccgtcagtcacacctacatgagctgggtccgccaggctccgaggggaagggctggagtgcgttcttcttttattatagtagtggtacgtacatactccgcaagactcgtgngggccatcacatctcagagacaataccaagaacagtntatctanaaatgaacgacgtgagagtcgagcgacggctactatactgtacgcgaaagnttggcaggacggaccgggccccggttaaggcgggggtcctaggggtgggtacgggttcttacgtttcgaacgttcgggg

SEQ ID NO: 380302 - DNA, 673 bp, Homo sapiens
  misc_feature: GZ8MTXP01DU86M.13.76.G10.1.454.CMB.2.raw
  modified_base (173)..(173): a, c, t, g, unknown or other
  modified_base (243)..(243): a, c, t, g, unknown or other
  modified_base (304)..(304): a, c, t, g, unknown or other
  modified_base (422)..(422): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagcccaccctnagtgtccgtgtccccaggacagacagccagcatcacctgctctaggaaattaatggacaagtaataaatntactctgtatcagcagaagtcacggccacgtcccctgtgcgtggtccattctatacaaagntacgaccaacggccggaccctacggaagggtacctccccccgtaggacgcgtacttccgtactcggcctacccaaacgtccgtacgggaacctcggactacccactctacgaacctanccgacgggaccgggaacccgtaggcctaggtagacgtaggacggccttaggtaaccttagttaacgtcggttacggaacgggttcgggtaacgggactacggacctaaacggccaacccggttccggaccccgttaagttacgtcggttacccggtttaacggggaaccggttaccggggtaaacccgaaacggtttccccgaaacccgggtttaccttaaacggtaaccccgaaccgggtaaaccccccg

SEQ ID NO: 380303 - DNA, 608 bp, Homo sapiens
  misc_feature: GZ8MTXP01BXOPZ.13.76.G10.1.454.CMB.2.raw
  modified_base (250)..(250): a, c, t, g, unknown or other
  modified_base (453)..(453): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtcgtggaggaggcttgatccagccgtggggggtccctgagactctcctgtgcngcctcgtgggttcaccgtcagtcacacctacatgagcgtggtcccgccaggctccggagggaggggcgtggagtgcgttcttcttttatttatagtagtggtagtaccatactccgcagacctccggtggacggggccgtattccacctactctccagacgaacaacttccaaagaacacgtcttgtttctacaaatcgaacncggacccggagacgccgatcgaccacgggccgttagtacttacgtgtcggcgaaggtacgagggtcccggggaccctaaagggtaaccgtttacgttaccgcttaaggtcgggaaccgttcggacggggggacccaaacgggggccctaaccggg

SEQ ID NO: 380304 - DNA, 770 bp, Homo sapiens
  misc_feature: GZ8MTXP01DT0AN.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggagggaggcttgatccaggccgtggggggtccctgagactctcctgtgcagcctcgtggtcaccgtcagtcacacctacatgagcgtcgggtccgccgaggctccggaggggaaggggcgtgggagtgtcgttctttacttttatttatagttaggtggtacgtaccatacgtcccgacacgtaacctccggtgggacggggtacccgtactttaccaacctactccgtacccgaaggacgaaaccctaaacttacccgaaaagtaaacccgtaccggttccttttacggttttaccttaaaccaaaagttaccgaaaacgtaccgtacccggttagggaaacggtaaccggacccggtaaagttcccggaaacgtacccgggggttaccgtttaaaggttaactttaccggtgggttacgggaacggtaaagggttacgggtacggttcccggggggaaacccctaaccgggttaaaacccggttttaccaacccggttcggtaaacgtccggggtaaaccgggttcgggttaccggggggaacccgaaaccgggggtaacccccg

SEQ ID NO: 380305 - DNA, 579 bp, Homo sapiens
  misc_feature: GZ8MTXP01BSM7A.13.76.G10.1.454.CMB.2.raw
  modified_base (328)..(328): a, c, t, g, unknown or other
  modified_base (427)..(427): a, c, t, g, unknown or other
  modified_base (432)..(432): a, c, t, g, unknown or other
  modified_base (437)..(437): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctctgggtcaccgtcagtcacacctacatgagctcgggtccgccaggctccgagggaagggctggagtgcgtcttnttttattatagtagtgtagtacagtactcgcagaactccgtggaggggcctattcaccatctccagagacaactaccaagaacacgcttgttcctaaanaaatnaaacncgcgtagagacgacgagtacgaccgacggtcgttagttacttacgtggcgaacggaagttacggacggttaccgggaaccctaacgttaacgttacacgtcgtaggtcggtaccgtcgggaccgggaaccgaacgggaaccg

SEQ ID NO: 380306 - DNA, 597 bp, Homo sapiens
  misc_feature: GZ8MTXP01EELIA.13.76.G10.1.454.CMB.2.raw
  modified_base (393)..(393): a, c, t, g, unknown or other
  modified_base (396)..(396): a, c, t, g, unknown or other
  modified_base (401)..(401): a, c, t, g, unknown or other
  modified_base (468)..(468): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagcgtggtggagtctggaggaggcttgatccgagccgtgggggtccctgagactctcctgtgcagcctcgtgggttcaccgtcagtcacacctacagtgagcgtcgggtcccgccaggcctccgagggaatgggctggagtgcgttcttcttttattatagtagtgtacgtacatactcgcaagctcggtggaggggccatcacntcncaganacatcaagacacgtctgttactacaaatgaaccaggctagacgacgccgatcgacctacgggtcctnttacttacgtggtgacgagggagacgggttaccggggaaccccgttaacgttaaccgtttacgtaaccggtacgttaacggttcggggtaccgttacgggtaaccgggggaacccgtaaaacccggggg

SEQ ID NO: 380307 - DNA, 673 bp, Homo sapiens
  misc_feature: GZ8MTXP01AMTX6.13.76.G10.1.454.CMB.2.raw
  modified_base (390)..(390): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtcgtggaggaggcttgatccaggccgtgggggtccctgacgactctcctgtgcagcctctgggttcaccgtcagtcacacctacatgagcgtcgggtccgccgaggccgtaccggaggggaacggggcgtgggagtcggtcgttcttttactttttagtttagtagtaggtaggtacgtacctactactccganacgtaaccgtccggtggacggggcctattccacctacttccaccgaagaacgtaacctaaacttaaccgaaacgtaaccacggtcttagtttacctaacaaaagtcgaaactcgccggtaggaacgagacccgtaatcggaaccgtaccgggtccgttagtaacttacgtggacggaacggaaggttacggcggttacccgggggaacccctaaacgggttaacgtttaccacgggtaactaggtcgggtacgtcgggacggggtaaccgaacgggtaacccg

SEQ ID NO: 380308 - DNA, 650 bp, Homo sapiens
  misc_feature: GZ8MTXP01A500F.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtcgggtcccgccaggctccggaggggaaggggctgggagtgcgttctttcttttattatagtagtggtataccatacgtcgcacgtaacctcggtggacgggtcctacgtaccactactcctaccgaaggacaactaacttaccgaaagtaacctacgttctttagtttacctaacaaagtacgaacaccggtcggaagacggacgacccgtatccggaaccggtaccggtaccgttagttaacttacggtggcggaacggaggagggtaccggggttcccggaaccgtaacggttaaccgttaccgacgtaatacggtcggtacccggtgggttacccgggaacggttaacggtaaccccgg

SEQ ID NO: 380309 - DNA, 565 bp, Homo sapiens
  misc_feature: GZ8MTXP01ANXGE.13.76.G10.1.454.CMB.2.raw
  modified_base (170)..(170): a, c, t, g, unknown or other
  modified_base (471)..(471): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctctaggaaataagttggacaagataaatatacttcctggtatcagcaagagtcaggccacgtcccctgtcgctggtacatctatacaagatcgaccgaacggccgaccctagacgggactcccccgtggacgcgtattcctcgtcggcctacccgaacgtcgtacgggaacctcgacgtcccactctacgacctagccgaggacccggaccaggctagtcggatgacggtctagtacttattcgtgtcgaggtcgaggacnggcacgcaacgtcgcccgtattcgtcggtacgttacggacgttaccgggaaccgtacggtccctaccggtaccttacgtccgaaccgaaccccg

SEQ ID NO: 380310 - DNA, 568 bp, Homo sapiens
  misc_feature: GZ8MTXP01DZI72.13.76.G10.1.454.CMB.2.raw
  modified_base (170)..(170): a, c, t, g, unknown or other
  modified_base (500)..(500): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtgtcccgtgtccccaggacagacagccagcatcacctgctctaggaaataatggacagaataaatatacttcctggtatcagcagaagtcaggccagtcccctgtgctggtcatctatacaagatcgaccagcgccctcgacgggactccccccgtgacgcgtacttctcgtggcctcaactcgtagggaacctcgacgccactctagacccagtccaaggacccgggacccaggtaccgtagtggacttagggacgggtctacggtaccttagttacgtagtccgaaggccggtagggacctaggcgaacgcaacgtccgcccggtnttacgtcgtcgttaccggacgttacgggaacctaaggtccaaccggtcttaacgtcgaacgaaccccg

SEQ ID NO: 380311 - DNA, 556 bp, Homo sapiens
  misc_feature: GZ8MTXP01EFRJ0.13.76.G10.1.454.CMB.2.raw
  modified_base (474)..(474): a, c, t, g, unknown or other
  modified_base (481)..(481): a, c, t, g, unknown or other
  modified_base (506)..(506): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttagaaggtgtccagtgtgaggtgcaactggtggagtcgtgggggaggcttggtccagccgtgggggtccctgagactctcctgtcaagcctctgggttcagcttcagtgtatattggatgagctgggtccgccagactccgaggggaaggggctggggagtggggtggccaaacataaacacagacggaagtcgacccatactatgcgactctgtgaaaggccgattcaccatctccagagacaacgccaaagaactacattatattgacaaagtgaccgcgtagagagacgaggacaggctatgtattacngtgaagngagattgagacggttggcttacggngggttcgggggaacccgggtaaccctggttacctaacccggttcaaaccg

SEQ ID NO: 380312 - DNA, 679 bp, Homo sapiens
  misc_feature: GZ8MTXP01B842A.13.76.G10.1.454.CMB.2.raw
  modified_base (295)..(295): a, c, t, g, unknown or other
  modified_base (391)..(391): a, c, t, g, unknown or other
  modified_base (529)..(529): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgccagtgtgaggtgcagcgtggtggagtcgtggaggaggcttgatccgagccgtgggggtcctgagctctcctgtgcagcctcgtggtcacgtcagcacactacatgacgcgtcgggtccncgacggcctaccggagggggaacgggcgtgggagtgtccgttcgtttactttttaagtttagtaggttaggttacggttaagtactaacttacccnccaaacacggtaaccgtcccgggtagggacgggggtaccctaattaccacccaacgtccctaccgaaggaacaaacctaacttaccgaaaaggacctaacgtcctttacttactaacaaagtacgaaacgcgtaccgngaacgacgacccgagtacgaacccgcgggtccttaggtacttaccggtgcggacggaagaggtaacggtccgggggaaccccttaagggttaaccgtttaacaccgtcgtaacggtacgggttaccgtccgggttaacgggggaacccgg

SEQ ID NO: 380313 - DNA, 568 bp, Homo sapiens
  misc_feature: GZ8MTXP01DYNMR.13.76.G10.1.454.CMB.2.raw
  modified_base (447)..(447): a, c, t, g, unknown or other
  modified_base (503)..(503): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtgggtcccgcaggctccgaggggaggggctggagtgcgttctttcttttattatagtagtggtagtaccatactccgcagaacctccgtggacggggccattccaccatctaccagagaacaataccaaagaacacgtcttgtttctacaaaatgaaacngcctagagaacgcccgaatcgacgacgggtccgttgttattacgtgtggaacgagngagttcggggacccagttaacgttcacgctaagtggacgtcggttacggggccgaacggggtccc

SEQ ID NO: 380314 - DNA, 644 bp, Homo sapiens
  misc_feature: GZ8MTXP01D095U.13.76.G10.1.454.CMB.2.raw
  modified_base (469)..(469): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtggggggtccctgagactctcctgtgcagcctcgtgggtcaccgtcagtcacacctacatgagcgtcgggtcccgcgaggctccggaggggaaggggctggagtgcgttctttcttttattagtagtagtggtagtacatactccgcagtaacctccgtggagggccgtattccaccatcctccaaggtacaactaacttacccaaagaacctacgtctttagtttacctaacaaaatcgaaaccncggtaccctaggacggacgacccgtagcgaaccgacgggtacccttggttaacttacgttggcggaacggaaggacgggtacggttcgggggacccctaaacggttaaaccggttcttaaaccgtctaagtcggggacctcgggttaccgggggaaccgaaacggggtaaccccg

SEQ ID NO: 380315 - DNA, 579 bp, Homo sapiens
  misc_feature: GZ8MTXP01BW9GF.13.76.G10.1.454.CMB.2.raw
  modified_base (482)..(482): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtcccgccaggctccgaggggaggggctggagtgcgtctttcttttatttatagtagtggtagtacatactcgcagaacctccgtggacggggccagttccacatctccagagactaatccaaagacacgcttgttctacaaatgaaacagcctagagacgtccgatcggaaccgcggccgttgtactttacgngtcgaacggagaggaacgttcgggggacccctaaggttaaccgttcacgtctagtgggaccgtcggttacgggggaacccttaaacgggggaacccc

SEQ ID NO: 380316 - DNA, 574 bp, Homo sapiens
  misc_feature: GZ8MTXP01EHMOB.13.76.G10.1.454.CMB.2.raw
  modified_base (253)..(253): a, c, t, g, unknown or other
  modified_base (293)..(293): a, c, t, g, unknown or other
  modified_base (334)..(334): a, c, t, g, unknown or other
  modified_base (442)..(442): a, c, t, g, unknown or other
tcagtcacgtactacacgaccggtgctcgatttagtcactcatacaggggtgggagaggagcccagcactgggattccgaggtgtttccattcggtgatcagcactgaacacagaggactcaccatggtagttttggctgagcttgggttttccttgttgcttaattttaaaaggtgcccagtgtgaggtgcagctggtggagtctggaggaggcttgatccagccgtgggggtccctgagactctctgtgcngcctcgtggtccacgtcagtcacactacatgagctggccncaggctcgaggggaggctggagtgcgttcttcttttattanagtagtgtacgactatacgtcgcaagtacctcggtggacggggcctattccaccatcaccagacgactaattcccaaagaaccacgcttgttcttacaaatgaaaccncggctagagacgcgagcgacgacggtcgtattacgttcgtggtgcggagacggttacggtccggggaacccaacggttaacgttacctaacgtcgtaagtcgggacgttcgggtaaccgggaaccgaacggg

SEQ ID NO: 380317 - DNA, 578 bp, Homo sapiens
  misc_feature: GZ8MTXP01A2JLZ.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggttcaccgtcagtcacacctacatgagctgggtccgccaggctccgagggaggggctggagtgcgtcttcttttattatagtagtgtagtaccatactcgcagtaacctccggtgaggggccgtattcaccagtctaccaggacacaacttaccaaagaacacgcttgtttctacaaatcgaacagccgtgagacgaccgatcgacacggccgtgtattactgtgcgagaggagttcgggggaccccaacggttaacgttaccgacgtctaagtcgggaaccggttcggacgggggtaacccgaacgggggaaccccgg

SEQ ID NO: 380318 - DNA, 797 bp, Homo sapiens
  misc_feature: GZ8MTXP01ENBOZ.13.76.G10.1.454.CMB.2.raw
  modified_base (611)..(611): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggtcaccgtcagtcacacctacatgagtcgtcggtcccgccgaggccgtaccggaggggaacgggggcgtaggggtaggttcggtccggtttacttttacgtttttttaagttttagtttaagggttaggttacgggttaacgttaaccctaacttaccgtacccggtactaacggtaaaccccgttcccgggttcggggaaccggggggtacccgtaacgtttaccccgaacccctaacgttccccgtaaccccgaaggtaaccgtaaaccgttaaactttaaccccgaaaagtaaacccgtaaaccggttctttttacggtttaaccttaaacaaaacgttacggaaaaccnccgttaccgttaggaacggacggacccgtaaagtcgggaaccgtaccggggtccgtttagtactttacgtggtacggaagtaggaggtacggttaccgggggaacccctaacgggttaacgttccgttacggcttaacgggtcgggtaccggtcgggttacggggaacccgaacggggtaaccccg

SEQ ID NO: 380319 - DNA, 508 bp, Homo sapiens
  misc_feature: GZ8MTXP01BEFVV.13.76.G10.1.454.CMB.2.raw
  modified_base (339)..(339): a, c, t, g, unknown or other
  modified_base (370)..(370): a, c, t, g, unknown or other
  modified_base (389)..(390): a, c, t, g, unknown or other
  modified_base (396)..(396): a, c, t, g, unknown or other
  modified_base (398)..(398): a, c, t, g, unknown or other
  modified_base (404)..(404): a, c, t, g, unknown or other
  modified_base (409)..(409): a, c, t, g, unknown or other
  modified_base (412)..(412): a, c, t, g, unknown or other
  modified_base (422)..(422): a, c, t, g, unknown or other
  modified_base (424)..(424): a, c, t, g, unknown or other
  modified_base (428)..(428): a, c, t, g, unknown or other
  modified_base (431)..(431): a, c, t, g, unknown or other
  modified_base (439)..(439): a, c, t, g, unknown or other
  modified_base (452)..(452): a, c, t, g, unknown or other
  modified_base (458)..(458): a, c, t, g, unknown or other
  modified_base (460)..(460): a, c, t, g, unknown or other
  modified_base (462)..(462): a, c, t, g, unknown or other
  modified_base (464)..(464): a, c, t, g, unknown or other
  modified_base (466)..(466): a, c, t, g, unknown or other
  modified_base (488)..(488): a, c, t, g, unknown or other
  modified_base (490)..(490): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtggggggtccctgagactctcctgtgcagcctctgggttcaccgtcagtcacacctacatgagcgtcgggtcccgcgaggctaccggaggggaagggggctgggagtgcgttcttnttttattatagtagtggtataccatactcgnagctcgtgagggcatcacnnctcagnanatacanacacnctnttcttacaananacancgngagagcgncgcgacgcgtgtntagtgngngngngngcggacgacgacgttcttacgngngtcgcgcgcggtcgcgcg

SEQ ID NO: 380320 - DNA, 666 bp, Homo sapiens
  misc_feature: GZ8MTXP01EQ478.13.76.G10.1.454.CMB.2.raw
  modified_base (397)..(397): a, c, t, g, unknown or other
  modified_base (435)..(435): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctatttaaaaggtgccagtgtgaggtgcagctggtggagtcgtggaggaggcttgatccagccgtgggggtcctgagactctcctgtgcacgtcctcgtgggttcaccggtcagtcacacctacatgagcgtcgggtccgccgaggccgtccggagggggaacgggggcgtgggagtcgtcggttcttactttttattagttagtagtaggtagtacatacctccgacagccgtcggngggacggggccgtattccacgtatccctacgaaggtanaacctaacttacccgaaagaacctacggtccttagtttacctaactaaaagttcgaaaccgagtcccgtagaacggacgacccgtagcggaacccgtcgggtcccttagttacgttaaccgtgggtagaccgggagttaacggacggttaccgggggaccccaacggttaaccgttaacgtacggtccgttaaggcggggttaccgtttcgggaaccggggggaaccccgg

SEQ ID NO: 380321 - DNA, 550 bp, Homo sapiens
  misc_feature: GZ8MTXP01CIO5D.13.76.G10.1.454.CMB.2.raw
  modified_base (441)..(441): a, c, t, g, unknown or other
  modified_base (471)..(471): a, c, t, g, unknown or other
  modified_base (483)..(483): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagctgggtccgccaggctccgaggggagggctggagtgcgtcttcttttattatagtagtggtagtacatactccgcagctcgtggaggggccatcacatcctccagagacaattccaaagaccacgcttgttactacaaatgaacagcctgagngcccgatcgacacggccgttagtacttcgnggtcgcgaaggngaacggtcgggggaccccacggttaacgtttccaggccttagtcgggacgtcggttgggggaacccg

SEQ ID NO: 380322 - DNA, 626 bp, Homo sapiens
  misc_feature: GZ8MTXP01EM1FA.13.76.G10.1.454.CMB.2.raw
  modified_base (335)..(335): a, c, t, g, unknown or other
  modified_base (439)..(439): a, c, t, g, unknown or other
  modified_base (449)..(449): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggtttccttgttgctattttaaaaggtgccagtgtgaggtgcagctggtggagtcgtggaggaggcttgatccagccgtcggggggtccctgagactctcctgtgcagcctcgtgggttcaccgtcagtcacacctacatgagcgtggtcccgccaggcctccgaggggaaggggctggagtgcgttctttnttttattatagtagtggtatacatactccgcagactccggtggacgggccgtattcaccatctaccagagactaatacaaagaacacgtcttagtttcctaaanaaatcgaacncgtacgtaggaacgtacgaccgagtcggaccgtacgggtacgttagttaattacgtggtggaacggaggttacgggtacgggttaccggggtaaaccctaaacggttaaccggttcaacggtcgttaaggccgggtaacggtccgggttacgggggaacccgaaacggggtaacccg

SEQ ID NO: 380323 - DNA, 613 bp, Homo sapiens
  misc_feature: GZ8MTXP01BHWY6.13.76.G10.1.454.CMB.2.raw
  modified_base (445)..(445): a, c, t, g, unknown or other
  modified_base (457)..(457): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtggtcccgccaggcctccgaggggaaggggctgggagtgcgtcttcttttatttatagtagtggtagtaccatactccgcagaacctccgtggacggggccattccaccatctcccagacgaactaattaccaaagaaccacgtcttgttttacctanaaaatgaaaccncgcgagacgacgaccgagcgaccgacggtcgttagttacttacgtggtgaacggaaggacggtacggttccggggacccctaacggttaaccgttaccgttacgtcttacggtcgggaccggttcgggaccgggggtaaccgaacggggtaacccg

SEQ ID NO: 380324 - DNA, 687 bp, Homo sapiens
  misc_feature: GZ8MTXP01C4ZTC.13.76.G10.1.454.CMB.2.raw
  modified_base (303)..(303): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggaggaggcttgactccgaggccgtgggggtccctgacgacctctcctgtgcagcctcgtggtcaccgtcagtcacacctacatgacgcgtcgggtcccncgaggcctccggaggggagggggctgggagtcgtcgttctttcttttatttagtagttagtggtagtaccatactccgcacgtaaccgtccgggtggacggggtcccgtacttccacctacgttcctaccgaaggaacaacctaattacccaaagactaccgtcttttagtttacctaacaaagtcgaaacgtccggaccgtggaacgaacgcccgtataccggaaccgtccggggtaccgttgttaactttacgtcgggtcggaacggaaggaagggtaccggccgggggtaacccctaaagggttaacccgtttacgttacggtccttagggtccggggtaccggttccgggacgggggtaaccccgaaacgggggtccccg

SEQ ID NO: 380325 - DNA, 638 bp, Homo sapiens
  misc_feature: GZ8MTXP01D20TL.13.76.G10.1.454.CMB.2.raw
  modified_base (342)..(342): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatccgagccgtgggggtccctgagactctcctgtgcagcctcgtgggtcaccgtcagtcacacctacatgagcgtcgggtccgccgaggcctccggaaggggaggggcgtaggagtgtcgttctttnttttattatagtagtgtagtacatactcgacacgaaccgtccgtgggacgggtaccgtacttccacctactccgtaccaaggacaactaactaccgaaaagaacctacggtctttagtttacctaaacaaagtacgaactcgacgtaggaacgacgacgagtaccgaccgtaccggtcgttagttagttacgtggagaacggaaggacggtacggttacccgggaaccctaaacggttaaccgttcacgtaacgtaggcgggtaccgtcgggaccggggaacccgaacgggtcccg

SEQ ID NO: 380326 - DNA, 639 bp, Homo sapiens
  misc_feature: GZ8MTXP01AUMFS.13.76.G10.1.454.CMB.2.raw
  modified_base (377)..(377): a, c, t, g, unknown or other
tcagtcacgtactacacgaccggtgctcgatttagtcactcatacaggggggagaggagcccagcactgggattccgaggtgtttccattcggtgatcagcactgaacacagaggactaaccatggagttttggctgagctgggttttccttgttgctattttaaaaggtgcccagtgtgaggtgcagctggtggagtctggaggaggcttgatccagccgtgggggtcctgagactctcctgtgcagcctcgtgggttccaccgtcagtcacaccacatgagcgtcggggtcccgccgaggcctccgaagggggaaggggcgtgggagtgcgttctttactttttaatttagtagtagtggtagtacactactcgnagactccgtggcggggccattcaccatctacagacgactaacttaccaaagaacacgtcttgtttactacaaatgaaacagtacctggggaacgaggcccgagtacggaaccgccgggtccgttagtaacttacgtggtcggacggaaggaacggttaggtccgggggacccctaacgggtaaaccgttacgttacggttactaaggtagggtaacccggtcggtacgggggacccgaaacgggggttaacccgtaaccggg

SEQ ID NO: 380327 - DNA, 635 bp, Homo sapiens
  misc_feature: GZ8MTXP01CQ6EY.13.76.G10.1.454.CMB.2.raw
  modified_base (271)..(271): a, c, t, g, unknown or other
  modified_base (519)..(519): a, c, t, g, unknown or other
  modified_base (544)..(544): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtggttcaccgtnagtcacacctacatgacgcgtggtcccgccgaggcctccgagggggaagggctgggagtgcgtcttcttttattagtagtaggtggtaagtactatacctccgacagccgtccggtgggacggggtccgtattccaccatccctaccagtaacgaactaaacttacccaaaggtaaccacgttcttagtttacttaacaaaagttcggaaacacgtcccgtagacgaacgcccggaattcggaaaccnccgggtaccgttagtactttacggnggtcggacgaggacgaggttcccggggaacccttaacggttaaacgttcaacgtcttaaggcgggaccgttaacggttcgggggaaccccg

SEQ ID NO: 380328 - DNA, 591 bp, Homo sapiens
  misc_feature: GZ8MTXP01D6B61.13.76.G10.1.454.CMB.2.raw
  modified_base (238)..(238): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctgggggccccagggcagagggtcaccatctcctgcacgtggggancagctccaacattggggcacattatgatgtacactggtaccagctagtttccaggagcaggtcccagactctcatacaataacgtaaacaaacaacgtccggacccgacgacggggtccctgaacccgtattctcgtcggctccgagtctaggccacctcacgtccctccgtggtccagtccacgtcgggcctcggaggctggaggatcggagtcgtagtactttactttcgtcgtcctaagttcccttagttacgacgtaacgcgttacggttcccgttggtaacggttcggtaacggtttaccgggtacgggtttccgggggaacccggggggttaacccgtaacccgggg

SEQ ID NO: 380329 - DNA, 555 bp, Homo sapiens
  misc_feature: GZ8MTXP01EDXOC.13.76.G10.1.454.CMB.2.raw
  modified_base (403)..(403): a, c, t, g, unknown or other
  modified_base (444)..(444): a, c, t, g, unknown or other
  modified_base (474)..(474): a, c, t, g, unknown or other
  modified_base (482)..(482): a, c, t, g, unknown or other
  modified_base (521)..(521): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcttggtttttccttgttgcttaattttaaaaggtgcccagtgtgaggtgcagctggtggagtcgtggaggaggcttgatccagccgtgggggtccctgagactctcctgtgcagcctcgtgggtcaccgtcagtcacacctacatgagcgtgggtcccgccgaggcctccgaggggaaggggctggagtgtcgttctttcttttattatagtagtggtatacatactcgcagaacctcgtggagggccatcacatctaccaganactaataccaaagaacacgtcttgttctacaaaatgaaacngcgtagagacgcgagtcgacgcgtacgttntatcgtgngaagagaggacgcgggaccctaacgttaacgttcacgtntagtcggacggtcggacggggaaccgaacgggcc

SEQ ID NO: 380330 - DNA, 639 bp, Homo sapiens
  misc_feature: GZ8MTXP01DUBDK.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtctggaggaggcttgatccagccgtgggggtccctgagactctcctgtgcagcctcgtgggttcaccgtcagtcacacctacatgagcgtggtcccgccaggcctccgaggggaaggggctgggagtgcgttcttcttttaattataggtagtggtagtacatacctccgactagccgtccgtgggacggggcccgattaccgactactcctcccgaagacgaactaattacccaaagaaacctacggtcttagtttacctactaaacttagaacgacgtcctagaacggagccccgagtacggaacccgtaccggggtcccgttagtacttacgtggtggacggacggttaggaacggtccgggggaacccccttagggttaaacccgttcgtaacgtccgtaagtcggggttacgtccgggttcggggaaccccggg

SEQ ID NO: 380331 - DNA, 716 bp, Homo sapiens
  misc_feature: GZ8MTXP01EX8ND.13.76.G10.1.454.CMB.2.raw
  modified_base (212)..(212): a, c, t, g, unknown or other
  modified_base (235)..(235): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctntaggaaataatggcagataaatntacttctgtatcagcagaagtcaggccagtcccctgtgctggtcatctatcaaagatcgccctaagccggccctcgacggggactccccccgtgacggtcgtattcctaccgtgggcctacctaaaccgttcgtaacgggggtaaacctcgacggacccctaacttccctacggaaccccacttaccgaacgggaccccgggggaaccccctaagggggacccttaacggttacggggaaacgttggtaaacgggggcccttaggggtaaacccgttttaaatttaacccgtggttacccgaaggggtcccgggttagggggaacctaggaccgtacgggacccaacgttccgggaacccccggttacgttaacggttccggttaccgttaccgggttaaaccgggttacccgggaaaccgtaacgggttaaccccgtaacccgggttacccgttaacggtaacccgaacccggaaccccg

SEQ ID NO: 380332 - DNA, 616 bp, Homo sapiens
  misc_feature: GZ8MTXP01CE5IZ.13.76.G10.1.454.CMB.2.raw
  modified_base (463)..(463): a, c, t, g, unknown or other
  modified_base (495)..(495): a, c, t, g, unknown or other
  modified_base (504)..(504): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtgggtcaccgtcagtcacacctacatgagcgtcgggtcccgccaggcctccgaggggaggggctggagtgtcgtctttcttttattagtagtagtgtagtaccatactcgcagaactccggtggacggggtcctattccacctactctaccagtacgaactaacgtacccaaagaacctacgtcttacgtttactacaaatcgaaacncgcgtgaagcgaccgatcgacgacggtccgtntaagtctgnggaacgagaggtagttaccgggggacccaagggttaacccgtttacgaccggttaagaacggtttcgggggaacctcggggttaccggggaaccggaacggggtaacccccg

SEQ ID NO: 380333 - DNA, 588 bp, Homo sapiens
  misc_feature: GZ8MTXP01CWGPW.13.76.G10.1.454.CMB.2.raw
  modified_base (455)..(455): a, c, t, g, unknown or other
  modified_base (495)..(495): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtcgggtcccgcaggctccgagggaagggggctggagtgcgttcttctttatttatagtagtggtatacatactcgacagaacctccgtggacggggtccgatttccacctatctaccagacgaactaacttccaaagaacacgtcttgtttacttacaaatgaaacncgcctggagacgcgatgacgacggtccgtagtacttacgngtgcggaagaggaacgttcgggggaccccaaggttaaccgtttacacgccgtaagtcggaccgtcggttacggggaacccgaagggaaccccg

SEQ ID NO: 380334 - DNA, 579 bp, Homo sapiens
  misc_feature: GZ8MTXP01B3S4T.13.76.G10.1.454.CMB.2.raw
  modified_base (170)..(170): a, c, t, g, unknown or other
  modified_base (295)..(295): a, c, t, g, unknown or other
  modified_base (467)..(467): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctctaggaaataaatggacagataaatatacttcctggtatcagcagaagtcaggccagtcccctgtcgctggtcatctatcaagntcgaccaagccggcctcgacgggactccccccgtaggacgtcgtactttccgtcgtcggtcctaccctaaaccgttccgtacgggaacctcgacgccctactctacgaccactacgacggaccgggacccaggctagcgagtgacggtcgtagtaacttattacgtgtacgngggtacggtagggactagcgagcctaacgtcgccgtcttacgtcgttacgttacgggttacgttacgggaacctacggtccgtacccgtcgttaacgtccgaacgaaccccg

SEQ ID NO: 380335 - DNA, 681 bp, Homo sapiens
  misc_feature: GZ8MTXP01DW7T9.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgcttattttaaaaggtgcccagtgtgaggtgcagctggtggagtctggaggaggcttgatccaggccgtgggggtccctgacgactctctgtgcacgtcctcgtcgggtcaccgtcagtcacacctacatgacgtcgtcggtccgcgaggccgtaccggaggggaaggggcgtaggagtcgtcgtttcttttacttttagtttagttagttaggttgtagtacctactacctccgacgtacgtaaccgtccggtgggacggggtccctacttccacctactctaccaagacgaactaactacaaagactacgtcttgttactacaaatcgaacacgaccgtaggacgacgacacgtcgacgtaccggtccttagttaacttacgtggtcggaacgtaggacggtaccgggccgggggtaaacccctaacgggttaaacccgttacgttacccggtaactttacggtaacgggtaacccggttccggggttaacgggggtaaccccggaaacggggtaacccccgg

SEQ ID NO: 380336 - DNA, 638 bp, Homo sapiens
  misc_feature: GZ8MTXP01A17DQ.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtcgggtcccgccgaggcctccggaggggaagggggctgggagtgcgtctttcttttattagtagtagtggtagtacatactcgcagactccgtggacgggccattcacctatctaccagacgactaactaccaaagacacgtcttagtttacctacaaatcgaaacacgccgtagagacgacccgtatccggaccgacgggtcccgttagttacgtttaccgtggtcggaacggtaagggacggtacggttccgggggaacccctaacgggttaaacccgtttacaaccggtcttaggtccggggtaaccgttccgggttacgggggaaccccgaaagggggtaacccccg

SEQ ID NO: 380337 - DNA, 622 bp, Homo sapiens
  misc_feature: GZ8MTXP01AMKHW.13.76.G10.1.454.CMB.2.raw
  modified_base (481)..(481): a, c, t, g, unknown or other
  modified_base (506)..(506): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatcgagcgtcgggtcccgccgagggcctaccggaagggggacggggcgtgggagtcggccgttcttcttttaattagtagtaggttggtacgtactatacctccgaacagcctccggtgggacggggcctagttcaccatccctcaagacgactaattcccgaaagacctacgtcttacgtttctaacaaattgaaccngtcctggagtacgcccgatcgaacncgggtccgtgttaacttcggtgtgggaccgaaggacgaacggttcgggggaccccttaacggttaaacccgtttcaacggccttaaggtgggaaccgtttcgggcggggaacccgg

SEQ ID NO: 380338 - DNA, 614 bp, Homo sapiens
  misc_feature: GZ8MTXP01C121X.13.76.G10.1.454.CMB.2.raw
  modified_base (361)..(361): a, c, t, g, unknown or other
  modified_base (437)..(437): a, c, t, g, unknown or other
  modified_base (493)..(493): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctatttaaaggtgcccagtgtgaggtgcagctggtggagtctggaggaggcttgatccagccgtgggggtccctgagactctcctgtgcagcctcgtgggttcaccgtcagtcacacctacatgagcgtggtccgccaggctccgaggggaagggctggagtgtcgtctttcgttttattagtagtagtggtagtacatacnccgacagctcgtggacggggcatcacatctcagagacaattaccaaagaacacgtcttgttctacaaatgaaacgngcctagacgacgcccgaagtcgaaaccgcgggtacccttaggttaacctttaaggngttggacggtaaggaggtaacggtccggggggaaccccaacgggttaaacccggtttaaccgtaaacggtccgttaaaggtggggttaacccggtttcgggttaacgggggaaaccccggg

SEQ ID NO: 380339 - DNA, 629 bp, Homo sapiens
  misc_feature: GZ8MTXP01DBP7J.13.76.G10.1.454.CMB.2.raw
  modified_base (516)..(516): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtcgggtccgccaggcctccgaggggaggggctggagtgcgttctttctttattatagtagtggtagtaccatactcgcagaacctccggtggacggggcccgtattccaccatccaccagaacgaacaaattccaaagaaccacgtcttgtttacctacaaaatcgaaacagtcccgtaggaacgtacgccgaatcggaccgtaccgggtccgttagttaactttaccgngtacggcggaaggaggtaacggttcgggggaacccctaaggttaaaacccgtttcaccggtcttaagtcgggaccggttcggttacgggggaacccgaaacgggggtaacccc

SEQ ID NO: 380340 - DNA, 557 bp, Homo sapiens
  misc_feature: GZ8MTXP01DZO1B.13.76.G10.1.454.CMB.2.raw
  modified_base (468)..(468): a, c, t, g, unknown or other
  modified_base (478)..(478): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggcaagataaatatacttcctggtatcagcagaagtcaggccacgtcccccgtgctggtcatctatacaagatgacccaagccggccctcgagggactcccgtgagcgatttcctcgtggcctccaactcgtagggaacctcgacgcctacgtctgaccatccgacggccgggaacccagggacctagtggatggaggctaggacttagttactgtacgaggcgtagggactggacacggaccncgcgccgttntacgttcggtacgttacgggaacgttcgggaaccgtaacggtccgaaccgttaccgacgaccgtaaccgaacccgaacg

SEQ ID NO: 380341 - DNA, 645 bp, Homo sapiens
  misc_feature: GZ8MTXP01B46AO.13.76.G10.1.454.CMB.2.raw
  modified_base (469)..(469): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggtcaccgtcagtcacacctacatgagcgtcgggtccgccgaggctccgaggggaaggggctggagtgcgtctttcttttatttatagtagtggtagtaccatactccgcagaacctcggtggacggggcccgtattccacctactctacccagacgaacctaattaccaaagaaccacgtctttacgttttaccttacaaaattcgaaaaccncggtcccgttagggaacggacgaccccgtaatcggaaccgtaccggggtccgttaggttaacttacgtggtcggaacggtagacggtacggttccgggggacccctaacggttaaccggtttcacggtgtagtcgggaacgtcggttacgggggtaacccaaagggggtaaccccg

SEQ ID NO: 380342 - DNA, 634 bp, Homo sapiens
  misc_feature: GZ8MTXP01ERCIR.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagcgtgggttttccttgttgctattttaaaaggtgccagtgtgaggtgcagctggtggagtcgtggaggaggcttgatccagccgtggggggtccctgagactctctgtgcagcctcgtgggtcaccgtcagtcacactacatgagcgtgggtccgccgaggcgtccgaggggaaggggcgtggagtgcgttctttcttttattatagttagtggtagtaccatactcgcagaacgtccgtggacgggccgtacttaccacctatcctaccgagtaacgactaaacttacccaaaaggtaacctaccggtactttgttttacctaactaaaattcgaaaactcggtccgtaagggacgacgaccgtagtacggaaccgaccgggttccgtagttaaccgttagtcggtggaacgtaggcgtaggttccgggacccctaaggttaaccgttcaacgcgtagtcgggacgtcgggcggaacccgttaacggggaaccc

SEQ ID NO: 380343 - DNA, 698 bp, Homo sapiens
  misc_feature: GZ8MTXP01B0MZD.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatccagccgtgggggtccctgagactctcctgtgcagcctcgtgggtcaccgtcagtcacacctacatgagcgtggtcccgcaggctccgaggggaggggctggagtgcgtcttcttttattatagtagtgtagtacatactccgacagtaacctcggtggacggggccgtattccacctactcctacccgaagtacgaaacctaattacccgaaaagaacctaccggtctttacgttttacctaacaaattcggaaaactcgaccggttaggaacggacgaccccgtaagtcggaaacccgtaccggggtacccgttagttaaccgttaccgtcgggtgggaaccgaagggacgggtacggttacccggggggaaccccctaaaaggggttaaacccgtttcgttaaacccggtcgttacggtaacgggggtaacccggttccgggaccggggggtaaccccgaaacgggggtaacccccgg

SEQ ID NO: 380344 - DNA, 745 bp, Homo sapiens
  misc_feature: GZ8MTXP01BXAT1.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtcgtggaggaggcttgatccgagccgtgggggtccctgagactctcctgtgcacgcctcgtcgggtcaccgtcagtcacacctacatgagcgtcggtcccgccgaggcctccggagggggaacgggggcgtgggagtcggtccgttctttactttttaagtttagtaggttaggttacggttaacgtaactaacgtacccgtcccggaacgtaacggtaacccgtccgggtaggggaccgggggtaccccgtaactttacccgaaccctaacttcccgtaacccgaaagggtaacgtaacctaaacgttacccgaaaacgtaaaccgtaccggttctttacgtttacttaaccgaaagttcgaaacgtacgtccgtaggaacggacgaccgtaagtacgaaccggtacggtccggttatacgttacgtggtacgacgggtagacgggtaacggtccgggggaaccccaacgggttaaaccggtttaacacgggtaacttacgggtacgggttacggtttaacccggggcgggggtaaaccccggg

SEQ ID NO: 380345 - DNA, 625 bp, Homo sapiens
  misc_feature: GZ8MTXP01B9181.13.76.G10.1.454.CMB.2.raw
  modified_base (402)..(402): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttggtcgaaggccgggggagtcccgtgagactctcctgtgaagcctacaactattctacttttgcttcgtgccgtgggtcgaccgtgggtcccgccgaggcctccggaggggagggcgtgggagtggattggcctaagtaagttaaaggacagacctaagtggcgcgacagcacactaactagaactctanaaagcagattcatcatcacgagaggtagacttaccgaataaccgacggttcgtctctccaagtactaggacgtcaagtcctaaagaaactcgggaaacggtaaccaacgtaacggtccttaaattacgtttaacgtggttacgacgtagttacgggacgttcggggaaccctaacggtaacccgtaacggtttacggtttaggggaacggttcgggtcccggg

SEQ ID NO: 380346 - DNA, 652 bp, Homo sapiens
  misc_feature: GZ8MTXP01BPEQQ.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctatttaaaaggtgcccagtgtgaggtgcagcgtggtggagtcgtggaggaggcttgatccagccgtgggggtccctgagactctcctgtgcagcctcgtggtcaccgtcacgtcacactacatgagcgtggtccgcaggcgtccgaggggagggctggagtcgcgtctttcttttattagtagtagtggtactacactactccgcgtacgaaccgtccggtgggaccgggggcctaacgttccaacccgtatacccgtaccgaagacgaactaaacttaaccgaaagaacctaaccggtctttacgttttacttaacaaaacgttcgaaacgtacgtaccggtaggaacgacgcccgtaatcggaccgaacgggtcccgttagttaccgttacgtggtcggaagaagaggtacgcgggggtaaccctaacggttaacgtttacacggtaatacggtcgggtaccgtcgggacgggggtccgaaacgggaacccg

SEQ ID NO: 380347 - DNA, 606 bp, Homo sapiens
  misc_feature: GZ8MTXP01C116H.13.76.G10.1.454.CMB.2.raw
  modified_base (265)..(265): a, c, t, g, unknown or other
  modified_base (277)..(277): a, c, t, g, unknown or other
  modified_base (289)..(289): a, c, t, g, unknown or other
  modified_base (329)..(329): a, c, t, g, unknown or other
  modified_base (351)..(351): a, c, t, g, unknown or other
  modified_base (404)..(404): a, c, t, g, unknown or other
  modified_base (429)..(429): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggattttggctgagctgggttttcctgttgctattttaaaaggtgcccagtgtgaggtgcagctggtggagtctggaggaggcttgatccagcctggagggtccctgagactctcctgtgcagtcctgtgggtcaccgtnagtcacactacntgagctgggtcncaggctcgaggggaggctggagtgcgttctcttttattanagtagtggtactacatctccgnaagactcggtgacggggcctatccacatctacagacgactattccaaagaacncgtcttagttctacaaagtcgaacngggcctagacgtacgcctatcggactaccgggtccgttaggttaacttccgtggttaacgccggaaggtaccggaggttacccgggggacccttaaaccggttacggtttacctaaccggtacgtaacggttcgggaccggttacggtaaccgggggttaacccgtaaacccggggg

SEQ ID NO: 380348 - DNA, 728 bp, Homo sapiens
  misc_feature: GZ8MTXP01A6L0X.13.76.G10.1.454.CMB.2.raw
tcagtcacgtactacacgaccggtgctcgatttagtcactcatacaggggtgggagaggagcccagcactgggattccgaggtgtttccattcggtgatcagcactgaacacagaggactcaccatggagttttggctgagcttgggttttccttgttgtcttattttaaaaggtgcccagtgtgaggtgcagctggtggagtcgtgggaggaggcttgatccagccgtgggggtcctgagactctcctgtgcacgtcctcgtggtcaccgtcacgtcacacctacatgagcgtcgggtccgccgacggccgtaccggagggggaacgggggcgtagggtaggtcggtccgtttctttacgtttttaatttaagttaggttagtaggttaacgtactactacctcccgacgaaacgtaccgtccggtacgggacggggtacccgtacgttccaccgtactcctaccgaagaacgaactaacttacccgaaagtaaacccacgttacctttacgttttacctaacaaaagttacgaaaccaggtaccctaagggaacgaacggtccgaaacgtcggaaccgtaccgggtccgttagttacttaacgtgggtaacggaggttaaggaacgttacggtaccgggggaaccccttaaacgggttaacccgttaccgtaaccgtcttaaggtccgggaaccggttcgggtaacgggggaacccccgaaagggg

SEQ ID NO: 380349 - DNA, 575 bp, Homo sapiens
  misc_feature: GZ8MTXP01BKQNL.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtctggaggaggcttgatccagccgtgggggtccctgagactctcctgtgcagcctcgtgggtcaccgtcagtcacacctacatgagcgtgggtccgcaggctccgagggagggctggagtgcgtcttcttttattatagtagtgtagtaccatactccgcagaactccgtggacggggccgattcaacctatctaccagagacaattccaaagaacacgtcttagtttctacaaaatcgaaactcgctagacgagccgaatcgacacggtcccgtgtaacttcgtgtgcgaagaggagttcggggaccctaacggttaaacgttccacgctaagtgggtaaccgtcgttacgggggtaacccgaaagggggtaacccc

SEQ ID NO: 380350 - DNA, 590 bp, Homo sapiens
  misc_feature: GZ8MTXP01EUEFK.13.76.G10.1.454.CMB.2.raw
  modified_base (445)..(445): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgagttgcagctggtggagtctggaggaggcttgatccagccgtgggggtccctgagactctcctgtgcagcctcgtgggttcaccgtcagtcacacctacatgagcgtggtccgccaggctccgagggagggctggagtgcgttcttcttttattatagtagtggtagtacatactccgacagctccgtggacggggccattcacatcctaccagagactaattaccaaagaccacgcttgtttacctacaaatcggaaacngacccttaggaacgacgcccgatacggaacccgacgggtcccgttagttacttacgtggtggccggaggttaggagtcgggggaccccacggttaaaccgttaacgtaccgcgttagtcgggaccgtccggttgggggaaccccg

SEQ ID NO: 380351 - DNA, 559 bp, Homo sapiens
  misc_feature: GZ8MTXP01EI9I2.13.76.G10.1.454.CMB.2.raw
  modified_base (170)..(170): a, c, t, g, unknown or other
  modified_base (214)..(214): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtcgtcccgtgtccccaggacagacagccagcatcacctgctntagaaataatggacagaataaatatacttctggtatcagcagagtcaggccagtcccctgtgctggtcatctatacaagtatcgaccaaggccggaccctgagggactcccccgtggacgcgtattcctcgtcggcctaccaaacgtcgtacgggaacctcgacgtcccactctacgaccatccgacggaccgggacccagggctagtggataggacgtcgtagtacttaattacgtgtcgagggcggtacgggacagcacgcaacgtcgccgtcttagtcgttacgttacggacgttacgggaacctaagggtcctacccgtacttacgtccgaacgaaccccg

SEQ ID NO: 380352 - DNA, 571 bp, Homo sapiens
  misc_feature: GZ8MTXP01D4DEU.13.76.G10.1.454.CMB.2.raw
  modified_base (379)..(379): a, c, t, g, unknown or other
  modified_base (443)..(443): a, c, t, g, unknown or other
  modified_base (464)..(464): a, c, t, g, unknown or other
  modified_base (491)..(491): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggtcaccgtcagtcacacctacatgagcgtcgggtcccgccgaggctccgaggggagggggctggagtgcgttctttcttttattatagtagtggtagtaccatactcgcagaacctccgnggagggcctatcaccatctcagagacaataccaaagaacacgtcttgtttctacaaatgaaacngcctagacgagccgatcgacncggcgtgttattacgtgtgaacgtagngacggttcgggaacccctaggttaaccgttcttacgctagtcgggacgtcggttacgggggaaccttaacggggaacccg

SEQ ID NO: 380353 - DNA, 635 bp, Homo sapiens
  misc_feature: GZ8MTXP01A7HEQ.13.76.G10.1.454.CMB.2.raw
  modified_base (534)..(534): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatccgagccgtgggggtccctgagactctcctgtgcagcctcgtgggtcaccgtcagtcacacctacatgagcgtcgggtccgcaggctccggagggaaggggctgggagtgtcgtcttcttttattagtagtagtggtagtacctatactccgctacgaacctccggtggacggggcctacttccgacctactctacccaggaacaactaacttaccaaagaacctaacggtctttacgtttactaacgaaattcgaaactcgaccgtaggaacgacgaccgtaagtcgaaccgtacggtaccgttagttacttacgnggtcggaacggtaaggaggtacgggttccgggaaccctaacggttaaccgttcacgtaacgtagtcgggacgtcggttacgggaaccgaacgggtaacccg

SEQ ID NO: 380354 - DNA, 750 bp, Homo sapiens
  misc_feature: GZ8MTXP01EUS8R.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgtcttaattttaaaaggtgcccagtgtgaggtgcagcgtggtggagtcgtggaggaggcttgatccgagacgtgggggtccctgagtactctcctgtgcacgtcctcgtcgggttcaccgtcacgtcacacctacatgacgtcgtcgggtcccgcgacggcctccgggaaggggaacgggggtctagggagtcggtcgttcttttactttttaagtttagttagttaggtaggtacgtaaccattaccgtccgactaacgaacccgttccggtggggacggggtacccgtacttaccaaccctacgtcctacccgaaggtaactaaacctaaacgttaacccgaaaacggtaacctaaccggttcttttacggtttaaccttaacgaaaagttacgaaaccacggtaccctagggaacccgacggacccgtaagtcgaacccgtacggtccgttagttaccttagtggtggaaccgtaagggacgtacggggttacccgggtaaccctaaacggggttacccttaagttacccgtcgttaaggtccgggtacgggttccgggacgggggaacccgttaacggggtaaccccgg

SEQ ID NO: 380355 - DNA, 558 bp, Homo sapiens
  misc_feature: GZ8MTXP01DKNW8.13.76.G10.1.454.CMB.2.raw
  modified_base (388)..(388): a, c, t, g, unknown or other
  modified_base (521)..(521): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtgggtccgccaggctccgaggggaaggggctggagtgcgtcttcttttattatagtagtgtagtacatactcgcagaactcgtggacgggcgatcacatcncagagacaattccaaagaacacgtcttgtttctacaaatgaaacacgccgtgaagacgaccgatcgacgaccgggtccgtagtattacgtgtgcgtagagacgttcggggaccccaaggttaacgttacacgntagtcggacgtcggacggggaaccaaggggaaccccg

SEQ ID NO: 380356 - DNA, 609 bp, Homo sapiens
  misc_feature: GZ8MTXP01ACY6O.13.76.G10.1.454.CMB.2.raw
  modified_base (330)..(330): a, c, t, g, unknown or other
  modified_base (519)..(519): a, c, t, g, unknown or other
  modified_base (522)..(522): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccaggccgtggggggtccctgagactctcctgtgcagcctctgggttcaccgtcagtcacacctacatgagcgtgggtccgccgaggctccgaggggaaggggctggagtgcgtnttcttttattatagtagtggtataccatactcgacagtaactccggtggacggggcccgtattccaacccatcctacccagacgaacaaacttcccgaaaaggtaccacgtcttagtttacctacgaaaatggaaacagccgtaggaacgagcccggaaatcggaccgacggtccgttgtactttacgnggngaacgaggagtacggccgggaaccctaagttaccgttcgacgtgtacggtcgggtacggtcggacggggaacccgaacgggaacccg

SEQ ID NO: 380357 - DNA, 570 bp, Homo sapiens
  misc_feature: GZ8MTXP01BDSFE.13.76.G10.1.454.CMB.2.raw
  modified_base (412)..(412): a, c, t, g, unknown or other
tcagtcacgtactacacgaccggtgctcgatttagtcactcatacagggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtcgggtcccgccgaggcctccgagggggaagggggctgggagtgcgtcttctttttattatagtagtggtagtaccatactccgcagaacctccggtggacgggggcccattccaccatctccaganacaattccaaagaacacgcttgtttactacaaatgaaacagccgtgagagccgatcgacacggccgtgtacttacgtgtgcgaaggagagttcgggggacccaacggacgttacacggctagtcgggacgttcggcgggggaacccaaggggaacccg

SEQ ID NO: 380358 - DNA, 601 bp, Homo sapiens
  misc_feature: GZ8MTXP01AQRCJ.13.76.G10.1.454.CMB.2.raw
  modified_base (171)..(171): a, c, t, g, unknown or other
  modified_base (291)..(291): a, c, t, g, unknown or other
  modified_base (304)..(304): a, c, t, g, unknown or other
tcagtcacgtactacacgaccggtgctcgatttagtcactcatacagggggctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctctaggaaactaaagttggacaagtaataaatacgttacttcctaggtactacagcagaagtcacggccacgtcccctgngctggtcatctanacaagactcgaccaaggccggccctagagggactcccccgtagacgcgtacttccgacgtgcctacccaaacgtcgtagggaaccctgaacgtcctacgtctacgactagacgacgggaccggacccgaggcctaagtcgaagttcggacggctacgtaacgttacttaacgtcgtcgaaggtcggtagggactcgcaagccaacgtcgacccgtattgtaccggttcgttaccgggacgttacggggaacctacggtaacgtaccggtacgttaaacgccgttaaccggaaccccg

SEQ ID NO: 380359 - DNA, 623 bp, Homo sapiens
  misc_feature: GZ8MTXP01EC26W.13.76.G10.1.454.CMB.2.raw
  modified_base (268)..(268): a, c, t, g, unknown or other
  modified_base (399)..(399): a, c, t, g, unknown or other
  modified_base (407)..(407): a, c, t, g, unknown or other
  modified_base (421)..(421): a, c, t, g, unknown or other
  modified_base (448)..(448): a, c, t, g, unknown or other
  modified_base (569)..(569): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccgagccgtgggggtccctgagactctcctgtgcagcctcgtgggtcaccgtnagtcacacctacatgagcgtcgggtcccgccgaggcctaccgaggggaaggggctagggagtgcgttctttcttttatttatagtagtggtataccatactcgcagaactccgtggacgggccattcaccntctcaganacaatccaagaacncgtcttgttactaacaaatcgaaaacncgtccgtaggacgaccgaccgagcgaacccgtacggtcccgtaggttaaacttcgtgggtcgaacggaaggacggtacggttaccgggggaccctaacgggttaaaccgtttcgaacccgngttaaggtcgggtaaccgtcgggttacgggggaacccaaacgggggtaaccccg

SEQ ID NO: 380360 - DNA, 639 bp, Homo sapiens
  misc_feature: GZ8MTXP01AE7C6.13.76.G10.1.454.CMB.2.raw
  modified_base (359)..(359): a, c, t, g, unknown or other
  modified_base (547)..(547): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctgggggtccctgagactctcctgtgcagcctcgtgggttcaccgtcagtcacacctacatgagctgggtccgcaggctccgaggggaagggctggagtgcgttccgtttattttattagtagtagtagtacgtanactaccgtccgaacgacgtccgtccggtagggacggggacctactaccacgtactccctacgaaggtaacaactaaccgttacaaacgactcgtctttacgttacctaaacaagtacgaaacggcgtccgtaggaacgccgaaccgtgtacgaaccgccggtcgtagttacttcgtggacgcggaagnggtacggtcccggggaacccttaacgggttaacccgttaacgtccgtaacgttgggtacggttcccggttcggggcccgggaaaccccgggg

SEQ ID NO: 380361 - DNA, 697 bp, Homo sapiens
  misc_feature: GZ8MTXP01AXV94.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtcgggtcccgccgaggcctccgaggggaggggctggagtgcgttcttctttttattatagtagtggtacgtacatactcgcacgtaaccgtccggtggacgggggccctattccacctatcctcccaaggtacaaactaacttaccgaaagaaacctaccgtctttagttttacctaacaaaagttcgaaaacctacggtcccgtagggaacggaacggaccccgtaaagttccggaaacccgaccgggggtccccgtttaggttaaacctttaccggttcggtgggaacccgaagggacggtaacggttcccggggggaacccctaaacgggttaaccgttttaccgacgtcctagttaacccggggaacggttccggacgggggaacccgaaacgggggtaacccccg

SEQ ID NO: 380362 - DNA, 558 bp, Homo sapiens
  misc_feature: GZ8MTXP01C98KE.13.76.G10.1.454.CMB.2.raw
  modified_base (216)..(216): a, c, t, g, unknown or other
  modified_base (425)..(425): a, c, t, g, unknown or other
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagcccaccctcagtgtccgtgtcccccaggacagacagcagcatcacctgctntagaaataatggcagataaatatacttctgtatcagcagaagtcaggccacgtcccctgtgctggtcatctatcaagatgccaagccggccctcgacggggacctccccgtagagcgtattcctactgggcctaccgaaaccttcgtacggggaactcgacgccctactcctacgaccagtccgaacggccgggacccagggccttagngggaatggaggggctggtaacttacgttacgtgtcgagggacgtggggaccaggcagcacttcgccccgttgtacgtcgttacgttcggaacgtcggaaccgtaacggtaccgtaccgttactaacgcgaacg

SEQ ID NO: 380363 - DNA, 591 bp, Homo sapiens
  misc_feature: GZ8MTXP01EH6XR.13.76.G10.1.454.CMB.2.raw
  modified_base (367)..(367): a, c, t, g, unknown or other
  modified_base (401)..(401): a, c, t, g, unknown or other
  modified_base (444)..(444): a, c, t, g, unknown or other
  modified_base (457)..(457): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgctaattttaaaaggtgcccagtgtgaggtgcagcgtggtggagtcgtggaggaggcttgatccagccgtgggggtccctgagactctcctgtgcagcctcgtgggttcaccgtcagtcacacctacatgagcgtcggccgccgaggctaccggagggaaggggctggagtgcgttcttacttttattatagtagtgtagtacatactcgnacgactcgtggacggggcatccacatctacaganacaactacaaagaacacgtcttagtttactacaaatcgaaacngtccgtagacgancccggatacgaccgacggtccgtatacttacgtggtcgaagaagagacggttcggggaaccctaaggttaaaccgtttcaacgtcgtaagtcgggaacgttcgggacgggggaacccgttaaacggggtccccg

SEQ ID NO: 380364 - DNA, 549 bp, Homo sapiens
  misc_feature: GZ8MTXP01CBUHF.13.76.G10.1.454.CMB.2.raw
  modified_base (405)..(405): a, c, t, g, unknown or other
tcagtcacgtactacacgaccggtgctcgatttagtcactcatacaggggtgggagaggagcccagcactgggattccgaggtgtttccattcggtgatcagcactgaacacagaggactcaccatggagttttggctgagcgtgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagctgggtccgcaggctccgaggggagggctggagtgcgtctcttttattatagtagtggtacgtacatactcgcaagactcgtgacggggcatcacatctcagagacaattccaagaacncgcttgtttctacaaatgaactaggcctggacgacgccgatacgactacggtctttatacgtggtgcgaagaggacgttcgggggacccctaggaaccggtttcacgtctagtcggacgtcgcggggtaacccaaggggaaccc

SEQ ID NO: 380365 - DNA, 623 bp, Homo sapiens
  misc_feature: GZ8MTXP01BZMGX.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtgggtcaccgtcagtcacacctacatgagcgtcgggtccgccgaggcctccggagggggaacggggctgggagtgcgttcttcttttatttagtagttaggtggtagtacatactccgacagcgtcggtggacggggcctagtcacatctcagtacgactaattccaaagacacgtcttagttacctacaaagtcgaacgacgtcctagaacgacgccgagtcggaaccgaccggtccgtagttacttacgtgggtcgacggaggacgtacgggtccgggggaccccttaacggttaaaccggtttaacccacggtcctttaagggccggggttacccggttcgggttaacgggggaaccccggg

SEQ ID NO: 380366 - DNA, 634 bp, Homo sapiens
  misc_feature: GZ8MTXP01BEV4Y.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtcctgagactctcctgtgcagcctcgtcgggttcaccgtcacgtcacacctacatgagcgtgggtccgccgaggctccgagggggaagggctgggagtgtcgttcttcttttattagtagtgtaggtagtacatacctccgacacgtcgtccggtagacggggcctattcacctatctcagacgactaattaccaaagacctacgtcttagtttactacaaagttcgaaacgtacgcccgtaggaacggacgccggactacggaccgtaccgggtcccgttagttaacgttcgtaacggtgaccggaggaggtacggtccgggggaccccttaacgggttaaccgtttaaccgtaccgtcgttacggtacgggttaccggttcggttcggggggaaaccccgg

SEQ ID NO: 380367 - DNA, 701 bp, Homo sapiens
  misc_feature: GZ8MTXP01EUSFD.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccaggccgtcggggggtccctgagactctcctgtgcagcctcgtggtcaccgtcagtcacacctacatgacgcgtcgggtcccgccgaggccgtccggaggggagggggctgggagtggtcgttctttctttttatttagtagttagtggtagtaccattactccgcagaaccgtccggtggacgggccacttccaacctactcctaccgaagtaacgaacctaaacttcccgaaaagacctaccggtcttttagtttacctaacaaaagttcggaaaacctacggcccgttaggaaacggaccgtacccgaagtccggaaccgtaccggggtaccgtttagttaacttacgtgggtaggaacgggtaaggacggtaacggggttccggggaacccctaaaacggttaaacccgttttacgaccggtccgttaagggtccggggaaccgttcgggacgggggtaacccgaaacgggggtaacccccg

SEQ ID NO: 380368 - DNA, 668 bp, Homo sapiens
  misc_feature: GZ8MTXP01B8U6Z.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggtcaccgtcagtcacacctacatgagcgtcgggtccgccgaggctccgaggggaaggggcgtgggagtggtagtttgggaccgttaagttaaaagtgacgccgtgacgtgggtagggacaacgagaactacgcgtcgccgacccggtggaacgggcagtacttaccgacctactcctaccgaagagtacgttgaacttacgaaaggtaaaccacgtagtttcgtttacgtagaacgtaaactacggaaaccgtacgtcccgtaggaaccgtcggggtaccccgggggactaccggttcggtccccgtttaggttactttaccgttggttaccgaccgttacgccgaacggccgtaacggttcccgtacgggtacccttacgttttaacgtttttaacgtttttttaaccggg

SEQ ID NO: 380369 - DNA, 617 bp, Homo sapiens
  misc_feature: GZ8MTXP01BL8RV.13.76.G10.1.454.CMB.2.raw
  modified_base (334)..(334): a, c, t, g, unknown or other
  modified_base (362)..(362): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttattttaaaaggtgcccagtgtgaggtgcagcgtggtggagtcgtggagggaggcttgatccagccgtgggggtccctgagactctcctgtgcagcctcgtggtcaccgtcagtcacactacatgagcgtggccgcaggcctccggagggaggggcgtggagtgtcgttctttnttttattagtagtagtgtagtacatacncgcacgtacgtccgtgggacgggcgtactcaccactctaccgagacgaactacttacaaacgaactacgtctttacgttactacaaagtacaacgcgaccgtagacggacgacccgagtacggaccgtaccggttccgttagttactttaacgtggtcggaacggtgaggtacgttccgggggaacccctaaggttaaccgttcgaccgtgtacgtcgggtacggtcggacgggggaaccgaacgggtaaccccg

SEQ ID NO: 380370 - DNA, 661 bp, Homo sapiens
  misc_feature: GZ8MTXP01APHMZ.13.76.G10.1.454.CMB.2.raw
  modified_base (615)..(615): a, c, t, g, unknown or other
  modified_base (624)..(624): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagcgtgggtggagtcgtgggaggaggcttgatccgagccgtggggggtccctgagactctcctgtgcagcctcgtgggttcaccgtcagtccacacctacatgagcgtcgggtcccgccgaggccgtaccggagggggaacgggggcgtagggaggtgggtagttcgggacctaagttaagttaaacgggactaacggaaccttaagtcgggcggacgaacacggaaccaacctaaccttaacccgttagaaaccgttacccgtaacaaaacggacctaagtactttcaaacttcaacgttcgtacggaaggtaggtactaacgttacccggaactaacgtacgggttctactctaccaatagtcgagcacggacctaaggtaaactccggaagaacaacgacggttacctaattacgtacgtgttcgnaggtaacgngtccggaccacggttaccctaaggttaagtttcgggg

SEQ ID NO: 380371 - DNA, 761 bp, Homo sapiens
  misc_feature: GZ8MTXP01CE3IY.13.76.G10.1.454.CMB.2.raw
tcagtcacgtactacacgaccggtgctcgatttagtcactcatacagggggggagaggagcccagcaccgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtgggttcaccgtcagtcacaccacatgagcgtcgggtcccgccgaggccgtacccggagggggaacggggcgtgggagttcgtccgtttctttcgttttttaatttagtaggttagttggtagtactactacctccgcgaggacccgtcccgggtgggcgggggcctagttccaccacttcctacccgaggaacgtaacctaaattacccgaaagtaacctacggtactttcgttttaccttacaaaagttcgaaactcggtaccccgttaggggaacggtacggaccccggtaagttacggaaccccggtacgggttacccggtttagtttacgttaaccgggttggtacggccgggtaaaggtacgggttaccggggtccgggggaaaccccctaaacggggttaaaccggtttaacccgacgggttaccttaaggggtccggggtaacccggttccggggtaccggggggacccgtaaaaccgggggcccctaacccggggg

SEQ ID NO: 380372 - DNA, 704 bp, Homo sapiens
  misc_feature: GZ8MTXP01DXXAS.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatcagccgtgggggtccctgagactctcctgtgcagcctcgtgggttcaccgtcagtcacacctacatgagcgtcgggtcccgccgaggcctccgagggaagtgggcgtgggagtgcgttctttcttttatttagtagtagtggtacgtacatacgtccgcaacgtaccgttccgggtgggacgggggtacccgtactttacccaaccgtactcctacccaaggacaactaacttaccaaagtaaccacgttacttcgtttactactaaagtcgaaacacgggtaccctagggaacgtacggacccgaagtcggaaccgtaccgggtccgttagttaacgtttccgtgggtaacggaccggaggaaacgggttcgggttacccgggggaccccttaaaccggggttaacccgtttaaccgtaaccggtacgttaacggttccggggaaccggttcggggtaaccgggggaaccggtaaaaccccggggg

SEQ ID NO: 380373 - DNA, 548 bp, Homo sapiens
  misc_feature: GZ8MTXP01EI66L.13.76.G10.1.454.CMB.2.raw
  modified_base (435)..(435): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggcagataaatatacttctggtatcagcagaagtcaaggccagtcccctgtgctggtcatctatcaagatgacaagcggccctgagggactcccccgtgacgcgtattctctcggcctaccaaactcgtaggggaacctcgacgccctactctcgaccagtcgacggaccgggacccaggctaagtggatgaggctaggtacttattacgngtcgaggcgtagggactggcagccaacgtcgcccgtcttagtcgtccgttacgggacgttacggggaacctaacggttcccgaacccgtcgttaaacgtccgaacgaaccccg

SEQ ID NO: 380374 - DNA, 612 bp, Homo sapiens
  misc_feature: GZ8MTXP01B2IDM.13.76.G10.1.454.CMB.2.raw
  modified_base (366)..(366): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagctgggtccgccaggctccgagggaggggctggagtgcgtcttcttttattatagtagtgtagtacatactcgcagaactcgngacggggccattcaccatctccagagactaataccaaagacacgtcttgtttctacaaatcgaacacgccgtaggaagtacgacccgatcggaaccgtaccgggtcccgttagtaagtttaccgtggtcggaacggaaggaggtacggttccgggggacccctaacggttaacccggttacttaccggcgttagtaacggggaccgttcggttacgggggaaccccgttaacgggggtaacccccg

SEQ ID NO: 380375 - DNA, 646 bp, Homo sapiens
  misc_feature: GZ8MTXP01EKU5K.13.76.G10.1.454.CMB.2.raw
  modified_base (249)..(249): a, c, t, g, unknown or other
  modified_base (477)..(477): a, c, t, g, unknown or other
  modified_base (489)..(489): a, c, t, g, unknown or other
  modified_base (538)..(538): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccgagccgtgggggtccctgagactctcctgtgcngcctcgtgggtcaccgtcagtcacacctacatgagcgtcgggtcccgccgaggcctaccggaggggaaggggcgtgggagtgtcgttctttctttttatttagtagtagtggtataccatactccgacacgtaaccgtccggtgggacggggtccgtattccaacctatccgtacccagacgaacctaaattcccgaaagaacctacgttctttagtttaccctaaanaaagtcgaaacncgtacgtagacgacgaccgagtcgaccgtcggtacgttattacttacgnggaggaacgaaggacggtacggttcccgggaaccctaacggttaacgtttcgacgtcgttaggtcgggtaaccggtcgggttacggggtaacccgaacggggtccccg

SEQ ID NO: 380376 - DNA, 608 bp, Homo sapiens
  misc_feature: GZ8MTXP01EXM5U.13.76.G10.1.454.CMB.2.raw
  modified_base (403)..(403): a, c, t, g, unknown or other
  modified_base (444)..(444): a, c, t, g, unknown or other
  modified_base (488)..(488): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtgggtccgccaggcctccgaggggagggctggagtgcgtcttcttttattatagtagtgtagtaccatactcgcacgaactccgtggacggggccgtattcacctatctaccaganaactaacttccaaagacacgtcttgttctacaaatgaaacncgcctgagacgccgatcgacgacggtccgttagtaactttacgngtcggaacgtaggaaggtacggttccgggggacccctaaacgggttaaaccgtttcgttaccgtcgtaggtcgggtaccggtacggttccgggggaacccgttaaagggggtaacccccg

SEQ ID NO: 380377 - DNA, 661 bp, Homo sapiens
  misc_feature: GZ8MTXP01AORW3.13.76.G10.1.454.CMB.2.raw
  modified_base (303)..(303): a, c, t, g, unknown or other
  modified_base (338)..(338): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtcgtccgtcgtccccaggacagacagccagcatcacctgctactaggaaaataagttggacaagaataaatctacttctgtatcagacagaagtcaggccacgtcccctgtcgctggtcatctatacaagntcgaccaacggccgccctgacgggtactcccccgnggacgcgtacttctcctcggtcctacctaaacgtccgtacgggtaaacctccgaacgtcccctaacttccgacgaaccctacgtaccggaaccgggacccgggaaccccgagggtacccgtaaggtcggtaagtacggtaacgggtcttaacggtaaccctttaagttaacccgtcggtaacggtacgggtcggtaacgggggaactacgggaccgtaccggcccgaacgtcgccccggttattaacggttcgtacgttaccggacgttaccgggaacctacgggtcctaaccgtaccgttacgtaacgaaccggtaaccccg

SEQ ID NO: 380378 - DNA, 651 bp, Homo sapiens
  misc_feature: GZ8MTXP01EOUGP.13.76.G10.1.454.CMB.2.raw
  modified_base (475)..(475): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgcttaattttaaaaggtgcccagtgtgaggtgcagcgtggtggagtcgtggaggaggcttgatccgaggccgtcgggggtcctgagactctcctgtgcagcctcgtggtcaccgtcacgtcacacctacatgagcgtcgggtcccgccgaggccgtaccggaggggaggggcgtggagtcgtcgttctttacttttattatagtagtgtagtaccatactcgcacgacgtccggtggacgggccgtacttccacctactctaccagaacgaactaattacccaaagactacgtctttagtttacctaacaaatgaaacncgtaccgtaggaacggcgaccgatcgaccgtaccgggtccgttagtactttacgtgggtcgaacggtaaggacggtacgggttcccggggaacccctaaaggttaacccgtttacgacggtcttaggtccgggtaccggtcgggttaccgggggaacccgaaacgggggtcccccg

SEQ ID NO: 380379 - DNA, 557 bp, Homo sapiens
  misc_feature: GZ8MTXP01CTG7T.13.76.G10.1.454.CMB.2.raw
  modified_base (390)..(390): a, c, t, g, unknown or other
  modified_base (396)..(396): a, c, t, g, unknown or other
  modified_base (424)..(424): a, c, t, g, unknown or other
  modified_base (451)..(451): a, c, t, g, unknown or other
  modified_base (478)..(478): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgaggggaagggggctggagtgcgtcttcttttattatagtagtggtagtaccatactcgcagaactcgtgaggggccattcaccatcncagaanacaatacaaagacacgtcttgttactanaaatgaaacacgacgtgagacgacganacgacgacggacgtagtattactgtgngagagacgacgggaccgaacgttaaacgttacgttacgtaactagtcggtacgtcggacgggtaaccggaacggaaccg

SEQ ID NO: 380380 - DNA, 756 bp, Homo sapiens
  misc_feature: GZ8MTXP01E2C4Z.13.76.G10.1.454.CMB.2.raw
  modified_base (504)..(504): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtctggaggaggcttgatccagccgtgggggtccctgagactctcctgtgcacgcctcgtgggttcaccgtcagtcacacctacatgagcgtcgggtccgccgaggcctccggaagggggaacggggcgtgggagtcgcgttcttacgtttttatttagttaggtaggttggtaagttactaacgtacctccggaacaacgtaaccgtcccgggtgggaacggggcccgtatttccgaacctactcctaccgaaggaacgaactaaacgttcccgaaaagaaccacgtcctttagtttaccctaanaaaagtcgaaaacgcggtacccgtagggaacgacggccccgaagttcggaaaccggtcccggtaccggtttagtttaaacgtttaacccgggtcgggtacggaaccgggtaaagggaacgggtaaaccggggttacccgggggaaaccccttaaaaccggggttaaacccgtttaaccgtaacccgggtaacgtttaacgggtccgggggttaacccgggttaaccgggggttaaccgggggtaaccccggg

SEQ ID NO: 380381 - DNA, 563 bp, Homo sapiens
  misc_feature: GZ8MTXP01DUF7X.13.76.G10.1.454.CMB.2.raw
tcagtcacgtactacacgaccggtgctcgatttagtcactcatacagggggaggctctgcttcagctgtgggcacaagaggcagctactcaggacaatctccagcatggcctggtctcctctcctcctcactctcctcgctcactgcacagggtcctgggcccagtctgtactgacgcagccgccctcagtgtctggggccccagggcagagggtcaccatctcctgcacgtgggagcagctccaacattggggcacattatgatgtacactggtaccagcagtttccaggagcaggtcccagactcctcatcaatacgtaacaacaacgtccggcccgacgacggggtccctagacccgattctctggactccaggtctggcacctcgacgccctcccgtggtcacttcacgtggaccttcggacggcgtggacggagtcgaggtctaggtattacgtttctcgtcctaacgttcccttagtcgacgaacggcaacggttccgttagtaagtcggtaaccgttcgggttacggttccggggtccgggggaacccgtaacggg

SEQ ID NO: 380382 - DNA, 702 bp, Homo sapiens
  misc_feature: GZ8MTXP01AQ6T9.13.76.G10.1.454.CMB.2.raw
  modified_base (170)..(170): a, c, t, g, unknown or other
  modified_base (292)..(292): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctctaggaaataatggacagataaatatacttctggtatcagcagaagtcaggccagtcccctgtgctggtcatctatcaagntgaccaagccggccctgacgggactccccccgtggacgtcgtattctacgtcggcctacccaaacgtcgtacgggaacctcgacgccctactctacgacctataccgacggacccgggaccccagggtccgtaagttagggaacgttgggaacgggtcttagggtaacctttaagttaccggtaggttcccggaagggggtccggttaacgggggaacctaacgggtaccgtaacggtcccgaaaccggttcccgggttccccgtacgtttaaacggttccggtttacccggtttaaccggggttaaaccggttaccgggggtaaacccccgttaaaggggttaacccccgtaaaccccgggttacccgttaaacgggttaaccccgaaacccgggtaaaccccccccgg

SEQ ID NO: 380383 - DNA, 675 bp, Homo sapiens
  misc_feature: GZ8MTXP01DC3LD.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctatttaaaggtgccagtgtgaggtgcagctggtggagtcgtggaggaggcttgatccgagccgtgggggtccctgagactctcctgtgcacgcctcgtcgggttcaccgtcagtcacacctacatgacgcgtggtcccgccgaggcctccggaagggggaacggggcgtagggagttcgtccggttctttacgtttttaatttagtaggttaggttaggtagtactattaacccgtccgaacaacgtaaccgtcccggtgggaacgggggccctacttccaacctactcctaccgaagaacgaactaaattacccgaaaagacctacgtctttagttaccttaaacaatacgaacgtacgtacgtagacgacgaccgtagtacggtaaccgtccggtcgtagttaacgtcgtaaggtcggacggaaggacggtaccgggtaccggaacccgttaacggttaaccgttaacgacgtcgtacggtacgggttaccggtaacgggaaccgggaaccg

SEQ ID NO: 380384 - DNA, 586 bp, Homo sapiens
  misc_feature: GZ8MTXP01EAFUJ.13.76.G10.1.454.CMB.2.raw
  modified_base (254)..(254): a, c, t, g, unknown or other
  modified_base (407)..(407): a, c, t, g, unknown or other
  modified_base (409)..(409): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgcttattttaaaaggtgcccagtgtgaggtgcagcgtggtggagtctggaggaggcttgatccagccgtgggggtccctgagactctcctgtgcacgntctgggtccaccgtcagtcacacctacatgacgcgtcggtccgccgaggcctccggaaggggaaggggcgtagggagtcgtcgttctttactttttatttatagtagtgtacgtaccatactcgcagacctcgtggacgggcctatcacgtancncagacgacaattaccaacgaaacaccgactacgtttacttacaaagttacgaaacaacgtaccgtacgagacgaccgatcgtaacgacggtccgtgtaacgttacgttgtgcgagagacgttcgggacccgaacggtaacggttaaccgtacgtacgttacgtaacggttaacgtcg

SEQ ID NO: 380385 - DNA, 643 bp, Homo sapiens
  misc_feature: GZ8MTXP01BMCPU.13.76.G10.1.454.CMB.2.raw
  modified_base (473)..(473): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtcgtggaggaggcttgatccagccgtgggggtccctgagactctcctgtgcagcctcgtgggttcaccgtcagtcacacctacatgagcgtcgggtcccgccgaggcctccggaaggggaacgggggcgtgggaggtcggtcgttctttctttttatttataggttagtggtagtaccatactccgcacgtaacctccggtggacggggcctattccacctactctaccagagactaacttaccaaagaacacgtcttagtttctacaaatgaaacngaccgtagagacgaccgagtcgaccgtacgggtccgttagtactttaccgtggtcggaacggtaggaggtacgttaccgggggacccctaacgggttaaaccgtttccgttacggccttaaggtcgggtaccggtcgggttaccgggggtaaccgaaacggggaaccccg

SEQ ID NO: 380386 - DNA, 596 bp, Homo sapiens
  misc_feature: GZ8MTXP01EUKTA.13.76.G10.1.454.CMB.2.raw
  modified_base (295)..(295): a, c, t, g, unknown or other
  modified_base (360)..(360): a, c, t, g, unknown or other
  modified_base (436)..(436): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtggggggtccctgagactctcctgtgcagcctctgggttcaccgtcagtcacacctacatgagctgggtccncaggctccgagggaggggctggagtgcgtcttcttttattatagtagtggtagtacatactccgnagaactccgtggaggggccgattccacatctccagagacaattccaaagacacgtcttgtttctacaaatgaaacngcctgagacgccgatcgaaccgacgggtcccgtagtactttaccgtggtggaacggaggttaggacggttccgggggacccctaacgggttaaccgtttacaccggcttaaagtgggtaaccggtcggttcgggggaacccgttaaacgggggaaccccg

SEQ ID NO: 380387 - DNA, 717 bp, Homo sapiens
  misc_feature: GZ8MTXP01AJS5T.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtgggtccgccaggctccggaggggaagggggctgggagtgcgttcttcttttatttatagttagtggtagtacctatactccgcaggaacctccggtggacgggggccagttccacctactcctaccaagtacgaacctaacttacccgaaaagtaaccctaccggtactttcggttttaccctttacgaaaaacttcgggaaaaaccccgcggtacccgggtaagggaaccggtaccggacccgtaaggtaccggaacccggtaccgggttaccgtttaaggttacttacggtgggtacggaacgggtaacgggaagggtccgggttacccggggaaccccgtaaccgggttaaccgttaccgttaccggtaacgttaggtccgggtaccgggtaccgggttacggggaacccggaaccgggtaacccg

SEQ ID NO: 380388 - DNA, 875 bp, Homo sapiens
  misc_feature: GZ8MTXP01C0VFZ.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtgggaggaggcttgatccaggccgtgggggtccctgagactctcctgtgcagcctcgtgggttcaccgtcagtcacacctacatgacgcgtcgggtccgccgacggccgtccggaagggggaacgggggcgtagggggacggttcggtccggtttaccttttacttttttaagttttaagttaagggtttaaggttacggggttaaacggttaacccctaacgtttaccgttcccggaccgtaacggtaaaccccgttcccgggttggggaaccggggggtcccgtaaacgtttcccaacccgtacttcccgtaacccgaaggtaaaccgtaaacctaaacgtttaaccccgaaaacggtaaacccgtaaccgggttaccttttacggtttttaacccttaaacctaaaaaagttacgggaaaaccctaccgggttacccggttaaaggggaacggggtaccggaaccccggtaagttacccgggaaacccgtaccgggggtacccggtttagttaaaccgtttaccggtggttaacgggaacgggtaaaggacgggtaaccgggttccgggggaaaccccgtaaaccggttaaaccgtttacgttaccgggtcttaacggtcggggtaaccggttcgggttacgggggaacccgaaacgggggtaacccccgg

SEQ ID NO: 380389 - DNA, 679 bp, Homo sapiens
  misc_feature: GZ8MTXP01BDTTM.13.76.G10.1.454.CMB.2.raw
  modified_base (375)..(375): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtgggttcaccgtcagtcacacctacagtgagccgtcgggtcccgccgacggcctaccggaggggaaggggcgtgggagtgtcgttctttcttttattatagtagtggtagtaccatacnccgcacgaactccgggtggacgggggcctagttccacctatcctaccgagaacgaaccgtaaacttaccgaaacgtaaaccgtaccgttcgtttagttttacccttaaactaaaacgttacggaaaccacggtacccggtagaacggtacgacccgtagtacgaaccgaccggtcgtacgttacttagtcggtggaaccgtaaggacgggtacggttcccgggggaaccccaacggttaaccgttacttacgtcgttagtcggggtacggtcggttacggggaaccgttaacgggtaaccccgg

SEQ ID NO: 380390 - DNA, 659 bp, Homo sapiens
  misc_feature: GZ8MTXP01C5FEY.13.76.G10.1.454.CMB.2.raw
  modified_base (379)..(379): a, c, t, g, unknown or other
  modified_base (443)..(443): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtgggtcccgcaggctccgaggggaggggctggagtgcgttctttcttttatttatagtagtggtagtaccatactccgcacgaacttccgnggacgggccattcacactcaccagagaactaattccaaagtaaccacgtcttagtttaccttanaaaagttgaaaaccgtcgacccgttaggaacggaacggaccccgtaagtcggaacccgaccggggtacccgttaggtttaacttaccgtggtcggaaccggaagaggtacggttccgggggtaaccccacgggttaaaaccgtttccggttaacgtccgtaaggtcgggtaccgggtacggttcgggggtaaccccgaaagggggttaacccccgg

SEQ ID NO: 380391 - DNA, 642 bp, Homo sapiens
  misc_feature: GZ8MTXP01DALGS.13.76.G10.1.454.CMB.2.raw
  modified_base (463)..(463): a, c, t, g, unknown or other
  modified_base (477)..(477): a, c, t, g, unknown or other
  modified_base (525)..(525): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgacgactctcctgtgcagcctcgtgggttcaccgtcagtcacacctacatgagcgtcgggtcccgcgacggcctccggaggggaagggggcgtggaggtgtcgttctttctttatttatagtagtggtataccatactcgcagacgtcggtggacgggcctagttccacctctcctaccagaacgaactaacttaccgaaagaacctacggtctttgttttaccctaanaaaagttcgaaacncgtccgtaggagaccgccgaagtcgaccgacggtcctagtacgttcgnggtcgaacgagacgggtcgttaccgggggaacccctaagggttaaacccgtttacttacgggcttaaggtccggggtacgttccgggacgggggaacccaaacgggggtaacccccg

SEQ ID NO: 380392 - DNA, 644 bp, Homo sapiens
  misc_feature: GZ8MTXP01C3N43.13.76.G10.1.454.CMB.2.raw
  modified_base (372)..(372): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctggggttccaccgtcagtcacacctacatgagcgtcgggtcccgcaggcctccgaggggaagggggctggagtgcgtctttcttttatttatagttagtggttagtaccatactccgnagaaccttcgtggacggggccgacttcaccatctaccgagagaacaacttccaaaggtaaccacgttacttgttttacctacaaaatcggaaactacgccgttagaacgacggacccgaaagtcgaaccgtacgggtcccgttaggttaaattaccgtgggtcggaacggtaaggaggtacgttaccggggggaccccaacggttaaaccgttacgttacgtccgtaagtcggggacgtcggttacgggggaacccgaaggggtaaccccgg

SEQ ID NO: 380393 - DNA, 555 bp, Homo sapiens
  misc_feature: GZ8MTXP01A0W49.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctggtcaccgtcagtcacacctacatgagcgtgggtccgcaggctccgagggaggggctggagtggattggcctagtattaaggacacgacctaatcggacgcgacagccactctaccttagaactccgtacaaagacagtattcatcatcagagaggtgacttaccgacaacgacgtacgtctcgtacctatatgacgcacgtcctagaaactcgaacgacaacgtacggcctagttacttacgtgttcgcgttaggtgacgtcgggccctacggaccctaacggttaaccgttttaagggg

SEQ ID NO: 380394 - DNA, 639 bp, Homo sapiens
  misc_feature: GZ8MTXP01ASHCJ.13.76.G10.1.454.CMB.2.raw
  modified_base (287)..(287): a, c, t, g, unknown or other
  modified_base (600)..(600): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgcttattttaaaaggtgcccagtgtgaggtgcagcgtggtggagtcgtggaggaggcttgatccgagccgtgggggtcctgagactctcctgtgcacgcctcgtgggttccaccgtcagtcaccacctacntgagcgtcgggtcccgccgaggcgtccggaggggacggggcgtgggagtcggtcgttctttactttttagttattagtagtggtacgtacctatactcgcacgtaacgtccggtggacggggacctactccgacctactcctaccagacgaactaacttaccaaagaacctacgtctttacgtttactaacaaagtacgaaactcgtaccgtaggaacgacggtaccgagtccgacggaccggtacgttgttaacttcggtgtcgggaacaagggaggtacggttccgggaaccctaacggttacgttcacgntaggcgggcgttcggacggggaaccgaacgggtaacccg

SEQ ID NO: 380395 - DNA, 667 bp, Homo sapiens
  misc_feature: GZ8MTXP01BITXU.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctatttaaaggtgcccagtgtgaggtgcagctggtggagtcgtggaggaggcttgatccagccgtggggggtccctgagactctcctgtgcagcctcgtgggttcaccgtcagtcacacctacatgagcgtcgggtcccgccgaggcctaccggaaggggaaggggacgtgggagtggcgttcttctttttattatagtagtggtagtaccatactccgcacgaactccgtggacggggcctattcacatctaccagagacctaattccaaagaactaccggtctttacgtttaccttaacaaaacgtcgaaacgacgccgttagggaacgacgacccggtaatcggaacccgtaaccgggtcccgttagttaacgttacgtggtacggaaccgggaaggacgggtacggttaccggggggacccctaaacgggttaacccgtttacgaccggtaaccgtaggtcgggtaccggtcggttaccgggggaaccgaaacgggggtaaccccg

SEQ ID NO: 380396 - DNA, 626 bp, Homo sapiens
  misc_feature: GZ8MTXP01CJ9K0.13.76.G10.1.454.CMB.2.raw
  modified_base (172)..(172): a, c, t, g, unknown or other
  modified_base (214)..(214): a, c, t, g, unknown or other
  modified_base (238)..(238): a, c, t, g, unknown or other
  modified_base (471)..(471): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctntaggaaataatggacagataaatntactctgtatcagcagaagtcagccagtcccctgtcgctggtcatctatcaagactcgaccaacggccggtaccctaggacgggtactccccccgtaggacgtcgtacttccgtaacgttcggcctacccgtaaacttcggtacgggaaacctcgacgaccctacttcacggaacctcgtaccgacggacccgggaaccagggtacctaagcggaatgacggtctgtaacttnttaacgtgtaccgaggcggtacggggaacctgacgacggccaaccggttcgacccgtcgttacgttcggttaccgttaccgggaccggttacggggtaaccctaagggtcccgtaaccggttaccgttaaacggtcccgaaccgggtaacccccg

SEQ ID NO: 380397 - DNA, 604 bp, Homo sapiens
  misc_feature: GZ8MTXP01E2WND.13.76.G10.1.454.CMB.2.raw
  modified_base (436)..(436): a, c, t, g, unknown or other
  modified_base (446)..(446): a, c, t, g, unknown or other
tcagtcacgtactacacgaccggtgctcgatttagtcactcatacaggggtgggagaggagcccagcactgggattccgaggtgtttccattcggtgatcagcactgaacacagaggactcaccatggagttttggctgagctggattttcctcgctgctattttaaaaggtgtccagtgtgaggtgcaagtggtggagtcgtggggggggcttggttaagccgtgggggtccctcagactctcctgtgcaacctctggattcattttctctgacgccttggtgagctgggtccgccgaggccgtcccggggaagggccgtgggacggtggggttggaccggttaagttaaagggtagaaagacgaagtggtacgaacaacagacctacgagtcgttcccgagaaaagggcaagtattcacttatctacgaagtanatagaactanaaaagaatgaatatatctagacaaatagaaacgaaaccgtaagaaaggaacgaaggaacgaacgacggacgtagtattactacgtacacaagagttggcgagagagacgagacggcgacggaacgtacgtacgacgtaacggttcggggaacccgggg

SEQ ID NO: 380398 - DNA, 621 bp, Homo sapiens
  misc_feature: GZ8MTXP01A80N2.13.76.G10.1.454.CMB.2.raw
  modified_base (537)..(537): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctgtgggttcaccgtcagtcacacctacatggagcgtgggtcccgccgaggccgtcggaagggggaaggggtcgtgggagtcggtcgttcttactttttatttagtagttagtggtagtactagtactccgacacgcgtccgtggacggggcctattcacatcctacagacgaactaattaccgaaagaactacgtacttgtttactacaaatcgaacgacgctagaacggacgaccgagtggaaccgcgggtcccgttagttacttacgtgtcggcgtaaggnggacgggtaccggggaccccgttaaacggttaaccggttaaccacggtaaccgtaggtcgggaccgttcgggcggggaacccgg

SEQ ID NO: 380399 - DNA, 660 bp, Homo sapiens
  misc_feature: GZ8MTXP01DQMRR.13.76.G10.1.454.CMB.2.raw
  modified_base (434)..(434): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtgggttcaccgtcagtcacacctacatgagcgtcggccgccgaggctccggaggggaaggggcgtggagtcgtcgttctttacttttatttataggttagtggtagtaccatactccgcacgaacctcgtggacgggccgattccacactctacaagagaactaataccaagaaaccncgtcttagttttaccacaaatcggaaactgccgtaggacgtacgaccgtatccggaaccgtacggggtccgttagttaaccttacgtggtggaaccggaagttacgggtacgggttaccggggaacccctaacggttaaaccggtttaccttaccggtaaggtttaacgtccggggtaacgttcggggttaaccgggggaacccggttaaaaccggggtaaccccg

SEQ ID NO: 380400 - DNA, 588 bp, Homo sapiens
  misc_feature: GZ8MTXP01EWR18.13.76.G10.1.454.CMB.2.raw
  modified_base (380)..(380): a, c, t, g, unknown or other
  modified_base (500)..(500): a, c, t, g, unknown or other
  modified_base (514)..(514): a, c, t, g, unknown or other
tcagtcacgtactacacgaccggtgctcgatttagtcactcatacaggggggagaggagcccagcactgggattccgaggtgtttccattcggtgatcagcactgaacacagaggactaaccatggagttttggctgagctgggttttccttgttgcttattttaaaaggtgcccagtgtgaggtgcagctggtggagtctggaggaggcttgatccagccgtggggggtccctgagactctcctgtgcagcctctgggttcaccgtcagtcacacctacatgagcgtcgggtcccgccaggcctccgaggggaaggggctgggagtgcgttctcttttatttatagtagtggtagtacactactcgcagcctccgtggnggggccatccaccatctccagagacaattccaaagaacacgtcttcgtttactacgaaattgaaacagccctaggggacgtacgacccgatcgaaccgacggggccttaggtacttacgngtcggcgaaggagngtcggggacccaggtaacgttacgcgttctaagtcgggaacgtcgtagggggaccctaaggggccgtaaccggg

SEQ ID NO: 380401 - DNA, 578 bp, Homo sapiens
  misc_feature: GZ8MTXP01C4TH3.13.76.G10.1.454.CMB.2.raw
  modified_base (331)..(331): a, c, t, g, unknown or other
tcagtcacgtactacacgaccggtgctcgatttagtcactcatacagggactgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataaatggacagaataaatatacttcctggtatcagcagaagtcaggccagtcccctgtgctggtcatctatacaagatcgaccaaggccggccctagagggacctcccccgnggacgcgtacttctccgtcgggtctacccgaaccttcgtacgggaacctcgacgcccactcgacaccatcgacggaccggacccgaggtacctagacggtagtacgacggtcgtacgtacttaacgttacgtcgttacggcgggtcggtagggaactggcacgcaacgtcgcccgtcttagtcgttacgttacggacgttcgggaacctacggtcctacccgtacgttacgtccgaacgtaaccccg

SEQ ID NO: 380402 - DNA, 610 bp, Homo sapiens
  misc_feature: GZ8MTXP01DSCG0.13.76.G10.1.454.CMB.2.raw
  modified_base (393)..(393): a, c, t, g, unknown or other
  modified_base (402)..(402): a, c, t, g, unknown or other
  modified_base (444)..(444): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggtcaccgtcagtcacacctacatgagcgtcgggtcccgcgaggctccgaggggaaggggctggagtgcgtctttcttttattatagtagtgtagtacatactccgcagaacctccgtggacggggcctattcaccntctacaganacaatccaagaactacgtcttgtttctaacaaaatcgaaacncgccgtagagacgacccgtatcgaccgtacgggtaccgttgtacttacgtggtcggaacggaaggacggtacggttccgggggaacccctaacgggttaaaccgtttacgacggtctaaggtcgggtaccgtcgggttacgggggaacccaaacgggggtaacccc

SEQ ID NO: 380403 - DNA, 711 bp, Homo sapiens
  misc_feature: GZ8MTXP01BJ1TS.13.76.G10.1.454.CMB.2.raw
  modified_base (298)..(298): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatccgagtccgtgggggtcctgagactctcctgtgcacgcctcgtggtcaccgtcagtcacacctacatgagtcgtcgggtccnccgaggccgtaccggaggggaaggggcgtgggagtcgtcgttctttacttttaagtttagtagtagtggtactaccatactccgcacgaacctccggtggacgggtccgtacttaccgacctactcctaccaagtacgaactaaacttaccgaaaacgaactaccgtcgtttacgtttacctaataaaacgtcgaaacctacggtacccgtaggaacgaccggaccgtaacgtcggaaccgtaccgggtccgttaagttaccgtttacgtcggttacggaaccggtaagggttacggtacggttacccgggggaaccccctaaagggttaaccccgtttacgacccgtaacgttaacgggtcgggtacccggttacgggaccgggggaaccccttaaacgggggtaacccccg

SEQ ID NO: 380404 - DNA, 779 bp, Homo sapiens
  misc_feature: GZ8MTXP01BDC24.13.76.G10.1.454.CMB.2.raw
  modified_base (184)..(184): a, c, t, g, unknown or other
  modified_base (213)..(213): a, c, t, g, unknown or other
  modified_base (245)..(245): a, c, t, g, unknown or other
  modified_base (280)..(280): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcgtggtttcgtgtagctatttaaagtgccagtgtgaggtgcagntggtggagtctggaggaggtcttgatccngccgtgggggtccctgagtctctcctgtgccncgtcgtcgtcggtaccaccgtcacgtcacacctanagtgacgtcgtccggaccgacgacggccgtacggggaaggggacgggtcgtaggtacgtcggttaccgtttacttttagttttaagttaagttaggttaacggttacggttaacgtaacccctaccgttaccgtaccgacgtaacggtaacccgttcccgggtaacgggtaccgggtaccctaacgttacccctaaccgtacgttaccgtaaccgaagtaacgtaaaccgtaaaccgtaaccgtaaacgtaaaccgtacgttaccgttacgtttacttaacgtaaacgtaacgtaacgtacgtacggtacggtaacggtacggacgtacgtaaccggtaccggtaccggtacggttacgttacgttacgttcgtggtaacggtaaggttacggtacggttaccgggtaacccggtaaccggttaaaccgttacgttaccgtaacgtacggtaacggtacggtaccgggttaccgggtaacccgggaaccgggtaaccgg

SEQ ID NO: 380405 - DNA, 585 bp, Homo sapiens
  misc_feature: GZ8MTXP01EILEK.13.76.G10.1.454.CMB.2.raw
  modified_base (454)..(454): a, c, t, g, unknown or other
  modified_base (515)..(515): a, c, t, g, unknown or other
  modified_base (523)..(523): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacactacatgagctggtccgccaggctccggaggggaggggctgggagtcgtcgttcttactttttattagtagtagtggtagtacatactcccgcacgcgttccggtggaacggggcctattcactactctaccagacgaactaacttccgaaaagaactacgtcttacgttccttaanaaattcgaaacggacgccttagacgaacgcccgagtcgaacgaccggtcgtagtattacgngtgcgagngtacggtcgggacccgacgttaacgttaacagtctagtcgggacgtcggttcggggaacccg

SEQ ID NO: 380406 - DNA, 793 bp, Homo sapiens
  misc_feature: GZ8MTXP01BCD8H.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgcttattttaaaaggtgcccagtgtgaggtgcagcgtggtggagtcgtggaggaggcttgatccaggtccggtggggggtccctgacgaccttctccgtgtgcagcctcgtcgggtcctaccgtcagtcaccacctacatgacgcgtcggtccggccgacggcgtccggacgggacggggcgtggagtcgtcgttcgtttcttttagtttattagttagtaggttacgtaacctactacgtccgtacgacgtaaaccgtccggtcgggacggggtacccggtacttacccgtaactacgtactacccgaagaacgtaaactaaacttaaccgaaaacgaaactacccgttacgtttcgtttaactaaccgaaaaagttacgaaaaccgcggtccggttaacggaaggaaccgaccccgggttaaactaccgggaaccggtaccggttaaccggtttagttacgtttaacggtcgggacggtaacggaaacggttaaggggtacccggaacccgggggtaacccccgttaaacgggttaaaaccgtttaccgttaaccgggtaacgttacgggttaaccggggtccgggttacccgggggttaacccgggggtaaccccgttaaacccggggtaacccg

SEQ ID NO: 380407 - DNA, 684 bp, Homo sapiens
  misc_feature: GZ8MTXP01ARX5Y.13.76.G10.1.454.CMB.2.raw
  modified_base (484)..(484): a, c, t, g, unknown or other
  modified_base (496)..(496): a, c, t, g, unknown or other
  modified_base (552)..(552): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgcttattttaaaaggtgcccagtgtgaggtgcagcgtggtggagtcgtggaggaggcttgatccaggccgtgggggtccctgagactctcctgtgcagcctcgtgggttcaccgtcagtcacacctacatgagcgtcgggtcccgccgaggccgtccggaggggaacggggcgtgggagtgtcgttctttcttttagtttatagtagtggtagtaccatactccgacacgaaccgtccggtgggacggggtccgtattccaccgtactcctaccgaagaacgaactaaacttacccgaaaagtaaccctacgtctttagtttacctaanaaaatcgaaacncgtctaggacgacgaccgtagtccggaaccgtacgggtccgttagttaacttacgnggtacggaacggtaaggacggtacggttccgggggaacccctaaagggttaaaccgttccgttaacggtccgttaaggtccggggtaaccggtcgggttaccgggggtaacccgaaacgggggtaacccccg

SEQ ID NO: 380408 - DNA, 693 bp, Homo sapiens
  misc_feature: GZ8MTXP01A6WNZ.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctatttaaaggtgccagtgtgaggtgcagctggtggagtcgtggaggagacttgatccaggccgtgggggtccctgagactctcctgtgcagcctcgtgggtcaccgtcagtcacacctacatgagcgtcgggtcccgcgacggctccggagggggaacggggcgtgggagtcggtcgttctttctttttatttagttagtaggtaggtaagtacctactacgtccgacacgtaaccgtccgggtggacgggggtccctacgttaccaccgactcctacccgaagtacgaaacctaacgttaccgaaaaggaccctaacggtcttttacgtttacctacgaaaacttcggaaacctacgcccgttaggaacgacggacccgtaagtaccggaaccgaccgggttaccgttaggtaccttaacgtgggtacggaacgtaaggacggtacggttccggggaacccctaacggttaaccgttcgttacgtgttaggtcgggaacggttcgggacggggtaacccgaacgggtaaccccg

SEQ ID NO: 380409 - DNA, 721 bp, Homo sapiens
  misc_feature: GZ8MTXP01CTZBW.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagcgtggtggagtcgtgggagggaggtcttgactccgaggccggtcggggggtccctgacgtacctctcctgtcgcacgtccttcgtacgggttccaccggtcacgtccaccacctacatgacgtcgtcgggcccgcgaggccgtcggaagggggaacgggggccggaggtcgtcgttcgtttactttttaattagttaggttagtaggtaacgtactacctaccgtccgacgtacgtaccgtcccgggtaggaaccgggggcctacttacccacctacttcaccgaagacaactaacttaccaaagtacaccgtctttagtttcctaacgaaagtacaaaccgagtcctaggggaacgacggccgtacgtcgaaccgtacccggggttcgttacgttacttacggtggacggacggaagacgggttacgggtacccgggaacccgtaaacggtaacgttaccgttcgttacgttaacggtacgggtaaccggtcgggtaccggggaacccggtaaccgggttcccgtaacccgg

SEQ ID NO: 380410 - DNA, 578 bp, Homo sapiens
  misc_feature: GZ8MTXP01DHJO1.13.76.G10.1.454.CMB.2.raw
  modified_base (360)..(360): a, c, t, g, unknown or other
  modified_base (376)..(376): a, c, t, g, unknown or other
  modified_base (484)..(484): a, c, t, g, unknown or other
  modified_base (496)..(496): a, c, t, g, unknown or other
tcagtcacgtactacacgaccggtgctcgatttagtcactcatacagggggggagaggagcccagcactgggattccgaggtatttccattcggtgatcagcactgaacacagaggactcaccatggagttttggctgagctgggttttccttattactattttaaaggtgtccagtgtgaggtgcagttggtggagtctgggaggaggcttgggtccgaggcccgggggggtccctggagactctcatgtgcggcctcgtgggctcacccgtcaaacacccaactacatgagctgggtccgccaggctccgagggaagaggccggagtgggtctcagttatttatgtcgacggtgccanttctacgcagctccgnggaacggggccgttcaccgatctccagacgactaaattccaaagaacacggtgtatacttacaaatcgaacgacctgagagtcgaggggacacgggcctctattacgngtgacgaaagtntgcagaagcgggccccgtaagcggggctgggttggttggtttcttgtttgcgttggcgttcggggccaacggggtaaccccg

SEQ ID NO: 380411 - DNA, 592 bp, Homo sapiens
  misc_feature: GZ8MTXP01A4YZ1.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtcctgagactctcctgtgcagcctcgtgggttcaccgtcagtcacacctacatgagcgtgggtcccgccaggcctccgaggggaaggggctgggagtgcgtcttcttttattagtagtagtggtagtacatacctcgacagctcgtggacgggcctatcactatcctaccagacgacaattcccaaagactacgtctttagttcttaacaaattcgaaaccaggaccctagaacggacgacccgagttcggaacctacggggtccttagtaacttcggtgtcggacggagagacggtccggggaccccaaggttaaccgttcgtacgcgtaagtcgggacgttcggttaacgggggaacccg

SEQ ID NO: 380412 - DNA, 563 bp, Homo sapiens
  misc_feature: GZ8MTXP01CP1WJ.13.76.G10.1.454.CMB.2.raw
  modified_base (336)..(336): a, c, t, g, unknown or other
  modified_base (497)..(497): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtcgggtcccgccgaggctccgaggggacggggcgtggagtgcgttcttntttattatagtagtgtagtaccatactcgcagaactccggtggacgggccattcaccatctccagacgaacaattaccaaagaccacgtcttagttctacaaatgaaactagcctggaacgcgaccgatcgacacggtccgtgtattacgtgtgaacgagngacgttcggggaccctagaacgttcacgtctagtcggacgtcgacggggaaccgaacgggtaaccg

SEQ ID NO: 380413 - DNA, 584 bp, Homo sapiens
  misc_feature: GZ8MTXP01A1BV1.13.76.G10.1.454.CMB.2.raw
  modified_base (170)..(170): a, c, t, g, unknown or other
  modified_base (292)..(292): a, c, t, g, unknown or other
  modified_base (518)..(518): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctctaggaaataattggacagataaatatacttctggtatcagcagagtcaggccagtcccctgtgctggtcatctatcaagntgaccaagccggaccctgacgggtactccccccgtgacgcgtactttcctacgtcggcctaccgaaacgtcgtacgggaacctcgacgaccctactctacgacctagtccgacggacccgggacccaaggtcctagtaggagttacggacgggtacctaggtaacttagttaaccgtggtaccgagggtccgtaggggactaaggcaacgcccaacgtcgcccgtnttagtcgtcgttacgggacgttcgggaactaacggtccaccgtacgttacgtccgaacgaaccccg

SEQ ID NO: 380414 - DNA, 557 bp, Homo sapiens
  misc_feature: GZ8MTXP01BVV4P.13.76.G10.1.454.CMB.2.raw
  modified_base (298)..(298): a, c, t, g, unknown or other
  modified_base (425)..(425): a, c, t, g, unknown or other
  modified_base (432)..(432): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctatttaaaaggtgcccagtgtgaggtgcagctggtggagtcgtggaggaggcttgatccagccgtgggggtcccctgagactctcctgtgcaggcctctgggttcaccgtcagtcacacctacatgagctgggtccnccaggctccgaggggaaggggctgggagtgcgttcttctttatttatagtagtccggtagtacagtactccgacagctcgtgagggccgattcacatctccagagacaattccaaatacaagccttnttactanaatgaacgacgcgtagacgacgcgagcgacgcgtcgtattacgttagtgtcgagaggagtacgtcgggacccacggttaacgttaacgtacgtaactagtcggttacggtcggttcggggaaccg

SEQ ID NO: 380415 - DNA, 776 bp, Homo sapiens
  misc_feature: GZ8MTXP01AQTR6.13.76.G10.1.454.CMB.2.raw
  modified_base (654)..(654): a, c, t, g, unknown or other
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtggtccaccgtcagtcacacctacatgacgcgtcggggtcccgccgacggccgtaccggaagggggaacgggggcgtaggggaggttcggtccggtttctttacgtttttagtttaagttaggttaggttagggttaacgtactattaccgtcccgactaaacggacccgttccgggtagggacgggggtcccgtacgtttaccaaccctattccctacccgaagaacggtaaacctaaacttaccccgaaaaggtaaccctacggttaccttagtttttaaactaaccgaaaaattcggaaaaccacggggtacccgttaagggaacggtaccggacccgtaagtaccgggtaaacccgtaaaccggggtcccggtttagttaaacgttttaccgngggttaaccggaacggttaaagggaacggttcgggtacccgggggaaccccttaaagggttaaccgtttacgaacggtctaagtcgggacggttcggtaacgggggaaccctaaaccggggg

SEQ ID NO: 380416 - DNA, 851 bp, Homo sapiens
  misc_feature: GZ8MTXP01D0JU8.13.76.G10.1.454.CMB.2.raw
tcagtcacgtactacacgaccggtgctcgatttagtcactcatacagggggcccagcactgggattccgaggtgtttccattcggtgatcagcactgaacacagaggactcaccatggagttttggctgagctgggttttccttgttgctattttaaaaggtgccagtgtgaggtgcagctggtggagtctggaggaggcttgatccagccgtgggggtcctgagactctcctgtgcagtcctcgtgggttcaccgtcagtccacacctacatgacgcgtcgggtccgccgtacggccgtaccggagggggaaggggcgtagggagtggtccgttctttacttttttaagttttagttaaggttaggttaggttaacgttaactacgtaccgtccccgacgtacggtacccgtccgggtacgggaaccggggggtaccctaacgtttacccaaacccgtaacttacccgttacccgaaacggtaaacggtaaaccctaaaccgtttaacccgaaaaaggtaaaccccgtacgggttacctttttacggttttttaacccttaaacctaaaaagttacggaaaaccgtaacgttaccccgttaagggaaacgggttaacggggaaccccggttaagttaccgggaaacccggtaccgggtcccggtttagttaacgttttacccggtaggttacgggaccggaaagggtacgggtaacggttccgggggaaccccgtaaacggtttaaaccggtttaaccgtaaccggttcgttacgttacggggtaaccggttcgggaaccgggggtaacccgaaacggggttcccgtaaccggggttccctaaccccggg

SEQ ID NO: 380417 - DNA, 626 bp, Homo sapiens
  misc_feature: GZ8MTXP01DV4PE.13.76.G10.1.454.CMB.2.raw
  modified_base (363)..(363): a, c, t, g, unknown or other
  modified_base (391)..(391): a, c, t, g, unknown or other
  modified_base (400)..(400): a, c, t, g, unknown or other
  modified_base (432)..(432): a, c, t, g, unknown or other
  modified_base (444)..(444): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtccacacctacatgagctgggtccgccgagcgtccgaggggaagggctggagtgtcgtctttcttttattatagtagttggtataccgatacncgcagactccgtggacggggcatcaccntctccaganactaatccaaagacacgtcttattccctaaanaaagtacgaacncgtacggtaggacgtacgacgagtacggaccgtacggtccgttaagttacgttacgtgggtacgaacggaaaggttacgggtaccgggttacccgggaaccccgtaacgttaaaccgttccgttacggtaacgtacggtcgggtaccgggtccgggacggggtaacccgaaccgggtaaccg

SEQ ID NO: 380418 - DNA, 579 bp, Homo sapiens
  misc_feature: GZ8MTXP01C692T.13.76.G10.1.454.CMB.2.raw
  modified_base (300)..(300): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgcttattttaaaaggtgcccagtgtgaggtgcagcgtggtggagtcgtgggaggaggcttgatccagccgtgggggtccctgagactctcctgtgcagcctcgtgggtcaccgtcagtcacacctacatgagcgtcgggtcccnccgaggcctccgaggggaggggctggagtgcgtctttcttttatttagtagtagtggtatacatactcgcagacctcgtggacgggcctattcaccatccgtaccagaagactaattcccaaagaaccacgtctttgtttacctacaaatgaaaactcgaccgtaggacggtacgcccgtaatcgaccgtacgggccttagtacttactggtcgaagagagcgttcggggacccctagaacgttcacgctagtggacgtgttcggggccaaggggtccc

SEQ ID NO: 380419 - DNA, 627 bp, Homo sapiens
  misc_feature: GZ8MTXP01BLRGB.13.76.G10.1.454.CMB.2.raw
  modified_base (464)..(464): a, c, t, g, unknown or other
  modified_base (577)..(577): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtgggttcaccgtcagtcacacctacatgagcgtcgggtcccgccgaggcgtccgaggggaaggggcgtggagtgtcgttctttctttttatttagtagtagtggtagtaccatactccgcagaacgtccgtggacggggcctattccaccatctaccagagaccaattccaaagaacacgtctttagtttacctacgaaaatcgaaacncggccgtagaacggacgccgaatcggaccgacgggtaccgttgttaacttacgtgtggaacggtagaggacgttccgggggaccccaaacggttaaccgttacgttaccggtntaacgtcgggtacgtcggttacgggggaacccttaaacgggggaaccccg

SEQ ID NO: 380420 - DNA, 626 bp, Homo sapiens
  misc_feature: GZ8MTXP01ARYFD.13.76.G10.1.454.CMB.2.raw
  modified_base (271)..(271): a, c, t, g, unknown or other
  modified_base (298)..(298): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtctggaggaggcttgatccagccgtggggggtccctgagactctcctgtgcagcctcgtgggttccaccgtnagcacacctacatgagcgtgggtcccncaggctccggagggaggggctggagtgcgtcttcttttattatagtagtgtagtactatactccgacagtcctcggtgacggggtcccattccgacatcctcaagacgactaacttacaaacgactacgtcttacgtttactacaaatcgaaacgcgtcctggaaagtacgcccggaattacggaaaccgtccgggtcccggttgttaaacgtttccgtgggttacgggaccggtaaggacggtaggtaccgggggaccccttaaacggttaacccgttaagtaccgtcttaggtacgggttaccgttcggttaacgggggaacccgg

SEQ ID NO: 380421 - DNA, 644 bp, Homo sapiens
  misc_feature: GZ8MTXP01C07IC.13.76.G10.1.454.CMB.2.raw
  modified_base (306)..(306): a, c, t, g, unknown or other
  modified_base (370)..(370): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagtcttgggtttttccttgttgcttaattttaaaaggtgcccagtgtgaggtgcagctggtggagtcgtggaggaggcttgatccagccgtgggggtccctgagactctcctgtgcacgcctcgtcgggttcaccgtcagtcacacctacatgagcgtggtcccncgaggctccggaggggagggctggagtgtcgtcttatttattatagtagtcggtatacataccncgacagcgtcgtaggacgggcctatccactactctacagaacgaactaacttaccaaagaccacgtcttagtttactacaaatcgaaacgacgtccgtagaacgacgacccgtagtacggaaccgtccgggtccgttagttacttaacgtggtacggacggaaggaacggtacggtccgggggttaacccccttaacgggttaaacccgttaaccgtaccggtaacttaacgggtcgggttaaccggttccgggttaaccgggggtaaacccgg

SEQ ID NO: 380422 - DNA, 781 bp, Homo sapiens
  misc_feature: GZ8MTXP01EX7CQ.13.76.G10.1.454.CMB.2.raw
  modified_base (277)..(277): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccgagccgtcggggggtccctgacgactctcctgtcgcctaccctcgtcgggttcaccgtcngtcacacctacatgagcgtcgggtcccgccgtacggccgtaccggagggggaacggggcgtagggaggttcggtccgtttctttacgttttttaatttagtaggttaggttaggttacgtactacttacctccgacgacgtacccgtaccgggtcgggaacggggtccgtaacttacccaccctaacttccgtacccaagggtaacaaaccttaaacttacccgaaaaggtaaccctaacggttcttttacggttttacctaaaccgtaaaagttacggaaacctacgggtccctagggggaaacggacgacccgtaagtaccggaaccgaccgggtccgttaagttacgttaacgtggtcgaacggaaggaacggttacgggtacccgggggaaccctaaacggggttaaaccgttacccgacggttacctaaggggttcgggtaaccgggttacccggggtcggggggaaaccccaaacggggggttcccccgtaacccggg

SEQ ID NO: 380423 - DNA, 660 bp, Homo sapiens
  misc_feature: GZ8MTXP01EGTIY.13.76.G10.1.454.CMB.2.raw
  modified_base (534)..(534): a, c, t, g, unknown or other
  modified_base (587)..(587): a, c, t, g, unknown or other
  modified_base (596)..(596): a, c, t, g, unknown or other
  modified_base (623)..(623): a, c, t, g, unknown or other
  modified_base (627)..(627): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgcttaattttaaaaggtgcccagtgtgaggtgcagcgtggtggagtcgtggaggaggcttgatccgagccgtcgggggtccctgagacctctctgtcgcacgtcctcgtcggtccaccgtcacgtaccaccacctacagtgacgtccggtcgggtcccgccgacggccgtaccggggaagggggacggggtcgtagggtacgtcgttccgtttcttttacgttttttaagtttagttaggttaggttaggttaacgtacctacgtacgtccgactacgtaacccgtcggtcgggacgggtccgtacttccacctactctaccgaagacaaactaactacaaacggactacgttctttagttactaacgaaatcgaacncgtacggtagacgtacgaccgagtacgaccgtacgggtctagttactacgtgngaacgtagngtacgcgggacccaaggttaccgttcncgtntagcggtacgtggacggaaccgaaggtaacccg

SEQ ID NO: 380424 - DNA, 635 bp, Homo sapiens
  misc_feature: GZ8MTXP01BOEG7.13.76.G10.1.454.CMB.2.raw
  modified_base (367)..(367): a, c, t, g, unknown or other
  modified_base (377)..(377): a, c, t, g, unknown or other
  modified_base (395)..(395): a, c, t, g, unknown or other
  modified_base (519)..(519): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccgagccgtgggggtccctgagactctcctgtgcagcctcgtgggttcaccgtcagtcacacctacatgagcgtcgggtcccgcgaggcctccgaggggaaggggctggagtgcgtctttcttttattagtagtgtggtactacatctcgnagaccgtcgnggacgggcctattcactntcctccagtacgaactactaccgaaagaactcgctttacgtttactaacgaaatcgaaactgggtccctaggacggaacgtcccgaatcggaaccgtccgggtcccgtttgtaactttacgggnggtacggaacgaaggacggtacgggttccgggaacccctaacgggttaaccgttacgaccggtgtacggtccgggtaccggtcgggaccggggaacccgttaaccggggtaacccg

SEQ ID NO: 380425 - DNA, 586 bp, Homo sapiens
  misc_feature: GZ8MTXP01C5T1T.13.76.G10.1.454.CMB.2.raw
  modified_base (280)..(280): a, c, t, g, unknown or other
  modified_base (363)..(363): a, c, t, g, unknown or other
  modified_base (484)..(484): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctanatgagcgtcggtcccgcaggctccggaggggaaggggctggagtgcgtctttcttttattatagtagtgtagtacatactcgnacgactccgtggacggggccgtattccacctatcctccgaagacgaacaacttaccaaagaacacgtcttgtttacttacaaatgaacagccgtagacgagccgatcgacgacggtccgtntattacgtgtgaacgaggacgtagttcggggacccacgttaaacgttcacgcttaaggtcggtaaccgtcggttacggggaacccgttaacggggaaccccg

SEQ ID NO: 380426 - DNA, 620 bp, Homo sapiens
  misc_feature: GZ8MTXP01BE0D9.13.76.G10.1.454.CMB.2.raw
  modified_base (185)..(185): a, c, t, g, unknown or other
  modified_base (244)..(244): a, c, t, g, unknown or other
  modified_base (263)..(263): a, c, t, g, unknown or other
  modified_base (271)..(271): a, c, t, g, unknown or other
  modified_base (276)..(276): a, c, t, g, unknown or other
  modified_base (278)..(278): a, c, t, g, unknown or other
  modified_base (280)..(280): a, c, t, g, unknown or other
  modified_base (308)..(308): a, c, t, g, unknown or other
  modified_base (313)..(313): a, c, t, g, unknown or other
  modified_base (326)..(326): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcgtggtttcgtgtagctatttaaaagtgccagtgtgaggtgcagntggtggagtctggaggaggcttgatccaggcctggggggtccctgagctctcctgtgcngtcctcgtcggtcaccgtnacgtcacnctagngngngcgtcggccgcgacgcgtcggaggaggngtggngtcgtcgtctttntttattagttagtagtgtagtacctactacgtccgacgacgtaacgtcggtcggacgggtaccgtacgtactacctactactacacgacgtaactaactaacgaacgtaacgtacgtacgttacttactactaagtacgaacgacgacggtacgacgacgacgacgtacgacgaccggtacgttacgtagttacgtgtggtaacggagaggtacggaccggtaccgtaacgttaccgttacgttacgtaacgtacgtcggtcggtcggttacgggtaaccggaaccggtaaccg

SEQ ID NO: 380427 - DNA, 595 bp, Homo sapiens
  misc_feature: GZ8MTXP01CJWP8.13.76.G10.1.454.CMB.2.raw
  modified_base (216)..(216): a, c, t, g, unknown or other
  modified_base (236)..(236): a, c, t, g, unknown or other
  modified_base (247)..(247): a, c, t, g, unknown or other
  modified_base (270)..(270): a, c, t, g, unknown or other
tcagtcacgtactacacgaccggtgctcgatttagtcactcatacagggggagcctgggcctcaggaagcagcatcggaggtgcctcagccatggcatggatccctctcttcctcggcgtccttgcttactgcacaggatccgtggcctcctatgagctgactcagcccaccctcagtgtccgtgtccccaggacagacagccagcatcactgctnagaaataatgcagataaatntactctgtatnagcagagtcaggcctacgtcccngtcgctgtcatctatcaagatcgaccgaggccgaccctaggacgggtaccctcccgtaggacgtcgtactttcccgtacgtcggtaccctacccgaaacgttcgtaaccggggtaacctccgacgtcccctacgtaccgtacgaacccagtaccgaccggaccggggaccccagggtactagtggatcgggaaggggtctagtaacttagttcgtacgcggaggcggtagggacagcgaagcctagccgtccgcttacgtcgttaccgttcggaacgtccgggaactaacgggtcctaccgggttactaacggttcccgaacccg

SEQ ID NO: 380428 - DNA, 690 bp, Homo sapiens
  misc_feature: GZ8MTXP01CL8Q1.13.76.G10.1.454.CMB.2.raw
  modified_base (425)..(425): a, c, t, g, unknown or other
  modified_base (543)..(543): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggtcaccgtcagtcacacctacatgagcgtgggtcccgccgaggcctccggaggggaaggggcgtgggagtgtcgttctttcttttatttatagtagtgtagtaccatacgtccgcagtaacgtccggtggacggggccgtattcccacctactcctacccaggtaanaactaaacttcccaaaagaaccacgtactttgtttacctaacgaaaattcggaaacctagccctaaggacgaacgcccgaatcgaccgtaacgggtcccgttaggttaactttaccgnggttgggaaccggtaaaggacggttaaacggcccggggggtaaacccctaacgggttaaaacccgggtttacttaccccggtaagttacggtcggggtaacccggttcgggttaccgggggtaaccccgaaacgggggtaacccccg

SEQ ID NO: 380429 - DNA, 686 bp, Homo sapiens
  misc_feature: GZ8MTXP01DV3VC.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgcccagtgtgaggtgcagcgtggtggagtcgtggaggaggcttgatccgaggccgtggggggtccctgagactctcctgtcgcagcctcgtggattcctacctttgatgattatcgccatgctacgtcgggtccgacaagcctaccggagggggaacgggtcgtagggtggtcggggttctcgtaggttagttaggttaggaagttaggtggtagcgtagtaggactaagtggacggtacttcgtaggtacggacgggcgtactccgactatcctacgagacgaaccaacgaccaaagacccttacccgtgtaactccgttagggaaacctaaagtacgaaaacgcgtacccgtaggaacggaacgtcggtaaggacggtaaccgtaccggttccgtttaagttagtttagttacggtacgaaaccttaaaaaggttcccttaaaccccgttaacccctttaaggtttcgtttttaggggacgttttacgggttaacggccgggttaaccgggggg

SEQ ID NO: 380430 - DNA, 549 bp, Homo sapiens
  misc_feature: GZ8MTXP01EINUE.13.76.G10.1.454.CMB.2.raw
  modified_base (385)..(385): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctgggggtccctgagactctcctgtgcagcctctgggttcaccgtcagtcacacctacatgagctggtccgccaggctcgagggaagggctggagtgcgtctcttttattatagtagtggtagtacatactcgcagctccgtgagggccattcacatctcagngacaattcaaagacacgctgttctacaaatgaaacagcctagagacgtccgagtgaacgacggtccgtgtacttcgtgtggacgaggagacggttcgggggaccccacggttaaacgttcctacgcgttaacgtcgggaaccggtccgttcgggggaaccccgg

SEQ ID NO: 380431 - DNA, 629 bp, Homo sapiens
  misc_feature: GZ8MTXP01DGW3M.13.76.G10.1.454.CMB.2.raw
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtcgtccgtcgtccccaggacagacagccagcatcacctgctactaggaaataatggcaagaataaatactactcctggtatcagcagagtcaggccacgtcccctgtgctggtcatctatacaagatcgaccaacggccggcccctcgaggggtacctccccccgtaggacgcgtattcctaccgtggtccctaccgaaaccttcgtacgggaacctcacgacccacctctacgaccactccgaacggaccgggaccctagggacctagtacggactagggacggacgttacgtactttaacgttcgtgttaccgagggtcggtacgggacgacggacgacgccgtaacgtccgcccggtacttagtcgggttcgttaccgggacgttacggggaacccctaaagggttcccgtaacccggtaccgttaacggtccgaaccccggtaaaccccgg

SEQ ID NO: 380432 - DNA, 632 bp, Homo sapiens
  misc_feature: GZ8MTXP01A62KA.13.76.G10.1.454.CMB.2.raw
  modified_base (234)..(234): a, c, t, g, unknown or other
  modified_base (309)..(309): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgcctcagtgtctggggccccagggcagagggtcaccatctcctgcactgggancagctccaacattggggcacattatgatgtacactggtaccagctagtttccaggagcgacggtcccagactccncatcaatacgtaaacaacaatccggccccgacgaacgggggtcccctaggacccgtattccgtacgtcgggccttccgacggtcgtcggcctaccctccgacggtcccctccccgttcggtcctacgttaccgaccgtcggggtccctcgggaacgggtccgtggaggtaagtgacggtcgttacggtaatttacgtttctcggtccctaacggttcccttagtacgacgtaacggccttacgcccgttaggtaacggtttcggtccgttttacgggtacgggtttcccgggggaacccggggggggttaaccccgtaacggg

SEQ ID NO: 380433 - DNA, 601 bp, Homo sapiens
  misc_feature: GZ8MTXP01EOVXK.13.76.G10.1.454.CMB.2.raw
  modified_base (170)..(170): a, c, t, g, unknown or other
  modified_base (281)..(281): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtcgtccgtgtccccaggacagacagccagcatcacctgctctagaaataatggacagataaatatacttctgtatcagcagagtcaggccacggccctgtgctggtctntatgtgagtacgccgaccggcctcgacggactccgtgacgcgtatcgtcggctaccaactcgacggacaccggccacggggtctacgacctatcgtacggtagggtacggaacggccggggtagtacgggacgggaccgtacgtacgttacgttagtacgtagggggttggtaggggtaagttaggtaggtcgtggtagagtagttggttaggttacggtcgggaacgggtaacgggaaccgtaaacggttcgtacccggtacgttacggttcgaccgaaccgacggccgtccgtccccgttcgtccgttaacgttcccg

SEQ ID NO: 380434 - DNA, 634 bp, Homo sapiens
  misc_feature: GZ8MTXP01AZVP9.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtgggttcaccgtcagtcacacctacatgagcgtcgggtcccgccaggcctccggaggggaagggggctggagtgcgttcttctttttatttagtagtagtggtataccatactccgcagaacctccggtggacggggcccgtattcacctatcctccagagacctaattacccaaagaactacgtctttagtttactacaaaattgaaactcgaccgtaggaaggtacgaccgtaatcggaaccgtaccgggtccgttaggttacttacgtggtggaacgaggaggtagttccgggggacccctaacggttaaccgtttcacggtcgtagtcgggaccggttccggttacgggggaacccgttaaacgggggaaccccg

SEQ ID NO: 380435 - DNA, 643 bp, Homo sapiens
  misc_feature: GZ8MTXP01D3NEL.13.76.G10.1.454.CMB.2.raw
  modified_base (370)..(370): a, c, t, g, unknown or other
  modified_base (437)..(437): a, c, t, g, unknown or other
  modified_base (459)..(459): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccgaggccgttggggggtccctgagactctctgtgcacgctcgtgggtcaccgtcagtcaacacctacatgagcgtcggtccgcaggcctccggaggggaggggctgggagtgtcgttctttcttttatttatagtagtggtagtaccattacncgcacgccgtcgtgggagggccgtacttcacctatctaccagacgaacaactaccaaagaacacgtnttgtttactacaaatcgaaacncgcgtaggacgaacggtcccgaatcggacgtaccggtacgttaggttacttacgtggtcgaacggaaggttcggacggttccgggggaaacccctaacggttaaaacccgttcgttaaccggtcgttaacggtaacgggaccggttaccgggacgggggtaaccccgaacggggtaacccccgg

SEQ ID NO: 380436 - DNA, 679 bp, Homo sapiens
  misc_feature: GZ8MTXP01AH3PT.13.76.G10.1.454.CMB.2.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcacgccaccctcagtcgtccgtgtccccaggacagacagccagcatcacctgctctaggaaataatggcaagataaatatacttctggtatcagacagagtcgagcctacgtcccctgtcgctggtctatctatacaagctgacccgaaggccggacccgttcgggggacctcccgtggacgtcgtactttccgtccgtcgggacctcccgaacgttccggtacgggtaaccttccgacgtccctacctcttacgaaccctacgtaccgaccgggaccgggaaccccgaggtaccttaggtacgggacgtacgggtaacggtcgttacggggtaactttaacgttacgttacggtaccgggtacgggtcgggttacggggaaccgacggtacgaacgggtcctaaccggtccgacccgttgttaccgttcggttaccgttaccggaacggttcgggaacccgtaacggtacccgtaaccgttacccgtaaggttaccgtaaccgaaccccgtaaacccgg

SEQ ID NO: 380437 - DNA, 513 bp, Homo sapiens
  misc_feature: GZ8MTXP01CUNZR.13.76.G10.1.454.CMB.2.raw
  modified_base (452)..(452): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctagaaataatggacagataaatatacttcctggtatcagcagaagtcagccagtcccctgtgctggtcatctatacaagatgccaagccggccctcgagggactccccctgagcgtattctctggcctccaactctagggaactcagccactctgaccatcagcggacccaggctagtcgatgagcgtagtaacgttatacgtgtcgaggtcgtaggggacagcagtcaactcgcccgtnttacgtgtcgttacggacttgggaaccaagggtccaccgtcttaacgtcgaacgaaccccg

SEQ ID NO: 380438 - DNA, 611 bp, Homo sapiens
  misc_feature: GZ8MTXP01D72LX.13.76.G10.1.454.CMB.2.raw
  modified_base (500)..(500): a, c, t, g, unknown or other
  modified_base (528)..(528): a, c, t, g, unknown or other
  modified_base (530)..(530): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctatttaaaaggtgccagtgtgaggtgcagctggtggagtcgtggaggaggcttgatccgagccgtcgggggtccctgagactctctgtgcagcctcgtggtcacgtcagtcacactacatgagcgtcggtccgcaggctaccggagggaacggggcgtggagtcgtcgtttcgtttactttttaattagtagttagtggtactacctatactccgacacgtaaccgtcggtggacgggtaccgtacttacacctaactcctaccgagacaactaaactccgaaagacctacgtactttgtttactaacaaagtcgaaaccagtccgtagaagtcgaccgaancgaccgaacggtccgtagtacttacggngngaagaagagtacggttccggaacctaacgttaacgttcacgtaagtagtaacggcgtcggacgggaaccgaacggtaaccg

SEQ ID NO: 380439 - DNA, 805 bp, Homo sapiens
  misc_feature: GZ8MTXP01CM0DL.13.76.G10.1.454.CMB.2.raw
  modified_base (244)..(244): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagtttggctgagctgggttttccttgttgcttattttaaaggtgccagtgtgaggtgcagcgtggtggagtcgtggaggagcttgatcagcgtgggggtcctgagactctctgtgcngcctcgtggtcaccgtcagtcacactacatgagcgtcggtccgcgacggcgtaccggaggggaacgggtcgtaggaggtcgtcgtttacttttacgttttaagtttagttaggttaggttaggttaacgtaacctactacgtcccgtacgtaacggtaaccgttcccgggtgggaccggggtacccgtaatttacccaacctactcctacccgaaaggtacaaaccttaaacgtacccgaaaagaaacccgtacggttcctttacgttttaaccttaaacaaaaagttcgaaaacccgtggtacccttaaaggggaacgtaaccggaccccggtaaattacccgggaacccgtaccggggttaaccgtttggtaaacctttaccgggttggaacggggaacccgttaaagggacggggtttaaaccggttccccggggggaaaccccctaaaagtttaaaccggggtttaacccaaacgggttaaccgttacggttaacccggggaaccgggtttccgggggacgggggaaacccccgttaaaaccggggggtaacccccg

SEQ ID NO: 380440 - DNA, 787 bp, Homo sapiens
  misc_feature: GZ8MTXP01C1SU7.13.76.G10.1.454.CMB.2.raw
  modified_base (307)..(307): a, c, t, g, unknown or other
  modified_base (403)..(403): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagtttggctgagctgggttttccttgttgctattttaaaaggtgccagtgtgaggtgcagctggtggagtcgtgggaggaggcttgatccgaggccgtgggggtccctgacgacctctcctgtcgcagcctcgtcggttcaccggtcacgtccacacctacatcggaacgtcgggtcccnccgaggccgtaccggagggggaacggggcgtagggagtcggtccgttctttactttttaatagttagttaggtaggtagtactacttaccgtccgngacgtacgtcccgggtagggaacgggggacctacttacccgaacctactccctacgaacgggaactaactaaaccgttaccgaaacggaaaccctacggtacttttacggttttacttaaacgtaaacgttacgaaaccgaccgtaccgtagggggaaccgaaccgggtaccgtaacgggttccgaaacccggtaccggggttacccgtttaaggtttaagtttacccgtggggtcggaccggtaaaggggtacggaacggggttaccccggggaacccgttaaaacgggtaaccctttaaccggttacgttacgttaacggtcggggtaaccggttcggggaccgggggttaacccgtaacggggaaccccgttaacccgggg

SEQ ID NO: 380441 - DNA, 645 bp, Homo sapiens
  misc_feature: GZ8MTXP01CQYPT.13.76.G10.1.454.CMB.2.raw
  modified_base (243)..(243): a, c, t, g, unknown or other
  modified_base (306)..(306): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacgagggtcctgggcccagtctgtactgacgcagcccgcctcagtgtcgtcggggccccaggggcaggacggtcaccatcctcctgcacgtggggancagctccaacgagttggggcacattatgatgtacacgtggtaaccagctagtttccgaggacncgacggtacccagactcctacatacaaataacgtaaacaacgaactccggacccgaacgtacgggggtccctagaacccgtacttccgtcgtcgggccttaccgagttccgttcgggacctacctaccacggtaccccttccccgtggttaccacttccgaacgtcgggaccttcccgggaggtccgtaggaagggtagtaggacgtacgttagttactttacgtttccgtacgtaccgtaacgttacgttagtacgacgtacgtacgacgttcgttacgtaacggtcgttcggttcgggttacgggttaccggggtaaccggggttaaccggtaacgg

SEQ ID NO: 380442 - DNA, 788 bp, Homo sapiens
  misc_feature: GZ8MTXP01B24P9.13.76.G10.1.454.CMB.2.raw
  modified_base (536)..(536): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggtagtttggctgagtcttgggttttccttgttgcttaattttaaaaggtgcccagtgtgaggtgcagcgtgggtggagtcgtgggaggaggtcttgactccgagccggtgggggtccctgagactctcctgtcgcacgtcctcgtcgggtcaccgtcagtccacacctacagtgacgcgtcgggtcccgccgacggtcctaccggaggggaacgggggtcgtagggtagttcggtccgttcttttactttttaattttagttaggttaggttaggttacgtaaccctactaccgtccgacgtacgtaaccgtcgggtgggacggggtacctactacccactactcctaccgaaggtactaaacctaaacttacgaaacggtaaccctacgttctttacgtttacctaaaanaaagtacgaacgtacgtacggtaggaacggaccgtaccgtaagtacccggacccggtaccggttacgtttacgttaacgttcggtacggtaacggaacggtaagggaccgggtaccgggttaacccgggtaaaccccgttaaacgggtttaaacccgttaccggttaaccggttaaccggtacgggttaaccggggtaccgggttacccgggggaacccgggggtaaccccggttaaaacccggggtccccg

SEQ ID NO: 380443 - DNA, 606 bp, Homo sapiens
  misc_feature: GZ8MTXP01BGAG2.13.76.G10.1.454.CMB.2.raw
  modified_base (406)..(406): a, c, t, g, unknown or other
  modified_base (512)..(512): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctatttaaaggtgccagtgtgaggtgcagctgggtggagtcgtggaggaggcttgatccagccgtggggggtccctgagctctcctgtgcagcctcgtgggttccaccgtcagtccacacctacatgagcgtgggtccgccgaggcctccgagggggaagggctgggagtgtcgttctttcttttattataggtagtggtagtactatacctccgacagctcgtgggacgggccgtatccacatccncagagacaattccaaagactgccttgttactacaaattcgaaacgacgtccctaggacgtacgcccgatcggaaccgtccgggtcccgtttagtaacgtttacggnggtcggacggaaggacggacggtaccgggaccccttaaaggttaacccgttaacacgtaacgtacggtcggttaccgggtcggccggggaaccg

SEQ ID NO: 380444 - DNA, 594 bp, Homo sapiens
  misc_feature: GZ8MTXP01DVYT2.13.76.G10.1.454.CMB.2.raw
  modified_base (452)..(452): a, c, t, g, unknown or other
  modified_base (551)..(551): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtctggaggaggcttgatccagccgtgggggtccctgagactctcctgtgcagcctcgtgggtcaccgtcagtcacacctacatgagcgtgggtcccgcaggcctccgaggggaaggggcgtggagtgtcgtctttcttttatttatagtagtggtagtaccatactccgcagaactccggtggacggggcctattcaccatctaccagacacaacttccaaagaacacgtctttgttcttacaaatcgaaacncgccgtgagacgccgagtggccgacggccgttgttaacttacgtggtcgaacgtaggaggacggttcggggaccccctaaggttaaccgttacaccgtntagtccgggacgtcggttacgggggcccgaaaggggaaccccg

SEQ ID NO: 380445 - DNA, 606 bp, Homo sapiens
  misc_feature: GZ8MTXP01APAZ6.13.76.G10.1.454.CMB.2.raw
  modified_base (400)..(400): a, c, t, g, unknown or other
  modified_base (469)..(469): a, c, t, g, unknown or other
  modified_base (516)..(516): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaggtgcccagtgtgaggtgcagcgtggtggagtctggaggaggcttgatccagccgtgggggtccctgacgactctcctgtgcagcctcgtgggtcaccgtcagtcacacctacatgagcgtcgggtcccgccgaggccgtaccggagggggaacgggggcgtagggagtggtcgttctttactttttagtttagtagttagttggtagtaccatactccgcagaaccgtccggnggacgggccattccaccatctcagagacaataccaagaacacgtcttgtttacctacgaaatcgaaacncgccgtagacgacgacccgatcggacgaccggtcgtgttacttacgnggtgaacgagaggacgttcggggacccctaaggttaccgttcgaccgtcttagcgggtacgtcggacggggtaaccgaagggtaaccccg

SEQ ID NO: 380446 - DNA, 574 bp, Homo sapiens
  misc_feature: GZ8MTXP01BL5QC.13.76.G10.1.454.CMB.2.raw
  modified_base (173)..(173): a, c, t, g, unknown or other
  modified_base (240)..(240): a, c, t, g, unknown or other
  modified_base (297)..(297): a, c, t, g, unknown or other
  modified_base (441)..(441): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagcccaccctnagtcgtcccgtgtccccaggacagacagccagcatcacctgctctagaaataatggacagataaatntacttctgtatcagcagagtcaggccagtcccctgtcgctggtcatctaatcaagtntcgaccaacggccggaccctaggacggggacctcccccccgtaggacgtcgtacttccgtcgtcggccctacgtaaacgtccgtacggggaacctcgacgaccctacgtctacgaccagtcgaacggccgggaccaggctacgnggatggagcgtagtacttatcgtagcgaggcgtaggcagctacgccaaggtccgcgtacttacgtgtcgttaccggaagttccggggtaacctacgggtcctaccgggtaccttacgtccgaaccgaaccccg

SEQ ID NO: 380447 - DNA, 650 bp, Homo sapiens
  misc_feature: GZ8MTXP01BECWE.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtctggaggaggcttgatccagccgtgggggtccctgagactctcctgtgcagcctcgtgggtcaccgtcagtcacacctacatgagcgtcgggtcccgcgaggcctccggaggggaaggggcgtggagtgcgttctttcttttattatagtagtggtagtaccatactcgacagtaaccgtcggtggacggggcctacgttccaccactcctaccaagaacgtaactaacgttacccaaagaaccctacggtctttagtttacctacaaaagtcgaaacacgtccgtaggaacggtacgacccgtaagtcggaaccgaccgggttccgttagttacgttacgtggtcgaacggtaggacggacggttccggggaacccctaacggttaaccgtttcgacgtctaaggtcgggtaacgtccgggttacggggaacccgttaacggggtaacccg

SEQ ID NO: 380448 - DNA, 617 bp, Homo sapiens
  misc_feature: GZ8MTXP01CCSJ3.13.76.G10.1.454.CMB.2.raw
  modified_base (368)..(368): a, c, t, g, unknown or other
  modified_base (380)..(380): a, c, t, g, unknown or other
  modified_base (394)..(394): a, c, t, g, unknown or other
  modified_base (397)..(397): a, c, t, g, unknown or other
  modified_base (402)..(402): a, c, t, g, unknown or other
  modified_base (434)..(434): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtgggtcaccgtcagtcacacctacatgacgcgtcgggtcccgccgaggcctaccggaggggaggggcgtgggagtgcgttctttcttttattagtagtagtgtagtacatcncgcagaactcgnggcgggctatcacntcncaganactataccaaagactacgtcttgtttaccaanaaactgaacacgtccgtaggaacggacgtacccgagtacgacccgtacggtacccgttagttaccgttagcgtggaacggtaagacggtacgggttcgggaacccctaacggttaaccgttaacgaccgtaacgttagtaacgggtacgtccgggttacggggaaccgaacgggggtaacccc

SEQ ID NO: 380449 - DNA, 544 bp, Homo sapiens
  misc_feature: GZ8MTXP01BRHV7.13.76.G10.1.454.CMB.2.raw
  modified_base (168)..(168): a, c, t, g, unknown or other
  modified_base (412)..(412): a, c, t, g, unknown or other
  modified_base (462)..(462): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctctatgagctgactcagccacctnagtgtccgtgtcccaggacagacagccagcatcacctgctactaggaaataattggacagataaatatacttctggtatcagcagaagtcaggccagtcccctgtgctggtcatctatcaagatcgaccaagccggccctacgaggggactcccccctaggagcgtattcctctcggcctccaaactcgtacgggaaactcgacgccactcacgaccatacgacgaccgggacccaggcgtagngataggaggtctagtacttagttacgtgtccgaggcgtagggacaggacngcaactcgcccgtcttagtcggtcttacggacgttggggaacccagggtccaccggtaccttaaacgtccgaacgaaccccg

SEQ ID NO: 380450 - DNA, 715 bp, Homo sapiens
  misc_feature: GZ8MTXP01DI8PQ.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttaattttaaaaggtgcccagtgtgaggtgcagcgtggtggagtcgtggaggaggcttgatccagccgtgggggtcctgacgactctcctgtgcacgcctcgtcgggttcaccgtcagtcacacctacatgacgcgtcggtcccgccgaggcctaccggaggggaaggggcgtggagtcgtcgttctttacttttatttagttagtagtaggtaagtaccactactccgacacgtaaccgtccggtgggacggggtacccgtatttcccaaccgtactaccgtacccgaaagacgtaaacctaaacgttacccgaaaaggtaaccctacgttctttacgttttaacctaacaaagttacgaaaccgtacgacccgttaggaaacgccgaccgtaagttccggaaccgttacccggtaccggtttagttaacgttacccggtggtcgggaacggtaagggttacgggtaccggttaccgggggaacccctaacggttaaccgtttcgacgtgtaaggtcgggacgtcgggttacgggggaacccgaacgggtccccg

SEQ ID NO: 380451 - DNA, 608 bp, Homo sapiens
  misc_feature: GZ8MTXP01DKA13.13.76.G10.1.454.CMB.2.raw
  modified_base (496)..(496): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtctggaggaggcttgatccagccgtgggggtccctgagactctcctgtgcagcctcgtgggttcaccgtcagtcacacctacatgagcgtcgggtcccgcgacggctccggaggggaaggggcgtggagtgcgttctttcttttattagtagtagtggtagtaccatacgtccgcagaactcgtggacgggccattcaccatctaccagagactaatccaaagaacacgtcttagtttactacaaatgaaacagccgtgaagcgaccgatcgacgcggtccgttgtacttacgtggngaacggaagacggtacgttccgggggaaccccaaggttaaaccgtttcgaccgtgttaaggtcgggtaaccggtcgggttacgggggaacccgttaaacgggggtaaccccg

SEQ ID NO: 380452 - DNA, 656 bp, Homo sapiens
  misc_feature: GZ8MTXP01BKAUZ.13.76.G10.1.454.CMB.2.raw
  modified_base (500)..(500): a, c, t, g, unknown or other
  modified_base (524)..(524): a, c, t, g, unknown or other
  modified_base (545)..(545): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgcttattttaaaaggtgcccagtgtgaggtgcagcgtggtggagtcgtggaggaggcttgatccagccgtgggggtccctgagactctctgtgcacgcctcgtgggtcaccgtcagtcacacctacatgacgcgtcggtcccgccgacggcctaccggaggggaagggggcgtgggagtgtcgttctttcgtttttatttagttagttaggttaggtaagtaacctactacgtccgacacgtaaccgtccggtgggacggggcccgtacttccaaccctactcctacccgaagacgaactaaacttcccaaagaactacgtctttagtttcctacaaatgaaacncgccgtagagacgaccgatcgacncggtaccgttgtaacttacgnggtgaacgaaggacgtacggttccgggggacccctaaaggttaaaccggtttccacggtcttacggtcgggaccgttcgggttacgggggaacccgaaaggggtaaccccg

SEQ ID NO: 380453 - DNA, 565 bp, Homo sapiens
  misc_feature: GZ8MTXP01CKL88.13.76.G10.1.454.CMB.2.raw
  modified_base (366)..(366): a, c, t, g, unknown or other
  modified_base (395)..(395): a, c, t, g, unknown or other
  modified_base (481)..(481): a, c, t, g, unknown or other
  modified_base (491)..(491): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggtttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtcgggtccgccaggctccgaggggaaggggctgggagtgcgttctttcttttattatagtagtggtagtacatactccgnagaactccgtgacgggccattcaccatcnccagagacaattccaaagaccacgtcttgttactacaaatgaacagaccgtgacgacgccgatcgacgacggtccgtgtattacgngtcgcgaggngagttcggggaacccacggttaacggttcacggtctagtcgggacgtggacggggaaccgaacggggtaacccg

SEQ ID NO: 380454 - DNA, 636 bp, Homo sapiens
  misc_feature: GZ8MTXP01DU481.13.76.G10.1.454.CMB.2.raw
  modified_base (457)..(457): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcacgtcctcgtgggttcaccgtcagtcacacctacatgacgcgtgggtcccgccgaggcctaccggagggggaagggcgtgggagtcgtcgttctttacttttattagtagtagtcgtagtacatacctccgacagcgtcgtggacggggcctatcactatccgtacagagaactaactaccaaagacctacgtcttcgtttctaanaaattcgaacagtccgtagaacgacgcccgagtcggaaccgtacggtccgttagttaacgttacgtggtcggacggaaggaggtacggtcccgggggaacccttacgggttaaaacccgtttaacgaccggtaaccgttaggtacggggaccggtttccggccggggggtaaaccccgg

SEQ ID NO: 380455 - DNA, 631 bp, Homo sapiens
  misc_feature: GZ8MTXP01AJXDJ.13.76.G10.1.454.CMB.2.raw
  modified_base (585)..(585): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccggtcagtcacacctacatgagcgtgggtccgccgaggctccgaggggaggggctggagtgcgtctctttttattatagtagtggtagtaccatactcgcagaacctccgtggaggggccagttccacctatctacccagacgaactaacttaccgaaagaaccaccgtcttggtttaccttacgaaaattcgaaaccacggcccttagggaacgacgacccgggaattccggacgtaccgggtacccgttgttaactttacgtggttcgcggaaggagacggttccgggggaccccaacggttaacgttccgttacgtntaagcggggtaaccgtcggttacggggaacccgaacggggaacccg

SEQ ID NO: 380456 - DNA, 712 bp, Homo sapiens
  misc_feature: GZ8MTXP01A13W5.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccaggccgtgggggtccctgagactctcctgtgcagcctctgggttcaccgtcagtcacacctacatgagctcgggtccgccgaggcctccgaggggaaggggctggagtgcgtcttcttttattatagtagtagtagtaccatactcgcagtacctccggtggacggggccgtattccaccatcctacccaagacgaaccctaaagttccccgaaaaggacctaccggtctttaggttttaccttaacaaaaagttcggaaaactacggccctagggaaccgaacggaccccggttaaagtccgggaaccgtacccggggttccgtttaaggttaacctttacggtggtaccgggaacggtaaacgggacggtaacgggttacccgggggaaaccccgtaaacggttaaacccggtttaccgttaacgtaaccggttacgggtcgggtacgggtaccggggttaccgggggtaacccgttaaaccggggtaaccccg

SEQ ID NO: 380457 - DNA, 627 bp, Homo sapiens
  misc_feature: GZ8MTXP01BZDUT.13.76.G10.1.454.CMB.2.raw
  modified_base (366)..(366): a, c, t, g, unknown or other
  modified_base (480)..(480): a, c, t, g, unknown or other
  modified_base (532)..(532): a, c, t, g, unknown or other
  modified_base (535)..(535): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtgggttcaccgtcagtcacacctacatgagctcgggtccgcaggcctccgaggggaggggctggagtgcgttcttcttttattatagtagtggttagtaccactactccgnacgaacctccgggtgggaccggggtcctattccgacctactcctcccgaagacgaacctaacttaccaaaggtaccaccggttctttgtttacctaacgaaagtcggtaaaccncggtacgtaggacggacgtccgagtaccgaccgtcggtcttagttattacgnggngaacggagacggtcggccgggaaccctaaggttaacgttcgacggtaactggtccgggtaccggtcggggacggggaacccgaaccggtccg

SEQ ID NO: 380458 - DNA, 739 bp, Homo sapiens
  misc_feature: GZ8MTXP01CMZV3.13.76.G10.1.454.CMB.2.raw
  modified_base (172)..(172): a, c, t, g, unknown or other
  modified_base (239)..(239): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctnagtcgtccgtgtccccaggacagacagccagcatcacctgctctaggaaataatggacagataaatntacttctaggtatcagcagaagtcaggccagtcccctgtcgcgtggtcatcgtatacgaagactcgacccaaggcccggccctagacggggctccccccgtggacgcgtattccgtcgtcggcctacctaaacgtcgtacgggaacctcgacgaccctacgtctacggacctagtccgaacgggcccgggaacccctagggtaccttaaggcgggtaacgttacggggaaacgggtccttaacgggtaaaccttttacgttaaccgggttgtacccggttaaggggccgggttacgggggaaaccgtagggaccgtaaaccgggtcccgaacccggtttcccggccccgggttaccttaggggtttacccgttacccggtttaccgggggttaaacccgggtttacgggggaaaaccccggttaacgggttttaaccccggaaccccggtttaacccggttaaacggtaaccccgttaaacccgggtaaaccccccccgg

SEQ ID NO: 380459 - DNA, 758 bp, Homo sapiens
  misc_feature: GZ8MTXP01CMS1M.13.76.G10.1.454.CMB.2.raw
  modified_base (250)..(250): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgactccaggccgtgggggtcctgagactctctgtgcngcctcgtggtcaccgtcagtcacacctacatgagcgtcgggtccgccgacggccgtaccggaggggaacgggggcgtagggagtcgtcgttctttacttttatttagtagttaggtggtagtaccactacgtccgacgacgtaaccgttccggtgggacgggggtcccgtacgtttacccaaccctacgttaccctacccgaaaggtaacgtaaacctaaacgtttaccccgaaaacggtaaacccgtaaacccgttctttacgttttaccttaaactaaaacgttacggaaaccgtaacggtccggtacggaaaggaccggacccggtaagtaccggaaccggtaccggttcccggttagttaaccgtttaccgtggtacgggaacggaaaggaggtacgggttcccgggggaaaccccgtaacggttaaaccggtttacgttaccggtcttaacggttcgggaaccgggttccgggaccgggggaaccgttaaacggggaaccccg

SEQ ID NO: 380460 - DNA, 612 bp, Homo sapiens
  misc_feature: GZ8MTXP01AWOHJ.13.76.G10.1.454.CMB.2.raw
  modified_base (442)..(442): a, c, t, g, unknown or other
  modified_base (500)..(500): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtcccgccaggctccgagggaggggctggagtgcgtctcttttattatagtagtggtataccatactccgcagaacgtccgtggacgggccgtattccacatcctaccagacaactactacaaagacacgtcttagtttctaacaaatgaaacncgtaccgtagaacgcgacccggatcggaaccgtaccggtccgttataacctttacggnggtggaacggtaaggacggtacgggttacccggaacccgtaacggttaaccgttcgacgtaacgttaggtccgggtaccggtcggggaccgggaaccggaacccgggtcccg

SEQ ID NO: 380461 - DNA, 588 bp, Homo sapiens
  misc_feature: GZ8MTXP01EXHTJ.13.76.G10.1.454.CMB.2.raw
  modified_base (172)..(172): a, c, t, g, unknown or other
  modified_base (503)..(503): a, c, t, g, unknown or other
  modified_base (508)..(508): a, c, t, g, unknown or other
  modified_base (519)..(519): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcactgctctagaaataatggcagataatatactctgtatcagcagaagtcacggcctagtcccctgtcgctggtacatctatacaagtatcgacctaacggccgaccctacgacggggtacctccccccgtaggacgccgtattcccgtaaccgtcggtccttacccgaacgttccgtacgggaacctcgacgtcccacttcgacgaccagtccgacggacccgggacccagggtactagtcggatacggagtcgtagtaacttacgttaccgtgtaccgaggtcggtaggactagcncgacnccgtcggcctnttacgtcgttacgttacggacgttacgggaactacggtccaaccgtcgttacgtcgaaccggaaccccg

SEQ ID NO: 380462 - DNA, 611 bp, Homo sapiens
  misc_feature: GZ8MTXP01E131S.13.76.G10.1.454.CMB.2.raw
  modified_base (240)..(240): a, c, t, g, unknown or other
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctcagtcgtccgtgtccccaggacagacagccagcatcactgctctaggaaataagtgacagtataaatntactctgtatcagcagagtcaggccacgtcccctgtcgctggtctatcgtaatcaagactcgaccgaacggccggccctacgacggggtacctcccgtaggacgtccggtacttccgtcgtcgggtaccctacccgaaaccgttcggtaacgggaacctcgtaaccgcctaacttcgacgacctagaccgacgggaccggtacccgaggtcaacggtgagtggacgggtcttacggtacttacgttaacgtcggtacgtagggtccggacgggtaacacggcgaacgtcgacgttcccgcccgttagtacgtcgttaccgttacggaccgtaagggacctaaggtcccacgttacgtaagttccgaacccg

SEQ ID NO: 380463 - DNA, 641 bp, Homo sapiens
  misc_feature: GZ8MTXP01AHMLQ.13.76.G10.1.454.CMB.2.raw
  modified_base (527)..(527): a, c, t, g, unknown or other
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtgggtcccgccgagggcctccgaggggaggggctggagtgcgttcttcttttattatagtagtggtacgtacatacgtccgcaagtaccgtccggtgggacgggggccctagttccaccgtactctacccaggacacaaattcccaaagaaccacgtcttgtttctaacaaatcgaacagggtccctaggacgacgacccgtagtgaacccgacgggtccgttaggttaatttccgggnggtaacggacggaagggacggttacgggtacccggggaaccccttaaacgggttaccgtttacgaacggtcgtaaggtcgggacggttcgggtaaccggggaacccgaacgggg

SEQ ID NO: 380464 - DNA, 592 bp, Homo sapiens
  misc_feature: GZ8MTXP01D3VC2.13.76.G10.1.454.CMB.2.raw
  modified_base (340)..(340): a, c, t, g, unknown or other
  modified_base (499)..(499): a, c, t, g, unknown or other
  modified_base (517)..(517): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtcgtccgtcgtccccaggacagacagccagcatcacctgctactaggaaataaattggacaagaataaatatacttcctgtatcagcagaagtcaggccacgtcccctgtcgctggtcatctatacaagtatcgaccaagccggccctagacgggacttcccccgnggacgcgtattcgtctcggcctaccaaacgtcgtacgggaactcgacgccctactcctacgaccctataccgacggacccgggaccctaggtacctagagggaatgacggtcctaggtaactttacttacgtgtacgaggtcggtacgggctaaggcgngtaccaacgtcgcccgtnttagtcggtcgttacggacgttcgggaacctaacgggtccctaaccggtccgttaacgtccgaaccgtaaccccg

SEQ ID NO: 380465 - DNA, 664 bp, Homo sapiens
  misc_feature: GZ8MTXP01ERENW.13.76.G10.1.454.CMB.2.raw
  modified_base (421)..(421): a, c, t, g, unknown or other
  modified_base (461)..(461): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagcgtggtggagtcgtggaggaggcttgatccgagccgtgggggtccctgagactctcctgtgcagcctcgtggtcaccgtcagtcacacctacatgagcgtgggtcccgccgaggccgtaccgaagggggaacgggggcgtgggagtgcgttctttcttttaatttatagtagtggtagtaccattactcgcagaacctccgtggacggggccgtatccactatctaccgaganaacaatacccaaagaaccacgtcttttagtttacctaaanaaagtcgaaacgtcgaccggtaggaacggacgaccgtaagtcggaaccgacgggttacgttagttaagttcgtggacggaacggaagttacgggacggttacccggggaacccctaaacggttaaaccgtttcgaaccggtgttaacgggtcgggtaccgggtacggggttaaccgggggaaacccgttaaaccggggccccg

SEQ ID NO: 380466 - DNA, 667 bp, Homo sapiens
  misc_feature: GZ8MTXP01DGXAD.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccgagccgtgggggtcctgacgactctcctgtgcagcctcgtgggttcaccgtcagtcacacctacatgagcgtcgggtcccgcgaggccgtccggaggggaaggggcgtggagtcgtcgttctttacttttatttagttagttaggtggtacgtaccatactcgacacgtaaccgtcgtggacgggcctacgttccacctacgtctaccagacaactaacttaccgaaagtaacacgttcttagtttactacaaaatcgaaactcgaccgtagacggacgaccgtaatcggaaccgccgggttaccgttagttaacttacgtgggttcgaacggtaaggacggtacgggccgggggtaacccctaaagggttaaacccgtttacgaaccggtcgttacggtcgggtaccggtccgggttacgggggaaccccgttaacggggtaaccccg

SEQ ID NO: 380467 - DNA, 660 bp, Homo sapiens
  misc_feature: GZ8MTXP01BIFSP.13.76.G10.1.454.CMB.2.raw
  modified_base (249)..(249): a, c, t, g, unknown or other
  modified_base (377)..(377): a, c, t, g, unknown or other
  modified_base (465)..(465): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcngcctcgtgggtcaccgtcagtcacacctacatgacgcgtcggggtcccgccgaggcctccggaggggaagggggctgggagtcgcgttcttctttttatttatagttagtggtagtaccatactccgnacgaacctcccggtggacggggccgtacttccacctatcctccagacgactaattccaaagacacgtcttgtttctacaattgaaacncgtccgtagacgcgaccgagtcggaccgtaccgggtcccgttaggttaactttaccgttggtagggaaccggaaaggacgggtaacggttccggggggtaacccccctaaacggggttaaccgtttaccgaccggtaacgttaggtccgggtacggttccgggacgggggtaacccgaaacggggggtaaccccg

SEQ ID NO: 380468 - DNA, 635 bp, Homo sapiens
  misc_feature: GZ8MTXP01BMWOH.13.76.G10.1.454.CMB.2.raw
  modified_base (250)..(250): a, c, t, g, unknown or other
  modified_base (362)..(362): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgacgactctcctgtgcngcctcgtggtcacgtcagtcacacctacatgagcgtcggtccgccgaggcctccgaggggaggggcgtggagtgcgtcttcttttatttattagtagtggtagtaccatacnccgcagaacgtccggtggacggggcccgtattccacctatcctacccagaagaacctaaattccccgaaaagtaaccgtaccgtacgtttacgtttacttaaccaaatcgaaacacgtcctaggaggacgacccgataccggactaccggggtccgttggttaacttaccgtggtcggaacggtaagcgggtacgttccgggggaccccaagggttaaccgtttacgcgtaactggcggtcggtcgggacggggccgttaacggggaaccccg

SEQ ID NO: 380469 - DNA, 687 bp, Homo sapiens
  misc_feature: GZ8MTXP01AWCHZ.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtgggtcccgccaggctccgaaggggaggggctggagtgcgtcttcttttattatagtagtggtagtacatactccgcagaactccggtggaggggccattcaccatctcagacaactatcaaagacacgcttcgttctacaaaatgaaactcgtccgtagaacggacgcccggtaatcgaaccgtacggggtacccggtttagtaaacgtttacccgtgggcgggaaccgtaaagggagggtaacggttcccggggggaaacccccctaaaaggggtttaaaaccccggtttaccgttaaaccgggttccggttaaaaggttcggggggtaaaaccccgggttttcggggttaaccgggggggggtaaccccaaaaaccggggggggtttaaacccccg

SEQ ID NO: 380470 - DNA, 629 bp, Homo sapiens
  misc_feature: GZ8MTXP01EVNFS.13.76.G10.1.454.CMB.2.raw
  modified_base (172)..(172): a, c, t, g, unknown or other
  modified_base (237)..(237): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctnagtgtcccgtgtccccaggacagacagccagcatcacctgctctagaaataatggcagataaatntactctggtatcagcagagtcagccagtcccctgtgctggtcatctatcaagactcgacctaaggccgccctgacgggactcccccgtgagcgtattcctcgtggcctaccaactcgtcggggaaacctcgacgtcccactcgtacgacccatccgacggaccgggacccgaggcttagcgagtaggacggtctaggtacttaagttacgtacggtacgacgggttcggtacggggactaggaccgtaacgccgtaaccggttcgggacccgtacgttacgtacgggtttaccggtttaaccggggaaccggtttacgggggaacccctaacgggggttaaccctaacccgggttacccgttaaaggttccccgaacccggtaacccccggg

SEQ ID NO: 380471 - DNA, 595 bp, Homo sapiens
  misc_feature: GZ8MTXP01ADBPI.13.76.G10.1.454.CMB.2.raw
  modified_base (297)..(297): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcacgcctctgggttcaccgtcacgtcacacctacatgagcgtgggtccncaggctccgagggaggggctggagtgcgtcttcttttattatagtagtggtagtaccatactcgcagaactccgtggaggggccattcacatctccagacacaattccaaagacacgcttagtttacctacaaatgaacacgccggtagaaggacggacccagtcgaaccgacggggtccttagtactacgtgtggaacgaagttagacgcgggggacccctaaacggttaccgtttacacccggtaattaggtcggtaccggtcgggttacgggggaaccgaacgggggtaaccccg

SEQ ID NO: 380472 - DNA, 661 bp, Homo sapiens
  misc_feature: GZ8MTXP01D8QGS.13.76.G10.1.454.CMB.2.raw
  modified_base (395)..(395): a, c, t, g, unknown or other
  modified_base (412)..(412): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttatttaaaggtgccagtgtgaggtgcagcgtggtggagtcgtgggaggaggtcttgatccgaggccgtgggggtccctgacgactctcctgtgcacgcctcgtgggttccaccgtcacgtcaccacctacatgagcgtcgggtccgccgaggcctccggaaggggaaggggctagggagtgtcgttctttcttttattataggtagtggtagtaccatactccgcagtaacctcgngggacgggctatccacntcctacaagacgaactaatccaaaagtacctacggttctttacgtttacctaacaaagttcgaaaacgtcggaccgttaggaaacggaccgaccggaagtaccgacccgtacggggttaccgttgttacttacggtgggtacgaaggaagagggtcgggttaccgggggaaccctaacgggttaaactttcggacccgtgttacggtcgggtaaccggtcggttacgggggaaccaacgggtaaccccg

SEQ ID NO: 380473 - DNA, 584 bp, Homo sapiens
  misc_feature: GZ8MTXP01ESMNX.13.76.G10.1.454.CMB.2.raw
  modified_base (237)..(237): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataatggcagataaatntacttctgtatcagcagagtcaggccagtcccctgtgctggtcatctatacaagatcgaccaaggccgccctagacggggactcccccgaggacgcgtacttccgtaacgtcggccctaccgtaaacgttcgtacgggtaacctcgacgtccctaactctacggacctacgaccgaacggaccgggacccagggcctagtacggactacggacgtcgtacggtacttacttacgtgtacgagggcggtacggggactacgcgacggcaacgtcgccgtcttagtcgttacgttacggacgttcgggaaccaggtaaccgtaccgtacgttacgtccaacgaaccccg

SEQ ID NO: 380474 - DNA, 581 bp, Homo sapiens
  misc_feature: GZ8MTXP01CD20Q.13.76.G10.1.454.CMB.2.raw
  modified_base (398)..(398): a, c, t, g, unknown or other
  modified_base (434)..(434): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtgggtcaccgtcagtcacacctacatgagcgtcgggtcccgccgaggcctccggaggggaacgggggcgtgggagtgcgttcttcttttattagtagtaggtgtagtaccatactcgcagactcgtggagggccgatcaccntctcagacgactatccaaagacacgtcttgttctanaaatgaacacgcgtagagacgccgatcgaccgacgggtcctgttaacttacgtggtgcggtaagagggtacgcgggggacccctaaggttaaaccgttcgacgtcgtagtcgggacgtcggacgggggaaccgaacggggtaacccg

SEQ ID NO: 380475 - DNA, 571 bp, Homo sapiens
  misc_feature: GZ8MTXP01CEP13.13.76.G10.1.454.CMB.2.raw
  modified_base (236)..(236): a, c, t, g, unknown or other
  modified_base (501)..(501): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataatggacagataaatntacttctgtatcagcagaagtcacggccacgtcccctgtgctggtcatctatacaagatgaccaaggccggccctcgacgggactccccccgtagagcgtattcctcgtcggtcctacctaactcgtacgggaactcgacgccctactctacgaccagtcgacggccgggtaacccgaggtcctagtgggactaggacggtccgttagtacttacgttacgtggttccgagggcggtagggacagcgagccgaacgtcgcccgtnttagttcgtcgttacggacgttacgggaacctaggtccctaccgtacgttaacgtccgaaccgaaccccg

SEQ ID NO: 380476 - DNA, 627 bp, Homo sapiens
  misc_feature: GZ8MTXP01AL8F2.13.76.G10.1.454.CMB.2.raw
  modified_base (466)..(466): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccgagccgtgggggtccctgagactctcctgtgcagcctcgtgggtcaccgtcagtcacacctacatgagcgtcgggtccgccgaggctccgaggggagggggctggagtgcgtcttcttttattatagtagtggtagtaccatactccgacagtaaccgtccgtggacggggcccgtattcccactactctacccagaacgacaaattcccaaagaaccacggtcttgtttactaacaaatcggaaacncgtccgtagaacggacgacccgtaagcggaaccgtacgggtacccgttagttacgtttaccgtaggttcggaaccgtaaggacggtacgttcgggggaccctaaacggttacgttacgacgtctaggtcggtacgtcgcggggaaccgaacgggtaacccg

SEQ ID NO: 380477 - DNA, 595 bp, Homo sapiens
  misc_feature: GZ8MTXP01BCH1D.13.76.G10.1.454.CMB.2.raw
  modified_base (252)..(252): a, c, t, g, unknown or other
  modified_base (305)..(305): a, c, t, g, unknown or other
  modified_base (450)..(450): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccgagccgtgggggtccctgagactctcctgtncacgtcctcgtcggttccaccggtcagtcacacctacatgagcgtcgggtccnccgaggcctaccggagggggaagggctgggagtcgcgttcgtttcttttattagtagtagttggtagtacagtacctcgacagcgtcggtgacggggcctagttccacctatctccgaagacgacaacgttaccaaagacacgtnttcttactacaaagtcgaacacggtcagaacgcgacccgagtacgaaccgcgggtccttaggtaacttcgtaaggcgagagttgaacggtcggggaccacggttaacgttcacgctagtcggacggttccggaacgggaacccgg

SEQ ID NO: 380478 - DNA, 659 bp, Homo sapiens
  misc_feature: GZ8MTXP01BCGVB.13.76.G10.1.454.CMB.2.raw
  modified_base (279)..(279): a, c, t, g, unknown or other
  modified_base (371)..(371): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagctctcgggtcaccgtcagtcacacctacntgagcgtgggtcccgccaggctaccggaggggaagggggctagggagtgtcgttcttactttttatattagtagtggtataccatactccgnacgaactccgtggacggggcctattccaccagtcctaccgagacgaacaacttccgaaagaactaccggtctttcgtttactactaaatcgaacacgacctaggacgacgcccggaatcgaccgtaccgggtacccgttgttaacttacgtggtcggcggaaggacggacggttcccgggggtaaacccctaacgggttaaaccgtttaccgaccggtccgttaaacggttccggggtaacgggttcccggttacggggggaaccccgttaaacgggggtaacccccg

SEQ ID NO: 380479 - DNA, 681 bp, Homo sapiens
  misc_feature: GZ8MTXP01EP3QG.13.76.G10.1.454.CMB.2.raw
  modified_base (466)..(466): a, c, t, g, unknown or other
  modified_base (476)..(476): a, c, t, g, unknown or other
  modified_base (488)..(488): a, c, t, g, unknown or other
  modified_base (499)..(499): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggtagttttggctgagcttgggttttccttgttgcttattttaaaaggtgccagtgtgaggtgcagcgtggtggagtcgtggaggaggcttgatccaggccgtcgggggtcctgacgtactctcctgtgcagcctcgtcgggttcaccgtcagtcacactacatgagcgtcggtcccgccgaggccgtaccgggaggggaagggggtctaggtagtggtcgttcgtttactttttattagtaggttgtaggtacgtaacctacttactccgacgtacgtaacccgtcggtgggacggggccctattccacctactcaccgagaactactaaactccgaaanaactaccgtntttcgttactanaaatcgaaacncgtacggtagaagtacgaccagtccgacgtacgggtcctttagtacgttacggtggtagaacggtaacgttacgggtaccggttacccgggaacccttaaacgggttaccgttaccgttacgtaacgttacgggtccggtaccgggtccggggaccggggtaacccggttaaccgggtcccg

SEQ ID NO: 380480 - DNA, 593 bp, Homo sapiens
  misc_feature: GZ8MTXP01B3HEC.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggattcacctttgatgattatgccatgcacgtgggtcccggcaagcctccgagggggaacgggcctgggagtgggtctcgaggttattaggttggaatacggtggtagcagtaggctatggcgggactcgtagtggaacggggccgtagttccacactctccagacgaaccaacgaccaacgaacctccctgtatctggacaaagtgaacagcctgagagcgtggacggacgacggtccttaggttattagttcgtagaacaaaaggttaccttaccctaaccccgttacgttaacgtttttagggaggtttagggttaacgttaaccggtaacgggg

SEQ ID NO: 380481 - DNA, 732 bp, Homo sapiens
  misc_feature: GZ8MTXP01DFSFZ.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttaattttaaaaggtgcccagtgtgaggtgcagcgtggtggagtcgtggaggaggcttgatccgagccgtgggggtccctgagactctcctgtgcagtcctcgtgggttccaccgtcagtccacacctacatgagcgtcgggtcccgcgacggccgtaccggaggggaacgggggcgtagggagtcggtcgtttctttacttttatttagttagttagtggtacgtaccactacgtccgacacgtaaccgtccggtgggacgggtccgtacttccacctactcctaccgaagaacgtaactaaacttaccgaaagtaaacctacgttctttacgttttacctaacgaaaacgttacggaaacctacggtaccggttaagggaaacggaaccggacccgtaaagtacccggaacccgtaccggggttacccgttagttaactttaccggtggttacggaaccggaaagggacggtacgggttcccgggggaaacccctaacgggttaaaccgttaccgttacgtaacgtaggtcggtaacggtcgggttaccggggaaccgttaaacgggcccg

SEQ ID NO: 380482 - DNA, 591 bp, Homo sapiens
  misc_feature: GZ8MTXP01C33FR.13.76.G10.1.454.CMB.2.raw
  modified_base (301)..(301): a, c, t, g, unknown or other
  modified_base (405)..(405): a, c, t, g, unknown or other
  modified_base (427)..(427): a, c, t, g, unknown or other
  modified_base (437)..(437): a, c, t, g, unknown or other
  modified_base (440)..(440): a, c, t, g, unknown or other
  modified_base (459)..(459): a, c, t, g, unknown or other
  modified_base (489)..(489): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatccagccgtgggggtccctgagactctcctgtgcagcctcgtgggttcaccgttcagtcacacctacagtgagcgtcgggtcccncgaggcctccgaggggaacggggctggagtgacgttcgtttctttatttatagtagtgtagtacatacgtcgcagacctccgtggacgggctattcgacagtcncagacacaattccaagacagtnttgttctaanaangacgcgcgagagcgacganacgaccgtacggacgttagttacttacggngtcggaacgaaggacggtacggaccgggtaccctaacggttaaccgttcgaacgtcgtacggtcgggtaccgtcgggttaccgggaaccgaaccgggtcccg

SEQ ID NO: 380483 - DNA, 658 bp, Homo sapiens
  misc_feature: GZ8MTXP01DJL5T.13.76.G10.1.454.CMB.2.raw
  modified_base (290)..(290): a, c, t, g, unknown or other
  modified_base (306)..(306): a, c, t, g, unknown or other
  modified_base (349)..(349): a, c, t, g, unknown or other
  modified_base (378)..(378): a, c, t, g, unknown or other
  modified_base (382)..(382): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagcgtggtggagtcgtgggagggaggcttgactccgagccggtgggggtccctgacgactctcctgtgcagcctcgtgggttccaccgtcagtcacacctanatgagcgtcgggcccncaggcctaccggagggggaacggggctggagtcgcgttctttnttttatttagtagtagtggtatacatacnccgnacgactcgtgggacgggcctattccacctatccacgagacaactaacttaccgaaagaacacgtctttagttttacctaacgaaaagtcgaaacacggaccgttaagggaggaaccgaccgtaagtcggaacccgtaccgggtccttagttaacttacgtgggtacggaacggtaaggacggtacggttacccgggggaacccctaacggttaaccgtttccacggtctaaagtcgggaacgtcggttacgggggaacccaacgggggtaaccccg

SEQ ID NO: 380484 - DNA, 620 bp, Homo sapiens
  misc_feature: GZ8MTXP01AQ8P4.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaggtgcccagtatgaggtgcagctggtggagtctggaggaggcttgatccgagccgtgggggtcctgagactctcctgtgcagcctcgtgggtcaccggtcagtcacacctacatgagcgtcgggtccgccgaggcctccggaggggaaggggcgtgggagtggtcgttctttcttttatttagtaggtagtaggtagtaccatactccgcacgtaaccgtccggtggacggggccgacttccaccactctaccagagaactaactaccaaagaactacgtcttgtttactacaaatcgaaactcgaccgtggaagacgaccgtaatcgaacaccgggtccgttagtacttacgtggtacggcgaaggaggtaacgttcgggggaacccctaaggttaaccgttacacggtctaggtcggacggtcggttacggggtaaccgaacgggtaacccg

SEQ ID NO: 380485 - DNA, 563 bp, Homo sapiens
  misc_feature: GZ8MTXP01BL82X.13.76.G10.1.454.CMB.2.raw
  modified_base (293)..(293): a, c, t, g, unknown or other
  modified_base (329)..(329): a, c, t, g, unknown or other
  modified_base (439)..(439): a, c, t, g, unknown or other
  modified_base (482)..(482): a, c, t, g, unknown or other
  modified_base (488)..(488): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccnccaggcctccgaggggagggctggagtgcgtctttnttttattatagtagtggtagtaccatactccgcagaacctcggtgagggggtcccattccgaccagtctcagagacaattccaagacacgcttgttctacaaatgaaacngccgtgaggacgccgatcgacgacggccgtgtattactgtcgnggaagnggacgttcggggaccccaaggttaaaccgttcaacgctagtcggacgtcgttggggaacccgaaggggaaccccg

SEQ ID NO: 380486 - DNA, 654 bp, Homo sapiens
  misc_feature: GZ8MTXP01D7VQP.13.76.G10.1.454.CMB.2.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtcgtcccgtgtccccaggacagacagccagcatcacctgctacaggaaataatggacagaataaatatacttcctggtatcagcagaagtcaagcacgtcccctgtcgctggtctatctatcaagatcgacacgcggccctgacgggactcccccgtgacgtcgtaacttccgtacgtcggcctacccgtaaacttcgtacgggaactcgaacgtccctactctacggaccactcgaacggaccgggaccctaggcctagtggaagtaggacggtcgttacggtaactttaacgttaccgtggttaccgaggggtacgttacggggaacctacgggtaccgtacgggacctaaacgtccggttccccggtatttacgtacgggtttccgtttaacgggaaccggtttacggggaacccggtaaacgggttaaccccgtaacccggttacccgttaacggttcccgaacggtaaaccccccgg

SEQ ID NO: 380487 - DNA, 593 bp, Homo sapiens
  misc_feature: GZ8MTXP01DTZBJ.13.76.G10.1.454.CMB.2.raw
  modified_base (293)..(293): a, c, t, g, unknown or other
  modified_base (361)..(361): a, c, t, g, unknown or other
  modified_base (546)..(546): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggtcaccgtcagtcacacctacatgagctgggtcccnccaggcctccgagggaaggggctggagtgcgtcttcttttattatagtagtggtagtacatactccgnagaacctcgtggacgggccgattcaaccctatcctaccagtacgaacaaattaccaaagaaaccacgtcttgtttacttacaaaatgaaactaggccctgaagacgaccgatcgacacggtccgtagtattacgtagtcgaagagagtcggggacccaacgtaacgttaaccgttcgaccgtaanggggtaaccgttcggcgggggaccgtaacggggaacccgtaaccggg

SEQ ID NO: 380488 - DNA, 627 bp, Homo sapiens
  misc_feature: GZ8MTXP01B5PFT.13.76.G10.1.454.CMB.2.raw
  modified_base (442)..(442): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctctgtgcagcctctgggttcaccgtcagtcacacctacatgagcgtcgggtcccgccgaggcctccgagggggaaggggctgggagtgtcgttcttctttttattagtagtagtggtagtaccatactcgacagacctccggtggacggggcctattccaccagtctaccagtacgaactaacttccaaaggaacctaccgnttttgttttacctacaaaattcgaaactcgtaccgtggaagaccgtccgaattccggaaccgtccggggtccgttagttaagttccgtgggtcggaacgtaaggaggtacgttccggggaccctaacggttaacggttcaacgctagtcgggcgtcggttcggggaacccttaacggggaacccc

SEQ ID NO: 380489 - DNA, 599 bp, Homo sapiens
  misc_feature: GZ8MTXP01ALKVL.13.76.G10.1.454.CMB.2.raw
  modified_base (494)..(494): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagctgggtcccgccaggcctccgaggggaaggggctgggagtgcgtcttcttttattatagtagtgtagtaccatactccgcagaactccgtggacgggggcctattccacctatcctaccagacgacaattaccaagaacacgtcttgtttactacaaatgaacacgccgtagagacgaccgagtcgacgtacggccgttgtattacgnggtaggcgaagacgggacgttccgggggacccctaacggttaaccgttacgttacgtaacctagtaacgggaccgtcggttcgggggaaccgaagggtaaccccg

SEQ ID NO: 380490 - DNA, 618 bp, Homo sapiens
  misc_feature: GZ8MTXP01D16C8.13.76.G10.1.454.CMB.2.raw
  modified_base (171)..(171): a, c, t, g, unknown or other
  modified_base (322)..(322): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgccttactgcacaggatccgtggcctcctatgagctgactcagccaccctnagtgtccgtgtccccaggacagacagccagcatcacctgctctaggaaataattggacagataaatatacttcctggtatcagcagagtcagccagtcccctgtgctggtcatctatacaagatcgcaagccggccctgagggctcccccngacgcgattctcgtaggcctaccaaacgttcgtacgggaaaccttcgacgccctaacttctacggaaccattaccgacggacccggggaccccaggggtacccttagtcgggaagttagggaacgggtcttacggtaactttaacgtttacccgtaggttacgacgggtcggtaggggacctacgggcaaggccaacgttcgacccgtcttacgtcgttccgtttacgggaacgttcggggaaccctaaggggttcccaacccggttccgttaaacgtccgaaccgtaacccccgg

SEQ ID NO: 380491 - DNA, 577 bp, Homo sapiens
  misc_feature: GZ8MTXP01EL9B0.13.76.G10.1.454.CMB.2.raw
  modified_base (394)..(394): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctatttaaaaggtgcccagtgtgaggtgcagctggtggagtcgtggaggaggcttgatccgagccgtgggggtccctgagactctcctgtgcagcctcgtgggtcaccgtcagtcacacctacatgagcgtcgggtccgccgaggcctacggaggggaagggggcgtggagtgtcgttctttacttttattagtagtagtgtagtacatactcgcagactcgtggacgggcatcacntctcagagactaatacaagacacgtcttgttctacaaatgaacagcgtagacgacgcgatcgacgcggtccgtgtacttacgtggtgaacggtagagacggttcggggaccctaacgggttaacgttcgttacgcttaggtcgggtacgggttcgggaccgtaacggggttcccgtaaccggg

SEQ ID NO: 380492 - DNA, 686 bp, Homo sapiens
  misc_feature: GZ8MTXP01CABOB.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagcgtcgggtcccgccgaggccgtaccggaggggaacgggggcgtgggagtcggtcgttctttcgtttttatttagtagttagtggtagtaccatactccgcagaaccgttccgtggacggggccgtattccaccatctaccgagacgaactaattacccgaaagaacctacgtcctttgtttacctaacaaaagttcgaaacacggtcctaggaacgacgacccgtaatcggaacccgacggtccgttagttaacgttacgtggtggaaccggtaaggacgggtacggttcccgggggaaacccccgtaaggttaaaacccggtttcgaaccggttccgttaaggttcggggtacccgttaccggggttaccgggggaacccggttaaccgggggtaacccccg

SEQ ID NO: 380493 - DNA, 680 bp, Homo sapiens
  misc_feature: GZ8MTXP01E135I.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccaggccgtggggggtcccggagactctcctgtgcagcctcgtgggttcaccgtcagtcacacctacatgagcgtgggtcccgccgaggcctccgaaggggaagggcgtggagtgcgttcttactttttatttatagttagtggtagtactactacctcgacagacctccggtggaacggggccgtattcaccattccaccagacgaactaattacccaaagaacacgtcttagtttacttacgaaatgaaacagcccgtaggaacggacgcccggtaatcggaaaccgtaccggggtacccgttaggttaacttttaccgtggtcggacgggaaggtagggaacggttccgggggaaaccccctaacgggttaaacccgtttaccgttaccgttacccgttaagttccggggaaccggtttcggtacggggggaccccgtaaaacgggggcccctaaccggggg

SEQ ID NO: 380494 - DNA, 613 bp, Homo sapiens
  misc_feature: GZ8MTXP01C7RLH.13.76.G10.1.454.CMB.2.raw
  modified_base (461)..(461): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtgggttcaccgtcagtcacacctacatgagcgtggtcccgcgaggcctccgaggggagggctgggacgtgtcgtcttcttttatttagtagtagttggtagtactatacctccgacagtccgtccggtggacggggccgattcaccatctaccagacgacaattcccgaaagacctacgtcttgtttactacaaatcgaaacncgtcctagacgtacgcccgagtcgaaccgtcggtccgttagtacttacgtggtcggacggtaaggacggtacggtccgggggaccccttaaggttaaccgttaaccgtacgtcgttagtcgggttaccggttcggttcgggggaaaccccgg

SEQ ID NO: 380495 - DNA, 702 bp, Homo sapiens
  misc_feature: GZ8MTXP01EZZYN.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtcgtggaggaggcttgatccagccgtgggggtccctgagactctcctgtgcagcctcgtgggttcaccgtcagtccacacctacatgagcgtcgggtcccgcgaggccgtaccggaggggaacggggctgggagtcgtcgttctttactttttattatagtagtaggtagtaacctatactccgacacgtaaccgtcggtgggacggggtcccgattccaacctactcctacccgaagaacgaacctaaacttccgaaaagtaaccaaccggttcttttacggttttaccttaacaaaagttcggaaaacctacggtacccgttagggaaacggtaaccgtacccggaagttacccggaaccgtaccggggtacccgtttagttaacgtttacctgggtacgaacggaaggacggtacggttccgggggaacccctaacggttaaacgtttccgacgtaacgtagtcgggaccgtcgggttacgggaacccgaagggggaaccccg

SEQ ID NO: 380496 - DNA, 587 bp, Homo sapiens
  misc_feature: GZ8MTXP01DKFD8.13.76.G10.1.454.CMB.2.raw
  modified_base (457)..(457): a, c, t, g, unknown or other
  modified_base (485)..(485): a, c, t, g, unknown or other
tcagtcacgtactacacgaccggtgctcgatttagtcactcatacagggggggagaggagcccagcactgggattccgaggtatttccattcggtgatcagcactgaacacagaggactcaccatggagttttggctgagctgggttttccttattactattttaaaaggtgtccagtgtgaggtgcagttggtggagtctggaggaggcttggtccaggccggggggggtccctgagactctcatgtgcggcctctgggctcaccgtcaacaccaactacatgagctgggtccgcaggctccgagggagaggccggagtgggtctcagttatttatgtcgacggtgccacattctacgcagactccgtgaacggggccgttcacctatcctccagagacaacttaccaagaacacggtgtatctacaaatgaacgacctagagagtcgaggggacncggccgtctattactgtagacgaaagtntgcgaggaaggacgggccccgtaaaggcggggccgtggggttcgggttgggtttcttcgtttaggaacgtggcggttgggggcccgaacgggggtaaccccg

SEQ ID NO: 380497 - DNA, 605 bp, Homo sapiens
  misc_feature: GZ8MTXP01CJWUP.13.76.G10.1.454.CMB.2.raw
  modified_base (243)..(243): a, c, t, g, unknown or other
  modified_base (418)..(418): a, c, t, g, unknown or other
  modified_base (428)..(428): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagcccgccctcagtgtccgtggggcccccagggcaggagggtcaccatctcctgcacgtggggacncagcctaccaacgattggggcacattatgatgtacactggtaccagtctagtttccgaggtacgcgacggccccagacctcctacatcaaataccgtaacaacaacgtccggcccgacgaaccgggtccctagacccgtattcgtcgtcggtctccgagtcctacggcaccgtcncgcccttccngttaccacttcgacgtcggccttccggaggtcgtggagactgacggtctagtatttacgtttcgtcgtaccttaacggtccttacgtacgacgtacgaccgttacgttccgttggtaacgttcggttaaccgttcggggttacggttccgggggaacccggggttaacccgtccggg

SEQ ID NO: 380498 - DNA, 603 bp, Homo sapiens
  misc_feature: GZ8MTXP01A4RJA.13.76.G10.1.454.CMB.2.raw
  modified_base (263)..(263): a, c, t, g, unknown or other
  modified_base (400)..(400): a, c, t, g, unknown or other
  modified_base (423)..(423): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctatttaaaggtgcccagtgtgaggtgcagctggtggagtctggaggaggcttgatccagccgtggggggtccctgagactctcctgtgcagcctcgtggggttcnccgtcagtcacacctacatgagctgggtccgcaggctcgagggaggggctggagtgtcgtcttcttttatttatagtagtggtagtacctatactccgcagaacctccggtggacggggccacttcaccatctccanacgacaagtccaaagaacacgtntttcgttctacaaagtgaaactgaccgtaggacgacgtccggatcggacgtaccgggccgttagtattaccgtggtccgaaggaggaggtaaggttccgggggaccccaacggttaaaccgttcgttacggtaacctagtcggacgtcgggttacggggtaaccggaacgggtaaccccg

SEQ ID NO: 380499 - DNA, 650 bp, Homo sapiens
  misc_feature: GZ8MTXP01BYSET.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctatttaaaaggtgccagtgtgaggtgcagctggtggagtcgtgggaggaggcttggatccgaggtccgtggggggtccctgacgactctcctgtgcacgcctcgtcggtcacgtcacgtcacacctacatgagcgtcgggtcccgcgacggccgtaccggagggggaaggggcgtagggacgtgtcgttcttacgtttttatttagtagttaggttggtaagtacaatacctccgaacgacgtctccggtagggacggggtaccctattccgactactcctaccgagaacgactaaacttaccaaacgaactacgtcttacgttacttaacaaattagaaacgacgtaccgtaggaacgacgacccgtagtacggaaccgtccggtaccgttagttacttaacgtggtggacgagaggtacggtcgggggacccaacggttaaccgttaacacggtctaaggtcgggaccgtcggttcggggaacccgg

SEQ ID NO: 380500 - DNA, 552 bp, Homo sapiens
  misc_feature: GZ8MTXP01CG07V.13.76.G10.1.454.CMB.2.raw
  modified_base (338)..(338): a, c, t, g, unknown or other
  modified_base (391)..(391): a, c, t, g, unknown or other
  modified_base (397)..(397): a, c, t, g, unknown or other
  modified_base (399)..(399): a, c, t, g, unknown or other
  modified_base (406)..(406): a, c, t, g, unknown or other
  modified_base (412)..(412): a, c, t, g, unknown or other
  modified_base (414)..(414): a, c, t, g, unknown or other
  modified_base (424)..(424): a, c, t, g, unknown or other
  modified_base (426)..(426): a, c, t, g, unknown or other
  modified_base (435)..(435): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggggttcaccgtcagtcacacctacatgagctgggtccgccaggctccgagggaggggctggagtgcgtcttcttttatttanagtagtggtatacatactcgcagaactccgtggacggggccattcacctatcncagaananatacaanaacatntnttctactaananacacgacgngagacgacgagacgacgacgtacgtgtatagtgtgcgagagaggcgggaccgaacgttaacgttacgttacgtaactagtaacggtcggtcggttacgggtaacggaacgggaaccg

SEQ ID NO: 380501 - DNA, 745 bp, Homo sapiens
  misc_feature: GZ8MTXP01DLL4K.13.76.G10.1.454.CMB.2.raw
  modified_base (169)..(169): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccacctnagtgtccgtgtccccaggacagacagccagcatcacctgctacgtaggaaaataagttggacaagtaaataaattactacttctggtatcagacaagaagtcaggcctacgtcccctgtgcgtggtcatcctaatacaaagactcgaccgaacggccggtccctacgaacggggtacttcccccccgtaggaacgtccgtactttcccgtacgttccgggtccttaccctaaacgttccggttaacggggaaacccttcgaacgtacccctaccttacgtacggaaccctagttacccgaacggggtaccccggggaaccccgtaagggtacccgtaaaggttcgggaacgtagggtaaacgggtccttaacggttaaaccgtttaacgttacgtacggtacggaacgggtcgggtacggaacgtagaccgaacggcctaaacggtcccgttcccggtacgttacgttacggtccggtttaaccgggaccggttaacggggaaccgttaaaacccgggtcccgtaaaccccgggttacccttaaaacggtcccgttaacccgggtaaaaccccccg

SEQ ID NO: 380502 - DNA, 563 bp, Homo sapiens
  misc_feature: GZ8MTXP01CLS78.13.76.G10.1.454.CMB.2.raw
  modified_base (364)..(364): a, c, t, g, unknown or other
  modified_base (404)..(404): a, c, t, g, unknown or other
  modified_base (488)..(488): a, c, t, g, unknown or other
  modified_base (553)..(553): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtggggggtccctgagactctcctgtgcagcctcgtgggttcaccgtcagtcacacctacatgagcgtcgggtccgccaggcctccgagggggaaggggctgggagtgcgttcttcttttattatagtagtaggtagtanatactcgacagcgtcgtggacggggcatcacatctcaganacaataccaaagacagtcttattctaacaaatcgaaacacggcctggaacgagcccgatcggaaactcggtcttagtaacttgnggtagcgagagtaacggtcggggaccccaaggttaaccgttaacacgctaaggcggttacgtcgngggggaaccc

SEQ ID NO: 380503 - DNA, 615 bp, Homo sapiens
  misc_feature: GZ8MTXP01DV06O.13.76.G10.1.454.CMB.2.raw
  modified_base (252)..(252): a, c, t, g, unknown or other
  modified_base (392)..(392): a, c, t, g, unknown or other
  modified_base (395)..(395): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgctattttaaaaggtgcccagtgtgaggtgcagcgtggtggagtcgtggaggaggcttgactccgagccgtgggggtccctgagactctctgtgcngcctctgggtcaccgtcagtcacacctacatgagcgtcggtccgccgaggcctccgaggggaggggctggagtgtcgttctttcttttattagtagtagtggtatacatactcgcagaactcgtggacgggcctatcacntcncagagacaactccaaagaacacgtctttgtttactacaaatgaaacacgccgtagaacggacgacccgatcgaaccgtacggtccgtttagttaactttacgtggtggaacgtaaggaggtacggttccgggggaacccctaacgggttaaaccgtttcgaaccggtcgtaaggtcgggtaccggtcgggttacgggggtaacccgaacggggaaccccg

SEQ ID NO: 380504 - DNA, 632 bp, Homo sapiens
  misc_feature: GZ8MTXP01AH0RQ.13.76.G10.1.454.CMB.2.raw
  modified_base (244)..(244): a, c, t, g, unknown or other
  modified_base (271)..(271): a, c, t, g, unknown or other
  modified_base (275)..(275): a, c, t, g, unknown or other
  modified_base (309)..(309): a, c, t, g, unknown or other
  modified_base (540)..(540): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagtttggctgagcgtggtttcgtgtagctatttaaagtgccagtgtgaggtgcagcgtggtggagtcgtggaggaggcttgatccgagccgtgggggtcctgagactctctgtgcanctcgtggttcacgtcagtcacacctangtgngcgtcggccgcgacgcgacggagggaggcgtggngtcgtcgttactttatttagttagtagtcgtagttacgtacctactacgtccgacgtacgtaaccgtcgggtcgggtacgggtacctactaccgaactactacccgtacaagtaactaaacctacgtaaccgaaagtaaccgttacgttctttacgttactaaacgaaactagaacgtacgacggtacgacgacgacgacgtacgacgacgtacgtcgtagtacgtcgtgngagaggtacggaccggtaccgtaaccgttaccgttacgttacgtaacgtacggtaacggtcggtacggaccggtaaccggaaccggtaaccg

SEQ ID NO: 380505 - DNA, 603 bp, Homo sapiens
  misc_feature: GZ8MTXP01BM6D1.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggtcaccgtcagtcacacctacatgagcgtgggtcccgccaggcctccgagggaaggggctggagtgcgtcttcttttatttagtagtagtggtagtccaaaatctccgcagaacctccggtggacggggccgacttcgacctatctcccagagaacaacttaccaaagacacgtcttagtttactacaaattagaacacgccgtgaggacgaccgagtcgaccgacgggtcccgtgtacttacgtgtggccgtaaggaggtacgttcggggacccgtaacggaaccgttccttacgtctaagtcgggaccgtcggttcggggtaaccgaacgggtaaccccggg

SEQ ID NO: 380506 - DNA, 587 bp, Homo sapiens
  misc_feature: GZ8MTXP01ADCZ6.13.76.G10.1.454.CMB.2.raw
  modified_base (461)..(461): a, c, t, g, unknown or other
  modified_base (474)..(474): a, c, t, g, unknown or other
  modified_base (495)..(495): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtgggtcccgccaggcctccgaggggagggggctggagtgcgtctttcttttattatagtagtggtataccatactccgcagaacctccgtggaggggcccgattccgaccatctcccagacgactaattccaaagacacgtctgtttactacgaaatgaaactgccgtagagtcnccgaatcggaacncgggaccgttgtaacttacgngtgcgaagagacggttcgggggacccctaaggttaaccgttcaccggtctacgtgggtaccgtcgacgggggaacccaagggggtaaccccg

SEQ ID NO: 380507 - DNA, 656 bp, Homo sapiens
  misc_feature: GZ8MTXP01D6LB2.13.76.G10.1.454.CMB.2.raw
  modified_base (252)..(252): a, c, t, g, unknown or other
  modified_base (421)..(421): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatccgagccgtgggggtccctgagactctcctgtgcngcctcgtgggtcaccgtcagtcacacctacatgagcgtcggtcccgccgaggccgtccggaggggaaggggcgtggagtgcgttctttcttttattagttagtagtggtagtacctatactccgcagtaacctcggtggacggggccgtattccaccactcctacaganaactaacttaccaaagtaacacgtcttcgtttactaacaaatacggaaacacggccgtaggaacgacgacccgtatccggaaccgtccggtaccgtgttaacttaccgtggtagaaccgggaaggttaagggtacggttaccgggggaacccctaaacgggttaaccgtttacgttacggtaacctaggtaaccgggtacggtcggttacgggggaacccgaaggggtaaccccg

SEQ ID NO: 380508 - DNA, 740 bp, Homo sapiens
  misc_feature: GZ8MTXP01EG6VB.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgcttaattttaaaaggtgcccagtgtgaggtgcagcgtggtggagtcgtggaggaggcttgatccagccgtgggggtccctgagactctcctgtgcagcctcgtcggttcaccgtcagtcacacctacatgagtcgtcgggtcccgccgaggccgtccggaagggggaaggggtcgtggggagttcgtcgtttcttttactttttatttagttaggtagttaggtagtaccactacgtccgacgtacgtaacccgttcggtgggtacggggtcccgtaactttcccaaacccgtacttacccgtaacccgaggaaacgtaaacctaaacttaacccgaaaaggtaaacctacggtcttttacggtttaccttaacaaaagtcaaacgagtcccggtagaacggacgccggtaatacggaccgtacgggtaccgttagttaactttacgtggtccggaacggaaggttacgggcggttaaccggggggacccctaaaagggttaaacccgtttacgttaccggaacttaaggtcggggtaccgtcggggttaacggggaacccgttaaaacgggggtaacccccg

SEQ ID NO: 380509 - DNA, 649 bp, Homo sapiens
  misc_feature: GZ8MTXP01BEUNS.13.76.G10.1.454.CMB.2.raw
  modified_base (288)..(288): a, c, t, g, unknown or other
  modified_base (305)..(305): a, c, t, g, unknown or other
  modified_base (458)..(458): a, c, t, g, unknown or other
  modified_base (470)..(470): a, c, t, g, unknown or other
  modified_base (524)..(524): a, c, t, g, unknown or other
  modified_base (555)..(555): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgcttaattttaaaggtgccagtgtgaggtgcagcgtggtggagtcgtggaggaggcttgatccgagccggtcgggggtccctgagactctcctgtgcagtcctcgttcgggtccaccgtcagtcacacctanatgagcgtcgggtcccncgaggcctccggaggggaggggcgtgggagtgtcgttctttcttttattagtagtagtaggtagtaccactacgtccgcgacgtaccgtcgggtggacgggtccgtacttaccacgtactctaccgaaggtaacaacctacttaacccgaaanaccgtacccgtntttcgttacctaaacaaaagtcgaaactcggacctaggaacgacgacccggtanccggaccgacggttccgtattacgttacggngacggaagagacggcggttaccggaacctaacggttaccgttcgttacgtcgtaggaaccggtaccggtacgggaccggtaaccgaaccggtcc

SEQ ID NO: 380510 - DNA, 607 bp, Homo sapiens
  misc_feature: GZ8MTXP01AMPRI.13.76.G10.1.454.CMB.2.raw
  modified_base (414)..(414): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggtttttccttgtttctattttaaaaggtgcccagtgtgaggtgcagctggtggagtctgggaggaggcttgatccagccgtggggggtccctgagactctcctgtgcagcctcgtggttcaccatcagtcacacctacatgagcgtgggtccgcgaggctccggaggggaaggggctggagtgcgttctttacttttattatagtagtggtagtaccatactccgacagaaccgtccggtggcggggcccattccacatctaccagtaanaaccaattaccgaaagacacgtcttcgtttactaacaaatcgaaactaggcctaggagcgaccgatcgacgaccggtcgttagtacttactgtacggaacgaaggaggtacggttcgggggacccctaaaggttaaccgttcaccggtaattacgcgggacgttcgggacggggaaccgaacggggaaccccg

SEQ ID NO: 380511 - DNA, 617 bp, Homo sapiens
  misc_feature: GZ8MTXP01A1Z42.13.76.G10.1.454.CMB.2.raw
  modified_base (381)..(381): a, c, t, g, unknown or other
  modified_base (414)..(414): a, c, t, g, unknown or other
  modified_base (454)..(454): a, c, t, g, unknown or other
  modified_base (504)..(504): a, c, t, g, unknown or other
  modified_base (518)..(518): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtcgggccgccgaggcgtccggaggggaaggggcgtggagtgcgttctttcttttattatagtagtggtagtaccatactcgcacgaactccggnggacggggcctacgttccaccactctaccaganaacaataccaagacacgtcttgttactacgaaatcgaacncgacgtaggagacgaccgagtcgaccgacgggtccgttgtaactttacgnggtaggcgtaaggngtacgggttccggggaaccctaacggttaacccgttacgttaccgcgttaacggtcggtacggttcgggacggggtaacccgttaaacggggaaccccg

SEQ ID NO: 380512 - DNA, 576 bp, Homo sapiens
  misc_feature: GZ8MTXP01EUVB7.13.76.G10.1.454.CMB.2.raw
  modified_base (294)..(294): a, c, t, g, unknown or other
  modified_base (435)..(435): a, c, t, g, unknown or other
  modified_base (472)..(472): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccnccaggctccgagggaggggctggagtgcgtcttcttttattatagtagtgtagtacatactcgcagaactccggtgacggggccgtattcaccatctcagagacaatccaaagacacgtcttgttacttacaaatgaaacngccgtgaagacgccgatcgaccacggctgtattacgngtgcgagagcgttccgggggaccctaacgggttaaccgtttcacggtaactacggtcgggtaccgtccgggttacgggggaacccgttaaacgggggaaccccg

SEQ ID NO: 380513 - DNA, 551 bp, Homo sapiens
  misc_feature: GZ8MTXP01D8Q0S.13.76.G10.1.454.CMB.2.raw
  modified_base (361)..(361): a, c, t, g, unknown or other
  modified_base (459)..(459): a, c, t, g, unknown or other
  modified_base (475)..(475): a, c, t, g, unknown or other
  modified_base (483)..(483): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagctgggtccgccaggctccgaggggaggggctggagtgcgtcttcttttatttatagtagtggtagtacatactccgnagaactccgtggaggggccgattcaccatctccagagacaagtccaaagaacacgtcttgtttctacaaatcgaaacacgcctagagagccgatgacncggccgtgtacttagngtgcgagngagttcggggacccacgttaaacggttcttacgctaagcggacgtcgttggggccaaggggtaacccg

SEQ ID NO: 380514 - DNA, 625 bp, Homo sapiens
  misc_feature: GZ8MTXP01EKEPI.13.76.G10.1.454.CMB.2.raw
  modified_base (369)..(369): a, c, t, g, unknown or other
  modified_base (459)..(459): a, c, t, g, unknown or other
  modified_base (471)..(471): a, c, t, g, unknown or other
  modified_base (503)..(503): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccgagccgtgggggtccctgagactctcctgtgcagcctcgtgggttcaccgtcagtcacacctacatgagcgtgggtcccgccgaggcctccgaggggaagggggctgggagtgtcgtctttcttttatttatagttagtggtagtacatacncgacagtaaccgtcggtggacggggccctacttccgacctactcgtacccagacgaacaattaccaaagaactacgtctttgttcctaanaaatggaaaccncgcggagagacgcagcgacgtacggtacgttntacgtacgtggtcggaacgaggacggtcgggttacccgggaaccctaacggttaaccgttcgttacgtaacgtaggtcgggtaccggtcgggttaccggggtaacccggaacggtaaccccg

SEQ ID NO: 380515 - DNA, 637 bp, Homo sapiens
  misc_feature: GZ8MTXP01ARHTZ.13.76.G10.1.454.CMB.2.raw
  modified_base (415)..(415): a, c, t, g, unknown or other
tcagtcacgtactacacgaccggtgctcgatttagtcactcatacaggggggagaggagcccagcactgggattccgaggtgtttccattcggtgatcagcactgaacacagaggactaaccatggagttttggctgagctgggttttccttgttgcttattttaaaaggtgcccagtgtgaggtgcagctggtggagtctggaggaggcttgatccagccgtgggggtccctgagactctcctgtgcagcctcgtgggttcaccgtcagtcacaccacatgagcgtgggtcccgccgaggctccggaggggaaggggcgtgggagtgcgttctttctttttatttatagttagtggtagtactactacctcgcagaccgtccggtagggcggggcctattccaccatctcaganacaatccaaagacacgtcttgtttactacaaatcgaaacagtccctaggggaacgacggcccgagtacggacctacggggtccttaggttacttaccgtgtcggacggaaggtaggttacggtccgggggacccctaaacggtaaaccgtttacgaacgttcgttaagtcggggtaaccgttcgggaccgggggaccgtaaaccgggggccctaacccgggg

SEQ ID NO: 380516 - DNA, 659 bp, Homo sapiens
  misc_feature: GZ8MTXP01CKY1F.13.76.G10.1.454.CMB.2.raw
  modified_base (399)..(399): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtcgtggaggaggcttgatccgagccgtgggggtcctgagactctcctgtgcagtcctcgtcgggttcaccgtcagtcacacctacatgacgcgtcgggtcccgcgaggcctccggaggggaggggcgtggagtgtcgttctttacttttaagtttagtagtaggtggtacgtacctactactccgacacgtaccgttccggngggacggggtaccctacgttaccacctacttccaccgaaggtaacaaaccttaaacttaccgaaacgaacctacggttctttacgtttactaacaaattacgaaacacgtcgtaggacgacgaccgatccgacgacggtcgtagttactacgtggtcgaacgaggacggtacggccgggggtaaacccctaaggttaaccgttacgaccggtctaaggtccgggaacgttcgggacgggaacccgaacgggggtaacccc

SEQ ID NO: 380517 - DNA, 676 bp, Homo sapiens
  misc_feature: GZ8MTXP01DYT2B.13.76.G10.1.454.CMB.2.raw
  modified_base (503)..(503): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatccgagccgtgggggtccctgagtactctcctgtgcagcctcgtcggttcaccgtcagtcacacctacatgagcgtcgggtcccgccgaggccgtaccggaggggaagggggcgtggagtcgtcgttctttcttttatttagttagttagtggtagtaccatactccgcacgtaacgtccggtggacggggtcccgtacttccgacctactcctaccaaggaacaactaaacttacccgaaaaggtaacctacggttctttagtttacctaacaaaattcgaaaacncgtccgtaaggacgacggacccgtaagtcggaaccgacgggtaccgttagttacttacgtggtgaacgggagaggtacggttccggggaacccctaacggttaaccgttacttacggtcgttaaggtcgggtaacggttccgggacgggggtaacccaacgggggtaaccccg

SEQ ID NO: 380518 - DNA, 673 bp, Homo sapiens
  misc_feature: GZ8MTXP01EVSNK.13.76.G10.1.454.CMB.2.raw
  modified_base (336)..(336): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtcgtggaggaggcttgatccagccgtgggggtccctgagactctcctgtgcacgcctcgtggttcaccgtcagtcacacctacatgagcgtcggtcccgccgaggcctccggaggggaggggctggagtgcgttcttnttttattagtagtagtgtagtaccatactccgcacgtaacgtccggtggacggggtacctacttccaccgtatacctacccgaagaacaacctaaagttccccaaaaggaaaccctaccggtcttttagttttacccttaaacaaaacgtacgaaacgtacgaccggtaggaacggaacgaccgtaagtcgaaccgtaccgggtcgttagttaacgttacgtggtacggaaggtaacggaggtaccggttaccgggaccccgtaaaggttaaccgttaccgacggtcgtaggtaaccgggtaccggtcgggaccgggggtaacccgaacggggtccc

SEQ ID NO: 380519 - DNA, 595 bp, Homo sapiens
  misc_feature: GZ8MTXP01DR7G3.13.76.G10.1.454.CMB.2.raw
  modified_base (392)..(392): a, c, t, g, unknown or other
  modified_base (401)..(401): a, c, t, g, unknown or other
  modified_base (411)..(411): a, c, t, g, unknown or other
  modified_base (415)..(415): a, c, t, g, unknown or other
  modified_base (439)..(439): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtggtcccgcgaggcctccgaggggaaggggctggagtgtcgttctttcttttattatagtagtggtagtacatactcgcagaactcgtggagggccgtatcaccntctacaganaacatacaanaacncgtcttgttctacaaatcgaaacncgcgtagacgacgccgatcgaaccgacgggtaccttgtaattacgtgtcggaaggaaggaggtaccgggcggggaaccccaacggtttaaaccggttccttacggtaactaggtaaggagttcggttacggtccgggggaaccgtaaacccggggg

SEQ ID NO: 380520 - DNA, 575 bp, Homo sapiens
  misc_feature: GZ8MTXP01CQR0N.13.76.G10.1.454.CMB.2.raw
  modified_base (398)..(398): a, c, t, g, unknown or other
  modified_base (484)..(484): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtgggtcccgccaggctccgagggaggggctggagtgcgttctttcttttatttatagtagtggtagtacctatactccgcagacctccgtggacggggccattcaccatcncagagacatccaagacacgtcttagtttctacaaatcgaaactcgaccgtggagacgacccgatcgacgacggtccgtgtattacnggtgcggagaggacgttcgggggaccccaggttaacgttcacggtctagtcggtaaccgtcggttcgggggaacccgaaggggtaaccccg

SEQ ID NO: 380521 - DNA, 607 bp, Homo sapiens
  misc_feature: GZ8MTXP01CZ8JU.13.76.G10.1.454.CMB.2.raw
  modified_base (216)..(216): a, c, t, g, unknown or other
  modified_base (228)..(228): a, c, t, g, unknown or other
  modified_base (230)..(230): a, c, t, g, unknown or other
  modified_base (268)..(268): a, c, t, g, unknown or other
  modified_base (393)..(393): a, c, t, g, unknown or other
  modified_base (473)..(473): a, c, t, g, unknown or other
  modified_base (500)..(500): a, c, t, g, unknown or other
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagcccaccctcagtgtcccgtgtccccaggacagacagcagcatccactgctntagaaataatgnanataatatactctgtatcagcagatcgaggccagtcccngtcgctggtctagtactatacgaagtcgtgaccgaaggtcccggaccctagacgggacccttccccgtaggacgtcgtactttccgtcgtcggtccctaccgtaacgtcgacgggaactcgaccnccctactctacgacctagacccgacgggacccgggaccgaggtactagtcggattcggaaggggtctagtacttatacgngtacgaggtccggtgacgagccggacnccgtacgttccgtccgttcgttacggttccgttaccgttccgggttaacgggtaaccggaaacccgttaacgggtacccgtacccgttaccgtaaccgccgaacccg

SEQ ID NO: 380522 - DNA, 614 bp, Homo sapiens
  misc_feature: GZ8MTXP01BK1DA.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctctgggtcaccgtcagtcacacctacatgagcgtcgggtcccgcgacggctccgaggggaagggctggagtgtcgtcttcttttatttatagtagtggtagtacatactccgcagaactccgtggacggggtccgattccacctagtcctaccaaggacaactaacttacccaaagaacctacggtcctttgtttactacaaaatcgaaacagccgtaggaacgacgcccgatacggaccgacgggtcccggttatagtttacctggtgaacgtagaggacgttcgggggaccccaaggttaaccgtttacacgtctagtcggggtacgtcggttacgggggcccttaacgggggtaacccc

SEQ ID NO: 380523 - DNA, 694 bp, Homo sapiens
  misc_feature: GZ8MTXP01AWW4S.13.76.G10.1.454.CMB.2.raw
  modified_base (636)..(636): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtcgtggaggaggcttgatccagccggtgggggtccctgagactctcctgtgcagcctcgtgggtccaccgtcagtcacacctacatgagcgtcggtcccgccgacggccgtaccggaggggaacggggcgtggagttcggtcgttctttcgtttttaatttagttaggttaggttaggttacgtaaccctagtactcccgacacggtaaccgtccgggtgggaccggggtcccgtacttccacctatcctaccgaagtacaaactaacgttacccaaacggactaccggttctttagtttacctaaacgaaagtacgaacctacgacccgttaggaaggccgaaccgtagaccggaaccgtccgggtacgttcgttaattaccgtggcggaaccgaggttcggtacgccggggaaaccctacgggttaaccgtttcncggtaactacgtcggggaccgttccggggacggggtaacccgaaacgggggtcccccg

SEQ ID NO: 380524 - DNA, 673 bp, Homo sapiens
  misc_feature: GZ8MTXP01D94IE.13.76.G10.1.454.CMB.2.raw
  modified_base (383)..(383): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtcgtggaggaggcttgatccagccgtgggggtccctgagactctcctgtgcagcctcgtcgggttcaccgtcacgtcacacctacatgagcgtcgggtccgccgaggcctaccggaggggaaggggcgtaggagtggtcgttctttctttttatttagttagtagtggtagtaccatactccgnagtaacctccggtggacggggcctattccaacctactctaccgaagacgaactaactaccgaaagaaacctcgtctttcgtttactacaaaagtacgaaactcggaccgtaggacgaacgccgaagtccggaacgtaccgggtccttaggttaattacgtggtcgaacggtaaggagggacggttccgggggaaacccctaacggttaaacccggtttacacggtaaccgttaggtaacgggtacccggtacggggttaccgggggaaccgaaaccgggggtaaccccgg

SEQ ID NO: 380525 - DNA, 590 bp, Homo sapiens
  misc_feature: GZ8MTXP01ALAZW.13.76.G10.1.454.CMB.2.raw
  modified_base (271)..(271): a, c, t, g, unknown or other
  modified_base (389)..(389): a, c, t, g, unknown or other
  modified_base (490)..(490): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctctgggttcaccgtnagtcacaccctacatgagcgtcgggtcccgccacggccgtccgagggggaaggggctgggagtgcgttcttctttttattatagtagtcggtagtacatacctccgacagtcctcggnggaggggcccgtattccactactcctccaagagaaccaattaccaaagaacacgtcttagtttctacaaatcgaacagcccgtgacgacgccgatcgaacnccgggtcgtagttactacgtgtggacggagaggacggtcggggacccgacgttaaccgttaacgacgtcgtaagtcgggacgtcggttcgggggaacccg

SEQ ID NO: 380526 - DNA, 697 bp, Homo sapiens
  misc_feature: GZ8MTXP01AIHHY.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtctggaggaggcttgatccagccgtgggggtccctgagactctcctgtgcagcctcgtgggtccaccgtcagtcacacctacatgagcgtcgggtccgccgaggcctaccggaggggaacgggggcgtgggagtcggcgttctttctttttatttagttagtagtggtagtaccatactcgcagaactccggtggacggggccattccgacctatctaccagacgtaactaacttacccgaaagaaacctacggtctttacgttttactaacgaaaatcggaaactacggccgtaggaaggacgacccgaagtcgaaccgaccgggtaccgttagtaactttaccgtggtcggaaccggaaaggacggtaacgggttccggggggaacccctaaaccggggttaaaccgtttaccgttaaccgggtaaccttaagggttccggggtaaacccgggttccggggttacggggggtaaccccgaaacggggggtaaccccccg

SEQ ID NO: 380527 - DNA, 762 bp, Homo sapiens
  misc_feature: GZ8MTXP01B6NMP.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccaggccgtggggggtccctgagactctcctgtgcagcctcgtgggttcaccgtcagtcacacctacatgagcgtcgggtccgccgaggcctccggaggggaaggggctgggagtcgtcgttctttacgtttttaatttagtagttaggtaggttaacgtaccattacgtccgcacggtaaccttccggtgggacgggggccctatttaccaaccctatccgtacccaaggaacgaaacctaaagttacccaaaagaaacctaccggtcctttaggttttaccttaacaaaacgttcggaaactacgggacccttagggaacggtaaccggaccccggaaagttccggaaacccggaccggggttacccgtttaggttaaactttaccggtgggttcgggaaccgggaagggttaacgggacgggttacccggggggaaccccctaaacggggttaaaccggtttacccgttaaccggtccgttaagggttccggggtaacgggtccgggttaccggggggaacccttaaacggggggtaacccccg

SEQ ID NO: 380528 - DNA, 658 bp, Homo sapiens
  misc_feature: GZ8MTXP01EO8GJ.13.76.G10.1.454.CMB.2.raw
  modified_base (333)..(333): a, c, t, g, unknown or other
  modified_base (363)..(363): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccgagccgtggggggtccctgagactctcctgtgcagcctcgtgggttcaccgtcagtcacacctacatgagcgtcgggtcccgccaggctccgaggggaggggctggagtgcgtcttntttttattatagtagtggtagtaccatacnccgcagaacctccgtggacggggccattcaccatctccagagacaattccaaagaacacgctttgtttcctacaaatcgaaactcgccgtaggacgacggcccgaatcgaaccgaccgggtcccgttagtaacgtttacgtggttcggaaccggaaggaacgggtacggttacggggggacccccctaaaacgggttaaacccggtttaccgttaccgggtcctttaaagggtcgggtaacccgggtttccgggttaacggggggaaccccgttaaaacggggggtaacccccgg

SEQ ID NO: 380529 - DNA, 608 bp, Homo sapiens
  misc_feature: GZ8MTXP01AEL3P.13.76.G10.1.454.CMB.2.raw
  modified_base (295)..(295): a, c, t, g, unknown or other
  modified_base (427)..(427): a, c, t, g, unknown or other
  modified_base (510)..(510): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtgggtcccncgaggctccggaggggaaggggctggagtgcgttctttcttttattagtagtagtggtagtacatactcgcagacctccgtggacggggtccattccactatcaccagacgacaacgttccaaagacacgtntttacgtttctaacgaaatacggaaactcgccgtagagacggaccagtcgaccgtacggtccgtattacgttacgtggtacgnggaagaggtacgttccggggaacccctaacggttaacgtttccgacgtcgtaagtcgggtaaccgtcggttcgggggaacccgaacggggtaaccccg

SEQ ID NO: 380530 - DNA, 594 bp, Homo sapiens
  misc_feature: GZ8MTXP01BAONY.13.76.G10.1.454.CMB.2.raw
  modified_base (491)..(491): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgaggggaaggggctggagtgcgtctctttttattatagtagtggtagtacatactccgcacgaactccggtggacggggcccgattccgaccatctccagagaacaattccaaagaactacgcttgtttcctacaaattcgaaactgccgtagacgcgcccgaatcgacgacgggtccgtgtaacttacnggtcgcgaaggaggacgttcgggggacccctaaggttaaccgtttacgaccgtctaagtcggggaacgtcggttacgggggaacccgttaagggggaaccccg

SEQ ID NO: 380531 - DNA, 737 bp, Homo sapiens
  misc_feature: GZ8MTXP01E01LI.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatccagccgtggggggtccctgagactctcctgtgcagcctcgtgggtcaccgtcagtcacacctacatgacgcgtcgggtccccgccgaggcctaccgggaaggggaagggggcgtgggagtcggtccgttctttactttttagtttataggttaggttggtaagtaccatactcccgacacgtaacctcccgggtgggacggggccctagttaccacctatcctaccgaggaactaaacctaaacttacccgaaaagaaccgtaccgtctttagttttacctaacaaaagtgaaaaccgtgcccggttaggaaaggaccggaccgtaagttccggaacccgtaaccggggttccgttaggttaaacttttaaccggtgggtacgggaacggaaaggttacgggtaacgggttaccccgggggaaacccctaaaccggttaaccggttaccttacccggtaagtacgggtaacgggtaccggtccggggttaccgggggaacccggaaacgggtaaccccg

SEQ ID NO: 380532 - DNA, 675 bp, Homo sapiens
  misc_feature: GZ8MTXP01DR8IB.13.76.G10.1.454.CMB.2.raw
  modified_base (491)..(491): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggtcttgactccgaggccggttcggggggtccctgacgtactctccgtgtcgcagcctcgtggtcaccgtcagtcacacctacatgagcgtgggtcccgcgaggcctccggaggggaacggggcgtggtagtcgtcggttcctttattttatttatagtaggtgtagtacctactacgtccgacacgtaaccgtccgtggggacggggccctaattccacctattccaccgagaacgaacctaattacccaaagtaacctacgttcctttagtttaccaaanaaagtcgaacgcgtacggagaacgaccgacgtactacggaccgtacgggttacgttagttacgttacggtggcggaacggaggttacggggtaccggttaccggggtaaaccccgtaacggttaaccgttcgacgtaacgtagggtcgggtaccggtcggggaccgggaaccgaaccgggtccg

SEQ ID NO: 380533 - DNA, 726 bp, Homo sapiens
  misc_feature: GZ8MTXP01AXNH6.13.76.G10.1.454.CMB.2.raw
  modified_base (628)..(628): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtcctgagactctcctgtgcagcctcgtgggtcaccgtcagtcacacctacatgacgcgtcgggtccctccgacggccgtccggaagggggaacgggggtcgtggggacggttggtccggtttcttttacgttttttaagtttaagttaggttaggttagggttaacgttaaccctacttaccgtcccggacctaacggtaaacccgttcccgggtgggacgggggtcccgtaacgttcccaacccgtacttcccgtacccgaaggaacgtaacctaaacttacccgaaaacggaaaccctaccggtctttacggttttacctaactaaaacttacggaaacctacggacccggttaggaacgtagacccgtaagtcgacgtacggtccgtagtacttacgngtgcgaaggacgtaggttccgggacctaacggttaaccgttacgacgtaacgtagtcgggtaccgtcgggttacgggtaacccgaacgggtaaccccg

SEQ ID NO: 380534 - DNA, 629 bp, Homo sapiens
  misc_feature: GZ8MTXP01AMQEP.13.76.G10.1.454.CMB.2.raw
  modified_base (451)..(451): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgacgcgtcgggtcccgccgaggcctccggaggggaagggggctggagtgcgtcttcttttatttatagtagtggtagtaccatactccgcagaacctccggtgacgggggccctattccactatcctaccagtagaacaattaccaaagaacacgtccttgtttccttanaaatgaacacgccgtaggaacgacgacccgaatcgaaccgaccgggtccgttagttaacgtttacgtggtggaaccgaaggaggacggttacgggggaccccctaacggttaaccgtttacacgtaaccgtagtcgggtaacggttcggacgggggtaaccgaacgggggtaaccccg

SEQ ID NO: 380535 - DNA, 691 bp, Homo sapiens
  misc_feature: GZ8MTXP01CG5LZ.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtgggttcaccgtcagtcacacctacatgacgcgtcgggtcccgccgacggcctccggaaggggaagggggcgtgggagtgtccgttctttcttttatttatagttagtggtagtaccatactccgacacgaaccgtccggtgggacggggtcccgtactttaccacctactctacccgaagacgtaacctaaacttacccgaaaagtaaaccgtaccggttaccttttacggttttacccttaaaccaaaaagttaccggaaaacctacgggtaccccgttagggaaacgggaaccgacccggtaagtacggaaccgtacgggtacccgttagttaacttacgtgtgaacggtagaggtacgttacggggaccctaaggttaacgttcgacgtctagtcgggtacgtcggttacggggaaccgaacgggaacccg

SEQ ID NO: 380536 - DNA, 679 bp, Homo sapiens
  misc_feature: GZ8MTXP01DBQTT.13.76.G10.1.454.CMB.2.raw
  modified_base (169)..(169): a, c, t, g, unknown or other
  modified_base (236)..(236): a, c, t, g, unknown or other
  modified_base (295)..(295): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctctatgagctgactcagccaccctnagtgtccgtgtccccaggacagacagccagcatcacctgctctaggaaataatggacagaataaatntacttctggtatcagcagagtcgaggccacgtcccctgtcgctggtcatctatacaagntcgacaacggcgccctacggaggtactcccccgagacgcggtacttcgtccgtcggtcctacctaaaccgtccgttacgggaaacctcgacgccctacgtcgtacgacccagtaccgaacgggaccgggaacccgaggtaccgtagtagggtagtacgggtaaccggtacgttacggtaactttaacgtttaacccgtggttacccggaaagggggtccggtttaacggggaaccgtaagggtaccgacgtacccgtaaaccggtcggttacccggtacgttaacgtttcggtaccgtttaaccgggaccgttacggggtaacccgaaacggttcccgtaacccggttaccgttaaaaccggttccgaacccggtaaacccccg

SEQ ID NO: 380537 - DNA, 672 bp, Homo sapiens
  misc_feature: GZ8MTXP01AVAUN.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctatttaaaaggtgcccagtgtgaggtgcagctggtggagtcgtggaggaggcttgatccagccgtgggggtccctgagactctcctgtgcagcctcgtggttcaccgtcagtcacacctacatgagcgtcgggtcccgccaggcctccggaggggaagggggcgtgggagtcggtcgttctttcttttattagtagtagtggtagtaccatacgtccgcacgtaaccgtcggtggacggggcctacttccgacctactcctaccgagacaactaacttaccgaaagtaacacggtctttagtttacctaacgaaaatcgaaacctcgacccgtaggacggaccgacccgtagtccggaccgtaaccgggtccgttagtaacttacgtggtcggaacggtaaggaggtaccgggttccgggggaacccctaacgggttaaaccgttacgttaccggtaactacggtcggggaacccggtcgggttaccgggggaacccggaacgggtaaccccgg

SEQ ID NO: 380538 - DNA, 603 bp, Homo sapiens
  misc_feature: GZ8MTXP01CWMBZ.13.76.G10.1.454.CMB.2.raw
  modified_base (294)..(294): a, c, t, g, unknown or other
  modified_base (382)..(382): a, c, t, g, unknown or other
  modified_base (385)..(385): a, c, t, g, unknown or other
  modified_base (390)..(390): a, c, t, g, unknown or other
  modified_base (423)..(423): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccncaggctccgagggaggggctggagtgcgtcttcttttattatagtagtgtagtacatactcgcacgaactcgtgacgggcctatcacntcncaganacatccaagacagtctgttctacaaatgaaacngcctagacgacgacccggtatcggaaccgacgggtacccgtggttaacttaaccgtggtcggcgaaggaggacggttacggggggacccctaacgggttaaacggtttccttaacccgggtcttaaaggtcgggtaaccgttcggttacggggggtaaccccaaaggggggtaacccccg

SEQ ID NO: 380539 - DNA, 752 bp, Homo sapiens
  misc_feature: GZ8MTXP01CDG3D.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgactccgaggccgtggggggtccctgacgacttctcctgtgcagcctcgtgggtcaccgtcacgtcacacctacatgacgtcgtcgggtccgcgaggccgtaccggagggggaacggggctgggacgtcggtcgtttctttcgttttaatttagtaggttagtggttaacgtaccctagtacgtccgtcaacggtaacccttccgggtgggacggggtcctacttaccacctacgtcctacccgagtaacgtaacctaaacgttacccgaaaaggtaacctacggtttaccctttaggttttaacctaacgaaaaacttcgggaaaaccctacgggtcccgttaagggaaccgggtaccgaaccccggtaaagttccggaaaccggttaccggggtacccgtttagtaaacgtttccgtagggtcgaacgggtaaggacggtacgggacccggggtaacccctaacggttaaaaccgtttcgaccgtgttacggtcgggtacccggttcgggacggggtaacccgaacgggtaaccccg

SEQ ID NO: 380540 - DNA, 590 bp, Homo sapiens
  misc_feature: GZ8MTXP01BQ9QA.13.76.G10.1.454.CMB.2.raw
  modified_base (281)..(281): a, c, t, g, unknown or other
  modified_base (297)..(297): a, c, t, g, unknown or other
  modified_base (409)..(409): a, c, t, g, unknown or other
  modified_base (478)..(478): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagctctcctgtgcagcctcgtgggtcaccgtcagtcacacctanatgagcgtcgggtccnccgaggcctaccgagggggaagggggcgtgggagtcggcgttcttcttttattagtagttagtggtagtacatactccgacagctcgtggacgggcgatcacactctcaganacaatacaaagacacgtcttgtttactagaaatggaacacgccgtagaacgacgtcccgatcggaaccncgggtacccttggttaactcggtggtggacgaggacgtaggtccgggggaccccacggttaacgttaacctacggccgtaagtcggggaaccgtcgggttcggggaacccgg

SEQ ID NO: 380541 - DNA, 696 bp, Homo sapiens
  misc_feature: GZ8MTXP01CYUAZ.13.76.G10.1.454.CMB.2.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcacgccaccctcagtcgtccgtcgtccccaggacagacagccagcatcactgctctagaaataatggacagataaatatacttctggtatcagcagacgtcgagccacgtcccctgtcgctgtctatctatacaagactacgacccgaacggtccgaccctacggacggggtacctaccccccgtaggacgcggtacttccgtaccgtcggtccctacccgtaaacgttcggtacgggaacctcgacgccctacttacgtaccggaactacgccgaacgggcccgggtaacccgagggtacctaaggtcgggtaagtacggtaacgggtccggttaaggtaaacctttaagtttacccgtagggtaccggacggggtacggtacgggacgtaacggccgaaacggtccgtaaccggtccgttacccggtacttacggttaccggtttacccgttaacgggggttaaccggttacgggaacccgtaaacgggtcccgtaacccggtacgttaaccgtaacccggaacggtaacccccg

SEQ ID NO: 380542 - DNA, 588 bp, Homo sapiens
  misc_feature: GZ8MTXP01DEGMN.13.76.G10.1.454.CMB.2.raw
  modified_base (364)..(364): a, c, t, g, unknown or other
  modified_base (379)..(379): a, c, t, g, unknown or other
  modified_base (401)..(401): a, c, t, g, unknown or other
  modified_base (444)..(444): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtgggtcaccgtcagtcacacctacatgagcgtcgggtcccgcgaggccgtccgaggggaaggggctggagtgcgttctttctttatttatagtagtgtagtacatacncgcacgtaacctcgnggacggggcctattcaccatcncagagacaatccaagaacacgtcttgttactacaaatgaaacngcgtagagacgaccgatcgacgtcggaccgttgtaacttacgtggtcgaacggaggacgtacggttcggggaccccaagttaaacccgtttcgacgtctaagtggggtacccgtggttacggggaaccgaacggggtaaccccg

SEQ ID NO: 380543 - DNA, 661 bp, Homo sapiens
  misc_feature: GZ8MTXP01BBWK3.13.76.G10.1.454.CMB.2.raw
  modified_base (407)..(407): a, c, t, g, unknown or other
  modified_base (468)..(468): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtgggtcaccgtcagtcacacctacatgagtcgtcgggtccccgccgaggcctccgggaagggggaacgggggcgtggggaggtcggtcgtttctttacttttttaatttagttagttagtggttaataccatactccgcagaaccgtccgnggacgggcctattccactactctacagacaactaataccaaagacacgtcttgttacctanaaatcgaacacgccgtagagacgaccgtatcggaaccgtacggtacccgttagtacgtttaaccgtggtacggaacggtaacggacggtacgggttaccgggggaaccccctaagggttaacccggtttacttaccggtctaacgggtcggaccgggttcgggttacgggggaaccgaaccggggtaaccccg

SEQ ID NO: 380544 - DNA, 597 bp, Homo sapiens
  misc_feature: GZ8MTXP01CIYM5.13.76.G10.1.454.CMB.2.raw
  modified_base (382)..(382): a, c, t, g, unknown or other
  modified_base (458)..(458): a, c, t, g, unknown or other
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtcgggttcaccgtcagtcacacctacatgagctgggtccgccaggctccgagggaggggctggagtgcgttcttcgttttatttagtagtagtggttacgtactatactccgcaacgactcccggngacggggcctattccaccgatcctaccgagacgaacaacttaccaaagacacgcttcgttactacaaatgaaaccnggacctgacgacgccgatcgacgaccggcgtagtattacgtgtgcggagacgaggtccgggggacccaacgggttaaaccgttacgtaaccgtcgtaaggtcgggtacgttacggtccgggggaaccgtaaaccggggg

SEQ ID NO: 380545 - DNA, 622 bp, Homo sapiens
  misc_feature: GZ8MTXP01ES1WX.13.76.G10.1.454.CMB.2.raw
  modified_base (257)..(257): a, c, t, g, unknown or other
  modified_base (317)..(317): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccaggccgtggggggtccctgagactctcctgtgcagtccngttcgtcggtccacgtcacgcacactcagcgcgtcggtcgcgcgcgcgacgggaggaggngtgtgtcgtccttatttatttagttagtaggtaagttacgtaatactacgtacgacgacgtacgtacgtacgggtacgggacggtaccgtacctactacctacctacgacgaacgaactaacctaacgtaaacgaaacgaacgtacggtttcgtttacgttaactaacgtaaacgtaacgacgacgacgacgtacgacgacgacgaacggaccggttacggtacgttacgttacgttcgttcggcggacggaaggtacgggaaccgggtaccggaaccggttaaccgttaaccgttaacgtaacg

SEQ ID NO: 380546 - DNA, 702 bp, Homo sapiens
  misc_feature: GZ8MTXP01C4E3D.13.76.G10.1.454.CMB.2.raw
  modified_base (233)..(233): a, c, t, g, unknown or other
  modified_base (249)..(249): a, c, t, g, unknown or other
  modified_base (375)..(375): a, c, t, g, unknown or other
  modified_base (598)..(598): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccngagactctcctgtgcngcctctgggtcaccgtcacgtcacacctacatgagcgtcgggtcccgcgacggcctccggaaggggaacggggcgtggagtgtcgttctttctttagtttatagtagtgtacgtaccatactccgnacgtacccttcggtcgggacggggtccgtacttaccaacctactacccgaccgaagaaacgaacctaaacgttaaccgaaacgtaaacccgtacggttaccttttacgtttaaccttaaccgaaaaagtttccggaaaaccgtccgtaccgttaacgggaaagtaccggacccgttaaagtacggaacccgttacgggcccgtttaagtaacgtttaaccggnggtacggaacggtaaggacgggtacgggacccggtaaccctaacggttaacgttcaccggtaacgtaggtcgggtacggtcgggacgggaacccgaacggtccg

SEQ ID NO: 380547 - DNA, 661 bp, Homo sapiens
  misc_feature: GZ8MTXP01CJTA2.13.76.G10.1.454.CMB.2.raw
  modified_base (498)..(498): a, c, t, g, unknown or other
  modified_base (510)..(510): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtggtcaccgtcagcacacctacatgagcgtcgggtcccgccgacggccgtaccggagggggaacgggggtcgtgggagtcggtcgtttctttactttttaatttagtagttaggttacggtagtactagtacctccgacacgtccgtccggtgggacggggtccgtacttccgacctacttccctaccgaagacgaactaacttacccgaaagtaaccacgtctttagtttaccctaanaaatcggaaacncggtacctggaacggacgcccgtagtacggaaccgtaccgggtccgtttagttactcgttggcgacggaggagtaacgggtcggggaccccttaacggttaacgtttaaccgacgtcgtaggtcgggttaccgtcgggttccgggaaccgg

SEQ ID NO: 380548 - DNA, 711 bp, Homo sapiens
  misc_feature: GZ8MTXP01DQ66Q.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgcttattttaaaaggtgcccagtgtgaggtgcagcgtggtggagtcgtggaggaggcttgatccagccgtgggggtccctgagactctcctgtcgcagcctcgtcgggtcaccgtcacgtcacacctacatgagcgtcggtcccgcgaggcctaccggaggggaaggggcgtggagtcgtcgtttctttcttttaatttagtagttagtggtacgttaccattacgtccgcacgtaacctccggtgggacggggcctattaccacctatctaccagaacgtaactaacttaaccaagaaacctacgttctttacgttttaccaactaaaagtcgtaaacacggtaccgtaggagtaccggccgaagttcgacgaccgggttaccgttaggtaactttacgtggtcggaacggtaagggaacggtaccgggttacccgggggaaaccccgtaaacggttaaaaccggtttacccgttaacggtaactttaaacgggtccggggtaaccggttaccggggttacgggggaaccccgttaaacggggggtaaccccccg

SEQ ID NO: 380549 - DNA, 767 bp, Homo sapiens
  misc_feature: GZ8MTXP01B9ST3.13.76.G10.1.454.CMB.2.raw
  modified_base (570)..(570): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttattttaaaaggtgcccagtgtgaggtgcagctggtggagtcgtggaggaggcttgatccaggccgtcgggggtccctgacgactctcctgtgcacgcctcgtcggtccaccgtcacgtcacacctacatgacgcgtcgggtcccgccgaggcctaccggagggggaacgggggcgtagggacggtcgtcgtttctttacgtttttaagtttaagttaaggttaggtaggttaacgtaaccccgtacgttaccgtccgaccgtaacggtaacccgttcccgggtcggggacggggtacccgtaactttacccaaccctacgtaccctacccgaaaggaaactaacctaaacgttaacccgaaaagtaaacccgtaccggttactttgtttacctaaacaaagtcgaaacncgtccgtaggaacgtacgaccgagtcgaccgtacggtccgttagttaaccttacggtcggtggaaccggtaaaggttacggaaccgggttccggggaaaccccttaagggttaaaacccgtttacgttaccggtaacgttaacggtcggggtaccgttccgggttacgggtaacccgttaaaccgggggtaaccccg

SEQ ID NO: 380550 - DNA, 748 bp, Homo sapiens
  misc_feature: GZ8MTXP01AP4X9.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtcgtggaggaggcttgatccgagccgtgggggtcctgagactctcctgtgcagcctcgtgggttcaccgtcagtcacacctacatgagcgtcgggtcccgcgacggcctccggaagggggaacgggggcgtgggagtcggtcgtttctttacgtttttaatttagtaggttagtagggttagtaaccccagttacctcccgactaacggtaacccgtccgggtgggacgggggtccctaactttccaaccctataccctacccgaaggaacgaaacctaaacttaccaaaacggtaaacctaccggtactttacggtttaaccttaacgaaaagttcgaaacgacggtaccgtaggaacggacgacccgtaagtcgaaccgtacggtcccgttagttacttaacgtggtacggaacgtaagggaggtacggcccgggggaacccctaaaccggttaaaccggtttaaccttaccgggtaaccttagggtaacggggtaaacccggttcgggttaacccgggggaacccggttaaaaccggggtaaccccggg

SEQ ID NO: 380551 - DNA, 645 bp, Homo sapiens
  misc_feature: GZ8MTXP01DNUYZ.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtgggttcaccgtcagtcacacctacatgagcgtgggtcccgccgaggcctaccggagggggaacggggcgtgggagtgtcgttctttctttttatttagtagtagttggtatacatacctccgacagcgtccggtgggacggggcctactcacatcctacgagaacgactaacttaccaaacgtaaccacgtcttacgtttactaagaaatcgaaacgacgccgtaggaacgacgccgtagtacggaaccgacggtccgttagttaacgttcgtgtggaccggtaagacggtacggtccggggaaccccgttaacggttaaaccgtttaaccgacgtaacgttaacggtcgggttaaccggtttccgggaaccgggggaaacccggg

SEQ ID NO: 380552 - DNA, 726 bp, Homo sapiens
  misc_feature: GZ8MTXP01D27U4.13.76.G10.1.454.CMB.2.raw
  modified_base (527)..(527): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgcttattttaaaaggtgcccagtgtgaggtgcagcgtggtggagtcgtgggagggaggtcttgactcccgaggtcccggttcggggggtcccctggacgtacctctccgtgtcgcacgcctcgtcgggttccaccgtcagtcacacctacatgacgcgtcggtccgcgacggcctaccggaggggacggggcgtggagtcgtcgttctttcttttatttagttagtaggtggtagtactatactccgactacgaaccgttcggtgggacggggtccgtacttaccacctactcctaccgaggaacaacctaacgttacccgaaagtaaacctaccggttctttacgtttacctaaacaaagttacggaaacncggtaccggtagaaacggtacgaccgagtccggaacgtaccggggtaccttgttaaacttcggtggtcgggaacgtaagggacggtaccgggttaccgggggaacccctaaacggttaaccgggttttaccacgggtaacgtttaacgggtcgggtaacccgggttcgggacgggggaacccgaacgggggtaaccccg

SEQ ID NO: 380553 - DNA, 747 bp, Homo sapiens
  misc_feature: GZ8MTXP01ES9ZG.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgctaattttaaaaggtgcccagtgtgaggtgcagcgtggtggagtcgtggaggaggcttgatccgagccgtgggggtccctgagactctcctgtgcagcctcgtggtcaccgtcagtcacacctacatgacgcgtcgggtcccgccgaggcctccggaaggggaggggcgtgggagtgtcgttctttactttttattagttagttagtaggtagtaccacttactccgacacgtaaccgttccgggtgggacggggtccgtaactttccaaccgtactccgtacccaaggtaacgaaacctaaacgttaacccgaaaacggtaaacccttaaccgggttctttttaacggttttaccctaaacgtaaaaacgttcggaaaaaccgccggtacccgttagggaaacggtaacggaccccgtaaagtaccggaacccgtacccggggtacctttggtaaactttacggtcggtaagggaaccgtaaggttacggtacggttccggggaacccctaaacgggttaaaccgtttacaccggtcctaggtccgggtacgtcgggttaccggggaacccgttaacggggtaaccccg

SEQ ID NO: 380554 - DNA, 565 bp, Homo sapiens
  misc_feature: GZ8MTXP01DNAGG.13.76.G10.1.454.CMB.2.raw
  modified_base (416)..(416): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtcgtccgtgtccccaggacagacagccagcatcactgctctaggaaataatggcagataaatatactctgtatcagcagagtcagccacgtcccctgtgctggtcatctatcaagatgaccaagccgcctcgagggactcccccgtgacgcgtatttctcgtcggcctaccaaacgttcgtacgggaaacctcgaacgcccaacgtctacgaccatcgacggaccgggacccaggctaaggngagtgacgtacgtacgtacttacttacgtggtcgaggcggtaggactcgacacgctaacgtccgccgtacttacgtcggttcgttaccggaacgttaccgggaaccgtacggtcctaaccggtacgttaacgtccgaacccggaacccg

SEQ ID NO: 380555 - DNA, 638 bp, Homo sapiens
  misc_feature: GZ8MTXP01DAO3J.13.76.G10.1.454.CMB.2.raw
  modified_base (282)..(282): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtccctgacgactctcctgtgcagcctcgtgggtcaccgtcacgtcacacctanatgagcgtcgggtccgccgaggctccgaggggaggggcgtggagtgcgttcgtttcttttatttagtagttagtggtagtaccatactcgacagaaccgtcgtggacgggcccgtatccacctatcctaccagtacgaactaattaccaaagaaccagtcttagttttactaacaaatcgtaaacacgtccgtaggacggaacgccccggtaagtccggaaccgaccgggtccgttagttaacttacgtggtgggaacgaaggacggacgttccggggaacccctaacggttaaacgtttcgacgtaactaggtcgggaccgtgggttaccggggaaccgaaacggggtaaccccg

SEQ ID NO: 380556 - DNA, 663 bp, Homo sapiens
  misc_feature: GZ8MTXP01CHBN4.13.76.G10.1.454.CMB.2.raw
  modified_base (247)..(247): a, c, t, g, unknown or other
  modified_base (249)..(249): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtncngcctcgtgggttcaccgtcagtcacacctacatgagcgtcgggtcccgccgaggcctaccggaggggaagggggctagggagtgtcgttctttacttttatttagtagtagtggtagtaccatactccgcagaccgtccgtggacgggccgtattccaccatcctaccagacaactaaacttaccaaagaccaacgttccttagtttaccttaacaaaattacggaaactacgtaccgtaggaaacgacggacccgaagtaccgaaaccgtccggtaccggttattaacgttaccgtggtcggaacggtaaggaggtcggttaccgggggaacccctaaggttaaaccgttcaaccgtctaacggtcgggtaaccggtcggttacgggggaaccccgaaacgggggtaaccccg

SEQ ID NO: 380557 - DNA, 696 bp, Homo sapiens
  misc_feature: GZ8MTXP01BAEQK.13.76.G10.1.454.CMB.2.raw
  modified_base (248)..(248): a, c, t, g, unknown or other
  modified_base (250)..(250): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatccagccgtgggggtccctgagactctcctgtncngcctcgtggtcaccgtcagtcacaccacatgacgcgtcgggtccgccgaggccgtaccggaggggacgggcgtggagtcgtcgttctttactttttattagttagtagtggtacgtactatactccgacacggtaacccgttccgggtggacgggggtaccctacgtttacccaaccctacttccgtacccgagaacgtaaacctaaacttacccgaaagaaaccgtaaccgtcgtttacgtttacttaacaaaattcgaaacaccggccgttaggaacgacgacccggtagtacgaccgaccgggtaccgttaggttaacttacgtggtacggcggaacggaggtaccggttccgggggaccctaaccgggttaaccgtttacgttacggtaaccgtaggtccggggtacgtcgggttaccgggggaaccgaacggggtaacccg

SEQ ID NO: 380558 - DNA, 699 bp, Homo sapiens
  misc_feature: GZ8MTXP01EFBUB.13.76.G10.1.454.CMB.2.raw
  modified_base (237)..(237): a, c, t, g, unknown or other
  modified_base (297)..(297): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcacgccaccctcagtcgtccgtgtccccaggacagacagccagcatcactgctctagaaataatgacagtataatntacttctgtatcagcaagagtcacggccacgtcccctagtcgctgtcatctatacaagtntcgacgaagccgtaccctagacggtactcccccgtaggacgtcgtacttcgtacgtcgggtcctaccgtaaactcgtacgggaactcgacgtcccacgtctacgaccctagtaccggacggtacccggggtacccctagggtacctaaggttagggtaacgtcgggtaacgggtaccgttaacggggttaacctttaacggttttacgtacgggttaccggaacgggggtttaccggtaacgggggaacgtacggtacccgaaacgggtccctaaaccggtttcccggaaccccgttggttaccgttaacgggttcccgttaaaccggttccggggttacgggtaaccctaacggttaacctaccccggttagttaaaccgtcccgaaccgggtaacccccg

SEQ ID NO: 380559 - DNA, 679 bp, Homo sapiens
  misc_feature: GZ8MTXP01BSSEZ.13.76.G10.1.454.CMB.2.raw
  modified_base (172)..(172): a, c, t, g, unknown or other
  modified_base (250)..(250): a, c, t, g, unknown or other
  modified_base (297)..(297): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctnagtgtcccgtcgtccccaggacagacagccagcatcacctgctctaggaaataattggacaagataaatatacttccnggtatcagcagaagtcagccagtcccctgtgctgtcatctatcaagntgccaagccggccctcgacggggactccccccgtaggacgtcggtatttccgtacgttcgggcctacccgtaactccgtacggggaaccttccgacgtccgtacttaccgtacggaacccagttaccgaacgggacccgggggacccctaaggggtcccttaaggtgggtaacgtagggtacggtcgttacggtaacttactttaacgtcggttaccgaggggtcgtaacggggacctagggaccacggcccgtaacgtcggccccgtacgttacgttcggttccggttaacccggggttcggttaaccgggggaaccccgtaacgggttccccgtaaccccgggttaccttaacggggttcccaaccggaacccccccggg

SEQ ID NO: 380560 - DNA, 748 bp, Homo sapiens
  misc_feature: GZ8MTXP01EHNEN.13.76.G10.1.454.CMB.2.raw
  modified_base (257)..(257): a, c, t, g, unknown or other
  modified_base (565)..(565): a, c, t, g, unknown or other
  modified_base (632)..(632): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttaattttaaaaggtgcccagtgtgaggtgcagcgtggtggagtcgtggaggaggcttgatccgaggccgtcgggggtccctgagactctcctgtgcngtcctcgtcggtcaccgtcacgtcacacctacatgacgcgtcgggtcccgccgacggccgtaccggaagggggaacgggggtcgtagggtaggttcggtcgtttctttacgttttttaagtttaagttaaggttaaggttaggttaacgtaacctaacttaccgtacccgactaacggtaacccgttaccgggtcggggaccggggtaccgtacttacccaacctactaccgtacccaaagggtaacaaaccttaacgtaccaaaacggaactaccggttctttagtttacctaaacaaagtcaaacncggtaccgtaggaacggaccgcccgtaatccggaaaccgcgggttaccgttagttaaactttacggnggcggaacggaaggacgggtaccgggttaccgggtaaccctaaacggttaaccgtttcgacgtcgttaggtcgggtacggtaccgggaccggggaacccgttaaccggggaacccg

SEQ ID NO: 380561 - DNA, 636 bp, Homo sapiens
  misc_feature: GZ8MTXP01AT3GH.13.76.G10.1.454.CMB.2.raw
  modified_base (470)..(470): a, c, t, g, unknown or other
  modified_base (520)..(520): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagacctctcctgtgcagcctcgtgggttcaccgtcagtcacacctacatgagcgtcgggtcccgccgaggcctccggagggggaacgggggctgggagtcgtcgttctttctttttaattagtagttagtggtagtaccatacgtccgcagtaacctcggtggacggggccattccacctatctacccaagacgaactaattacccgaaagtaacctacgtctttgtttaccttanaaatgaaacagccgtagagacgccgatcgacgccggtcgtgtaattccgnggtgaacggtagacggtacggttcggggacccctaacggttaaaccgtttcgttaccggtcgtaagtccgggtaacgttccgggttacgggggaacccgttaacggggtaaccccg

SEQ ID NO: 380562 - DNA, 791 bp, Homo sapiens
  misc_feature: GZ8MTXP01C99E6.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggtcaccgtcagtcacacctacatgagcgtcgggtcccgccgaggcctccggaggggaagggggctggagtgcgtctttcttttatttattagtagtggtagtaccatactccgcacgtaacctccggtgggacgggggtcccgtacgtttaccaacccctattccctacccgaaggtaacgtaaacctaaacgtttaccccgaaaagtaaaccccgacgggttcctttacgggttttttacccttaaacaaaaaacgttcggaaaaaacccgtccgggttaccccggttagggaaacggggtaaaccggacccccgggtaaagttacccggggaaacccgtaacccgggggttaccccggttttaggtttaaacgtttaacccggtgggttcgggaaccgtaaagggacgggtaaacggttccggggggaaccccctaacggggttaaaaccgtttccgttaaccggtccttaagggttccggggaacccgggtttcgggaccggggggtaaccccaaaacggggggtccccc

SEQ ID NO: 380563 - DNA, 749 bp, Homo sapiens
  misc_feature: GZ8MTXP01CASPL.13.76.G10.1.454.CMB.2.raw
  modified_base (382)..(382): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtcgtggaggaggcttgatccagtccgtgggggtccctgagactctcctgtgcacgcctcgtgggtcaccgtcacgtcacacctacagtgagcgtcgggtcccgaccgacggccgtaccggaggggagggggcgtagggtagtcgtcgtttctttactttttagtttagtagtagtggtagtaccnctacgtccgacagtaccgtccggtgggacggggtcctattccacctactacctcccgaaagacgtaaacctaacgttacccgaaaacggtaaccctaaaccggttcttttcgggtttttaaccctaacgtaaaaacttcgggaaaacctcgggtacccgggttaaggggaacggtaaccgtacccggtagttaccggaacccgtaccggggttaccgttggtttaacttaacgtcgggtggaacggacgggaacggttacgggttccgggggaacccctaaacgggttaaccggttttaccacgggtcccgtaaggtccgggggtacccgttggggaccggggaacccgttaacgggggtaaccccg

SEQ ID NO: 380564 - DNA, 587 bp, Homo sapiens
  misc_feature: GZ8MTXP01D0EQ1.13.76.G10.1.454.CMB.2.raw
  modified_base (336)..(336): a, c, t, g, unknown or other
  modified_base (409)..(409): a, c, t, g, unknown or other
  modified_base (449)..(449): a, c, t, g, unknown or other
  modified_base (475)..(475): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccgagccgtgggggtccctgagactctcctgtgcagcctctgggttcaccgtcagtcacacctacatgagcgtgggtcccgcaggctaccggaggggaaggggctgggagtgcgttctttnttttatttatagtagtggtagtacatactcgacagaacctcgtggacggggccattaccaccatctaccaganaacctaagtaccaagaacacgtcttagttactacaaaatnaacacgacgtacgagacgaccggacncgacgacggtacgtacgtagtacgtgtgaagagagacggcggaccgtaacgttaacgttacgttacgtaacgtagtaacggtcggtcggacgggtaaccggaacggtaaccg

SEQ ID NO: 380565 - DNA, 852 bp, Homo sapiens
  misc_feature: GZ8MTXP01AO9S1.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgcttattttaaaaggtgcccagtgtgagtgcagctggtggagtctggaggaggcttgatccagccgtgggggtccctgagactctcctgtgcacgcctcgtggttccaccgtcagcacacctacatgacgcgtcgggtcccgccgacggccgtaccgggagggggaacgggggcgtaggggagtcggtcgtttcgttttactttttaagtttaagttaggttaaggtttagggttaacggttactaacgttaacccgttcccggaaccgtaacgggtaacccgttcccggggtagggggtaccgggggtacccgttaactttacccaaacccctaaacgttcccttacccgaaacggaaacgtaaacccttaaaaccgtttaaccccgaaaaaacgtaaacccgttaaacccggttcctttttacggttttaacccttaaaccaaaagtttaccgggaaaaccctacggtaccccgttagggaaacgtaccggacccggtaagttaccggaacccggtaccggggtcccgtttaaggtttaaacgttacggtgggttaccggacgggtaacggacgggtacgggttaccccggggggaaccccttaaaacggttaccccgggtttaaacctaccggtaacgttacgggtacggggttacccggtttccggggaaccgggggtaaaccccgggg

SEQ ID NO: 380566 - DNA, 572 bp, Homo sapiens
  misc_feature: GZ8MTXP01BE5HY.13.76.G10.1.454.CMB.2.raw
  modified_base (333)..(333): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagctgggtccgccaggctccgaggggaaggggctgggagtgcgtcttnttttattatagtagtggtagtacatactccgacagctccgtggacggggccgtattcactatcctcagagacaattccaaagaacacgtctgtttctacaaattcgaaacgagcctgagacgccgatgaccgtacggccgtgtaacttctggtcgcgagagaacgtcgggggaccccaggttaaccgttaacaccgggaacttacggtacggggttaccgtcgggttcgggggaacccg

SEQ ID NO: 380567 - DNA, 603 bp, Homo sapiens
  misc_feature: GZ8MTXP01C2C6S.13.76.G10.1.454.CMB.2.raw
  modified_base (444)..(444): a, c, t, g, unknown or other
  modified_base (507)..(507): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtgggtcccgccaggcctccgagggaggggctggagtgcgtctttcttttatttatagtagtggtagtaccatactccgcagaacctcgtggacgggccgacttcaccatctccagacgacaattccaaagacacgtcttgtttctacaaatgaaacngcctaggagacgcccgatcgacgaccggtccgttagttacttacgtggtcggaacggtaaggnggtacggttcgggggacccctaaaggttaacccgtttacgaccgcttaaggtcgggtacggtccggttacgggggaaccaaacgggggtaaccccg

SEQ ID NO: 380568 - DNA, 649 bp, Homo sapiens
  misc_feature: GZ8MTXP01CA7PP.13.76.G10.1.454.CMB.2.raw
  modified_base (494)..(494): a, c, t, g, unknown or other
  modified_base (573)..(573): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtcggtcccgccgaggccgtccgaggggaacggggccgtggtagtcgtctttcttttacttttagtttagttagttaggtgtactacgtactacgtccgagacgtaaccgttccgggtaacggggacgggtaccgtacttaccgacctacgtcctaccgaagactaacctaaactaccgaaatacgaccttcgtttactttaccaaanaaacgtacgaactcgtacggagtaacgccgtagtacgaacggaccgtaccggttcgttattaacgttcgtggcgaacgnggagtacgggttcccgaactaagttaacccgttagcgtaagtgtaacggcgtcgggaccggaaccggaacgtcccg

SEQ ID NO: 380569 - DNA, 686 bp, Homo sapiens
  misc_feature: GZ8MTXP01AE5NH.13.76.G10.1.454.CMB.2.raw
  modified_base (607)..(607): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctccgtgtcgcacgcctcgtcgggttcaccgtcacgtcacacctacatgagcgtcgggtcccgccgaggcctaccggaggggaacgggggcgtgggagtcgtcgttcttactttttattataggtagtggttagtacatacctccgaacacgaaccgtccggagggacgggggtcctattccacctactcccgtacccgaagaagaacctaaacgttacccaaaacgaaccgtaaccgttcgtttacgttttaaccttaaacctaaagttacgaaaaccggtacgtaccccgttaggaaacggaaccgcccgaagttacgaaacccggtaccggtcccggttagttaacgttaccgtgtacggnggaagacgggtacgtccgggggacccacggttaaacgttaaccgacgtcgtaggtcgggacgttccggcggggaacccg

SEQ ID NO: 380570 - DNA, 697 bp, Homo sapiens
  misc_feature: GZ8MTXP01DECOK.13.76.G10.1.454.CMB.2.raw
  modified_base (329)..(329): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctatagaaataatggcaagtaataaatatacttcctaggtatacagcaagaagtcaaggccctagtcccctgtgctggtcatctatacaagatcgccaagccgccctagaggactccccngagcgtattcctacgtgctacctaactcgtacggacctcgacgcccacgttcacgacctacgtaccgaacggacccgggtaacccgaggtacccgttaagagggacttagggaacggttactacggttaaacttaacgtttacggtacggttaacccggaggggtacgggttaaaccgggggactaacggaccgtaaaccgggcccgtaaacccggtcccggttcccgggtactttacggtttacccgggttaacccggtttacccgggggaaaccggtttaaccgggggaacccggtaaaaccgggttccccgttaaaccccggtaccggtttaaaacggtccccggaaccccggtaaacccccggg

SEQ ID NO: 380571 - DNA, 762 bp, Homo sapiens
  misc_feature: GZ8MTXP01DL8ZU.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctatttaaaggtgccagtgtgaggtgcagctggtggagtcgtggaggaggcttgatccagccgtgggggtccctgagactctcctgtgcagcctcgtgggttcaccgtcagtcacacctacatgagcgtcgggtcccgccgacggccgtaccggaggggaagggggcgtgggaggtcggtcgttctttactttttaatttagtagttaggtggtagtacctatactccgactacgaaccgttccggtgggacgggggtcccgtacgtttcccaaccctacttcccgtacccgaaaggtaacgtaaacctaaacgttacccgaaaaacggtaaacctaccgggttactttagtttttaaccctaaacaaaagttacgaaacctacggtacccggttacggaaacgggtaacgaccccggtaagttccggaaacccgtccgggggtaccccgtttaggttaaacctttaccggtaggtcgggtaacggaaggttacggggtacgttacccggggggacccctaaccgggttaaaccgtttcgttaaccggtcgttaaggtcgggtaaccggtcgggttacgggggtaacccgaacggggtaaccccg

SEQ ID NO: 380572 - DNA, 711 bp, Homo sapiens
  misc_feature: GZ8MTXP01DD7GX.13.76.G10.1.454.CMB.2.raw
  modified_base (257)..(257): a, c, t, g, unknown or other
  modified_base (606)..(606): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagtttggctgagcttgggttttccttgttgcttattttaaaaggtgccagtgtgaggtgcagcgtggtggagtcgtggaggaggcttgactccgagccggtcgggggtccctgacgactctcctgtcgcncgcctcgtcggtcaccgtcacgtcacacctacagtgacgcgtcgggtcccgcgaggcctcggaagggggaacgggggcgtgggaggtcggtccgtttcttttactttttaagtttagttaggttagttggtaacgtacctactacctccgactacgtaaccgttccgggtcgggacggggtcccgtaacttacccacctacttcctaccaacggaagtaaacctaaacttacccaaacggaaacccgtacgttcctttacgtttacctaacgaaaacttcggaaaacctcgaccggtaaggacgaacgtccgaagtacggaccgtacggtaccgtttagtacctttacncgggtagaacggtaggagacgggttacggggaacccctaaggttaaaccgtttcgacgttctaaggtcgggtaccgtcgggacggggaaccaacggggtaacccc

SEQ ID NO: 380573 - DNA, 749 bp, Homo sapiens
  misc_feature: GZ8MTXP01DVA6X.13.76.G10.1.454.CMB.2.raw
tcagtcacgtactaccacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatccgagccgtgggggtccctgacgactctcctgtgcacgtcctcgtgggtccaccgtcagtcacacctacatgacgcgtcgggtcccgcgacggctaccggaggggaacggggcgtggagtgtcgtttctttacttttattagttagtagtggtacgtacacttacgtccgacacgtaccgttcggtgggacggggccctaattccaacctactccgtaccaaggtaacgtaacctaaacttacccgaaaaggtaaacctaccggtacttttacgttttacctaaacaaaacgttacggaaaaccgtacggtacccggtaaggaaccggaaccggtaccggtaaacgttaccgggaaccgtaccccgggggttaccgtttagtttaacgtttaacggtcggtacggaaccgggtaaggacgggtacgggacccgggggtaaccctaaacgggttaaaccgtttacgttaccggtcgttaaaggtcggggtaccgtcggggttaccggggaacccgaacggggtaacccccgg

SEQ ID NO: 380574 - DNA, 543 bp, Homo sapiens
  misc_feature: GZ8MTXP01CH243.13.76.G10.1.454.CMB.2.raw
  modified_base (426)..(426): a, c, t, g, unknown or other
  modified_base (436)..(436): a, c, t, g, unknown or other
  modified_base (478)..(478): a, c, t, g, unknown or other
  modified_base (492)..(492): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagtttttggctgagctgggttttccttgttgctattttaaaaggtgcccagtgtgaggtgcagctggtggagtctggaggaggcttgatccagcctggggggtccctgagactctcctgtgcagcctctggggttcaccggtcagtcacacctacatgagctgggtccgcaggctccgagggaaggggctggagtgcgttcttcttttatttatagtagtggtataccatactccgcagaacctccgtgacggggccgattcaccatctcagagacaattccaagacaacgcttgttctnaaatgaaacngctgagacgaccgatgacacggcctgtatactgtgcgagagngttcgggggacccncgaaacgttcacgctagtggaccgtggttcggggaaccgaaggggaacccg

SEQ ID NO: 380575 - DNA, 808 bp, Homo sapiens
  misc_feature: GZ8MTXP01CVQNY.13.76.G10.1.454.CMB.2.raw
  modified_base (294)..(294): a, c, t, g, unknown or other
  modified_base (312)..(312): a, c, t, g, unknown or other
tcagtcacgtactacacgaccggtgctcgatttagtcactcatacaggggtgggagaggagcccagcactgggattccgaggtgtttccattcggtgatcagcactgaacacagaggactcaccatggagttttggctgagcgtgggttttcttgttgctatttaaaaggtgccagtgtgaggtgcagcgtggtggagtcgtgggaggagtcttgatccgaggtccgtcggggggtccctgacgactctccgtgtgcacgtccttcgtggttccaccgtcacgtacacacctanagtgacgcgtcgggtccnccgaggccgtaccggaagggggacggggtcgtagggtacggtcgtccgtttactttacgttttttaagtttagttaggttaggttacggttaacgtaacgtacgttaccgtaccgacgtaaacgtccgttccgggtagggacgggtaccgtacttccgaacctacgtcctacgaagtaaccaaactaagttaacccgaaaaagtccgttaccggttcgttttaactttaccgtaaaacaaacgtaaccgaaactcggtaacggtaacgaaacggccgtaccgtaagtaccggtaaccggtacccgggttacgtttaacttaacgttccgggtgggtaacggacggggttaaacggtaaccgggttacccggggttaaaccccggggtacccttaaaaacgggtttaacccggtttaaccgaacggtttacccggttaaggggtacccgggtaccggggttaccgggtaacccgggggttaaaacccgtaacggggg

SEQ ID NO: 380576 - DNA, 677 bp, Homo sapiens
  misc_feature: GZ8MTXP01DMU6M.13.76.G10.1.454.CMB.2.raw
  modified_base (386)..(386): a, c, t, g, unknown or other
  modified_base (433)..(433): a, c, t, g, unknown or other
  modified_base (468)..(468): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgactccgaggccgtgggggtccctgacgactctcctgtgcagcctcgtgggtccacgtcagtcacacctacagtgagcgtcgggtcccgcgaggcgtccggaggggagggggccgtaggaggtgtcgtttctttacttttatttagtagttagtggtataccatacgtccgnacggaacctcgtgggacggggccgtattccgaccatcctacgaaganacaataccgaaagtaacacgtcttcgtttactaanaaatacgaacacggtaccgtaggagacggcccgaatccggaaccgtcggtaccggttgttaacgttagtgggtcgaacgggagttaagggcgggttaccccgggggaaaccctaacggggttaaaaccccgtttacgttacccggtgttaaacggtcggggaaccgggttcggacggggggaaccccgttaaacggggggtaacccccg

SEQ ID NO: 380577 - DNA, 641 bp, Homo sapiens
  misc_feature: GZ8MTXP01EGP3B.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtcgtggaggaggcttgatccgagccgtgggggtccctgagactctcctgtgcagcctgtcggtcaccgtcacgtcacacctacatgagcgtcggtccgccgaggcctccggagggggaacggggcgtgggagtcgtcgttctttcttttattagtagtagtaggtatacatactccgaacagcgtcggtaggacggggctattccgactactcctaccgaaggactaactaaacttaccgaaaagtaaacctcggtctttacgtttactaaacgtaaatcgaaacgacgtccgtagacgacgtacccgagtcgaacgtccgggtcttagttccttagtggtcgacggtaaggagtacgggtcccgggggaacccttacggttaaaccgttaacgtacccgtgttacggacgggttacggttcgggaaccgggggaacccgg

SEQ ID NO: 380578 - DNA, 654 bp, Homo sapiens
  misc_feature: GZ8MTXP01AHZMP.13.76.G10.1.454.CMB.2.raw
  modified_base (305)..(305): a, c, t, g, unknown or other
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagcccaccctcagtgtccgtcgtccccaggacagacagccagcatcacctgctctagaaataagtggacagataaatatacttctggtatcagcagaagtcacggcccacgtccccgtgtcgtctggtcatctaagtcaagntcgaccaagccggccctacgacgggacctcccgtgacgtcgtattccgtcgtcgcctaccaactcgtacgggtaactcgacgccctactctacgaccacgtcgaacggccgggacccacggtacgtagtaggacttggagggggtctacgtacgttaacgttaccgtggtacgacggggtacgggtacgggacacgggccgaaggtccgtaaccgttcccgggccccgttcgttaaacgttcccggttccggtttaaccgggttaacccgggttaacggggaaacccgttaaccggggttaccccttaaccccgggttaaccgttaaaccggttcccgtaaaccccggg

SEQ ID NO: 380579 - DNA, 630 bp, Homo sapiens
  misc_feature: GZ8MTXP01AQK4B.13.76.G10.1.454.CMB.2.raw
  modified_base (381)..(381): a, c, t, g, unknown or other
  modified_base (403)..(403): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctctgtgcagcctcgtgggttccaccgtcagtcacacctacactgagcgtcgggtccgccaggcctcgaggggaggggctggagtgcgtcttcttttattagtagtagtggtagtacatacgtccgacacgtccgtcggngggacggggcctattccaacgntcctaccgaagacgacaacttacccaaagtacacgtcttgtttactacaaagtcggaacagtccgtagacggtacgccgtagtacgaccgtacggtccgtatacgttacgtggtacgcggaaggttaacgcgggttcggggacccccttaagggttaaacccgttttaaccgaacggtcccgttaagggtcgggttacccgttcgggttaaccgggggaaccccggg

SEQ ID NO: 380580 - DNA, 617 bp, Homo sapiens
  misc_feature: GZ8MTXP01D7IUW.13.76.G10.1.454.CMB.2.raw
  modified_base (462)..(462): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatccgagccgtgggggtccctgagactctctgtgcagcctcgtgggttcaccgtcagtcacacctacatgacgcgtcgggtccgccgaggcctccggaggggaagggggctgggagtggtcgttctttcttttattagttagtagtgtagtaccatactcgcagacctccgtggacggggcctattcaccatctaccagacaactaactaccgaaagaacacgtctttgttactaacaaatgaaacncgtccgtagacgaacgccgagtccgacgtacggaccgtttggtaccttacgtcggtggaacgtaaggacgtacggttacggggaccccaacggttaaccgttacgacgtctaagtcggaaccgtcgggacggggaacccaacgggggtaaccccg

SEQ ID NO: 380581 - DNA, 666 bp, Homo sapiens
  misc_feature: GZ8MTXP01ANLUB.13.76.G10.1.454.CMB.2.raw
  modified_base (316)..(316): a, c, t, g, unknown or other
  modified_base (580)..(580): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggtcaccgtcagtcacacctacatgagctgggtcccgccaggctccgaggggaggggcngggagtgcgtcttcttttattagtagtagtggtagtaccatactccgcagaccgttccgggtggacgggggcctacgtttcacccgtatcctacccaaggtacgaacctaaattacccaaaaggtaaccacggtccttagttttaccttaacaaaacttacggtaaaccaaggccccgttaggaaacgcgggaccccgtaagttcggaaccgtaaccgggtcccggttagttaacctttaccggtgtcggaacgaagttacggngttccgggggaccccaacggttacgttaccgttacgtccgtagttcgggacgttcggcgggggaacccgttaacgggggaaccccg

SEQ ID NO: 380582 - DNA, 692 bp, Homo sapiens
  misc_feature: GZ8MTXP01AYIXU.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgtccagtgtgaggtgcaagtggtggagtcggtggggggggcttggttaagccgtggggggtccctcgagactctcctgtcgcaacctctggtattctattttctactgacgtccgttgggttgacgtcgtcgggtcccgccgacgggccgtacccggggagggcgtgggaggttggggttcggtaccgttaagttaaaggtagaagactagtgggtacggaacaacgagtactacgtacgtccgttcccggtaggaaacgcaagtaacttacaactatctacgaagagatacgaactaagaaaaagtaatagaattatactacgtagaactaaagtacgaaaaccaaacgtaaagaaaacggcggaaaggaaccaacgtaggtccgtaagtaacttacgaacgtacccaagagtacgcgggaacaagttagtacgaacgtaaacggcggttacccgcggacggtaacgtccggtaaccggttacggggtcgggggaacccggtaacgttccgttaaccggg

SEQ ID NO: 380583 - DNA, 776 bp, Homo sapiens
  misc_feature: GZ8MTXP01CHMP9.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggtcttgatccgagccgtgggggtccctgagactctcctgtgcacgcctcgtggttcaccgtcagtcacacctacagtgagccgtgggtcccgccgacggcctaccggaagggggaacgggggcgtggggacggttggtaccgtttctttactttttaagtttagttaggttaggtttaggttaacggttacaacgttaaccgtcccgaacgacgtaacccgttccgggtaaggggaccgggggtccgtaacgtttcccgaacctacttcccgtacccgaaaggaactacctaaaactttacccgaaaacggtaacctacggttacctttggttttaccctaaaccgtaaagttacggaaaccggtacgtcccgttaggacggacgacccgagttacggaaccgaccgggtccttagggttaaacttcgggtgtacggaccgggaagggttacgtaacgggtcccgggggttaaaccccaaacggttaaacccgggtttaacaccccggtaagtttaaacgggtccgggttaccgggtcccgggttaacgggggaaacccccggg

SEQ ID NO: 380584 - DNA, 707 bp, Homo sapiens
  misc_feature: GZ8MTXP01B9CKR.13.76.G10.1.454.CMB.2.raw
  modified_base (488)..(488): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtgggtcaccgtcagtcacacctacatgacgcgtcgggtcccgcgaggcgtccggaggggacggggcgtggagtcgtcgttctttcttttatttagttagtagtggtacgtacctatactccgcacgtacctccggtggacgggaccgtacgtccacctactctaccagaacgaacctaaacttacccgaaagaacctaacggtctttcgtttaccttaacaaattacgaaacncgtaccgtagacggacgacccgagtccggaacccgtcgggtaccgttagttaacgttacgtgggtcggaaccggtaaggacggtacgggttacccgggggaaacccctaaacgggttaaacccggtttcccgttaaacggtccggtttaaacggttccgggggtaaccggtttcccggggaaccggggggtaaccccgaaaccggggggttaacccccg

SEQ ID NO: 380585 - DNA, 699 bp, Homo sapiens
  misc_feature: GZ8MTXP01APTPY.13.76.G10.1.454.CMB.2.raw
  modified_base (590)..(590): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagcttgggttttccttgttgcttattttaaaaggtgcccagtgtgaggtgcagctggtggagtcgtggaggaggcttgatccagccgtgggggtccctgagactctcctgtgcagtcctgtgggttcaccgtcagtcacaccgtacatgacgcgtcgggtcccgccgaggccgtaccggagggggaacgggggctagggagttcgcgttcttacgtttttaagtttatagttaggtcggtagtactactactccgaacgacgccgtccggtagggacggggccgtattccgaacctacttaccacccgaaaggaacgaaacctaaacttacccgaaaacggtaacctacggttaccttttgttaaccctttaaaactaaacgtacgaaaccggtcgaccgtaaggaacgacggaccgagtacgaccgtacggtccgttagtacgttcgnggtacgacggaaggaacggtacgggtacccgggttacccgttaaacggttaaccgttaacgtacggtaacgttacgggtccgggttacggtccgggaaccggggaaccg

SEQ ID NO: 380586 - DNA, 672 bp, Homo sapiens
  misc_feature: GZ8MTXP01AE1QZ.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcacgcctcgtgggttccaccgtcagtcacacctacatgagcgtcgggtcccgccgaggcctccgaggggaagggggctggagtgcgttcttcttttattattagtagtgtagtaccatactccgcagaaccgtccggtggacggggccgtattccgacctatctaccgagacgaactaattacccaaaggaaccacggtcttagttttacctaacaaaacgttacgaaacctacggacccgttagggaacggacgacccggtatcggaaccgtaccggtcccggttagttaacctttacgtggtacggaacggaagggacggtacggttccgggggaacccctaacgggttaaaccgtttcaccggtaacttaggtaacggggtaccgtcgggttacgggggaacccgaacgggggtaaccccg

SEQ ID NO: 380587 - DNA, 590 bp, Homo sapiens
  misc_feature: GZ8MTXP01ENF1G.13.76.G10.1.454.CMB.2.raw
  modified_base (249)..(249): a, c, t, g, unknown or other
  modified_base (452)..(452): a, c, t, g, unknown or other
  modified_base (462)..(462): a, c, t, g, unknown or other
  modified_base (500)..(500): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatccagccgtgggggtccctgagactctctgtgcngcctcgtggtcaccgtcagtcacacctacatgagcgtcggtcccgcgaggcgtcgagggaaggggctggagtgtcgttcttcttttattatagtagtagtacgtaccatactccgcacgaacctccggtggacggggccgtatccacctactcctaccgaagacgaactaacttaccgaaagaactacgtcttagtttctaanaaatgaaacngtccgagacgcgacgatcgacgcggaccttgtattacnggtgcgaagagtacggttcgggaaccctaacggttaaccgttcacgcgttaagcggtacgtcggacgggaacccgttaacgggaaccccg

SEQ ID NO: 380588 - DNA, 766 bp, Homo sapiens
  misc_feature: GZ8MTXP01AK8M0.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctgtgggttcaccgtcagcacacctacatgagcgtgggtccgccagggcctaccggaggggaaggggctggagtgcgtcgtttcttttatttatagtagtggtaagttacatacctcccgaacgagtccgtcccggtagggacgggggtccctaattccacctaaacttccctaacccgaaggaacgtaaaccgtaaacgtttaccccaaaaacggtaaccctaaccggtccctttaggtttttaacccttaaactaaaacgtttgaaaacccggtacggacccgttagggacggaaacgtccccggaaagttaccgggaaaacccggtacccggggtcccggtttaagttaaccgtttaaccggtttggtaccggttacgggtaaacggaggtaaaccgggttcccgggggacccccgttaaacgggttaaaccccggtttaacgtaccgggtaacttaacgggttaacgggttacccggtttcggggttaacccgggggtaaaccccggg

SEQ ID NO: 380589 - DNA, 619 bp, Homo sapiens
  misc_feature: GZ8MTXP01AFN8P.13.76.G10.1.454.CMB.2.raw
  modified_base (575)..(575): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccgagccgtggggggtccctgagactctcctgtgcagcctcgtgggttcaccgtcagtcacacctacatgagcgtgggtcccgccgaggcctccggaggggaggggctggagtgtcgttctttcttttattagtagtagtggtagtaccatactcgacagaaccgtccggtggacggggcctattccaccatcctaccagacgactaacttaccaaagacctacgtcttgtttactaacaaagtcgaactacgccgtaggaacgacgacccgagcgaccgaaccgggtccgttagttacgttacgtggtgaacggaagaggtacggcgggggaccctaacggttaaccgttcaccggtntaggtcgggtacgtcgggttacggggaaccgaacgggtaacccg

SEQ ID NO: 380590 - DNA, 608 bp, Homo sapiens
  misc_feature: GZ8MTXP01DI7AF.13.76.G10.1.454.CMB.2.raw
  modified_base (290)..(290): a, c, t, g, unknown or other
  modified_base (443)..(443): a, c, t, g, unknown or other
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggtttccttgttgctatttaaaggtgcccagtgtgaggtgcagctggtggagtctggaggaggcttgatccagccgtgggggtccctgagactctcctgtgcagcctcgtggtcaccgtcagtcacactacatgagctcgggtccncgaggctcgaggggagggctggagtgcgttcttcttttatttatagtagtggtacgtacatactccgcaacgactcggtggacgggccgtattccacatctacagacaactattaccgaaagaacacgtcttagttcctaacaaatcgaaacnggccctaggacgacggccaagtcgaaccgacgggtccgtagttactacgtgtaagcgttaaggacgaggtccgggggaccccttaaacgggttaaccgttaactaacccgggtatttaacgggcgggtaccggttcggtaaccgggggaaccccgtaaaacgggg

SEQ ID NO: 380591 - DNA, 727 bp, Homo sapiens
  misc_feature: GZ8MTXP01BR80C.13.76.G10.1.454.CMB.2.raw
  modified_base (297)..(297): a, c, t, g, unknown or other
  modified_base (611)..(611): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtctggaggaggcttgatccagccgtgggggtcctgagactctcctgtgcagcctgtgggttcaccgtcagtcacacctacatgagcgtgggtcccncgaggcctccgaggggaagggggctagggagtgcgttcttactttttattagtagttagtcggttagtactagtacctcccgaacgaacgaaccgtccggtagggacgggggcccgtaatttcccgactactctacccgaagtacgaacaaactttacccaaaacggtaaacctacggttccttacggttttacccttaacgaaaacgttacggaaaccgtaacggtaccccgttaagggaacggtaaaccggccccggtaaagttccggaaaacccggtccggggtaccccgtttagttaaccgtttaaccgngggttcgaaccgggtaaggacgggtacgggtaccggggaccccgttaaacggttaaaccggttaacctacggtccttaaaggtcgggttaacgtccggttaacgggggaaccccgg

SEQ ID NO: 380592 - DNA, 665 bp, Homo sapiens
  misc_feature: GZ8MTXP01A83BO.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgccagtgtgaggtgcagcgtggtggagtcgtggaggaggcttgatccagccgtgggggtcctgagactctcctgtgcagcctcgtgggttcaccgtcagtcacacctacatgagcgtcgggtccgcaggctccggaggggaggggctggagtcgcgttcttctttttattagtaggttaagtggtagtaccatacgtccgcagaacctccggtggacggggcctattccacatcacagacgaacaacgttaccaaagtaacaccgtactttgtttaccttacaaagtacgaaaccacggtccgtaaggaacggtacggcccgaagtcggaaacccgccgggtaccgttggtaactttaacgttcggaggaacggaaggttaaacggacggttacgggggaaccccctaaacgggttaaccgttacgttacccggtaacttaagggtcggttaacccggtcgggttaccggggaacccgttaacgggggtaacccc

SEQ ID NO: 380593 - DNA, 673 bp, Homo sapiens
  misc_feature: GZ8MTXP01BODG6.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtcgtggaggaggcttgatccagccgtgggggtccctgagactctcctgtgcagcctcgtcgggttcaccgtcagtcacacctacatgacgcgtcgggtccgccgaggccgtccggaggggaacgggggcgtgggagtcgtcgttctttcttttatttagtagttagtggtagtaccatactccgacacgaaccgtccggtgggacggggtacccgtacttccgacctactcctacccgaagacgaaactaacttaccgaaagtaaccgtacgttcgtttacgttttacctaacaaaagttcgaaacctcggccgtaggacgacgacccgtagtcggaaccgtcggtaccgttgttaacgttcgtggtcggaacggagttacgggcggttccggggaacccctaaggttaacgttacacggtaacgttaggtcgggtaccgtcgggttacgggggaacccgttaaacggggtccccg

SEQ ID NO: 380594 - DNA, 604 bp, Homo sapiens
  misc_feature: GZ8MTXP01EJF0X.13.76.G10.1.454.CMB.2.raw
  modified_base (419)..(419): a, c, t, g, unknown or other
  modified_base (429)..(429): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagcgtgggtccgccaggctccgagggaaggggctggagtgtcgtctttcttttattagtagtagtgtataccatactcgcagaactcgtgagggccattcaccatctcagagacaatccaagacacgcttgttctanaaatgaaacncgccgtagacgtacgccgatcgaccgacgggtccgttgtaattaccgtggtagcggaaggaggacggttccgggggacccctaaacgggttaaccggtttaccacggtccgttaaaggttcggggtaaccggttccgggttacggggggtaacccaaaacggggggtaacccccg

SEQ ID NO: 380595 - DNA, 747 bp, Homo sapiens
  misc_feature: GZ8MTXP01BEVF1.13.76.G10.1.454.CMB.2.raw
  modified_base (252)..(252): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtgggaggaggcttgactccagccgtggggtccctgacgactctctgtgcncgcctcgtcggtcaccgtcagtcacacctacatgacgcgtcgggtcccgccgaggccgtccggaggggaagggggctagggagtcggcgtttctttacgtttttaatttagttagttaggttggttaacgtacctactaccgtccgacgtaacggaacccgttccgggtggggaccgggggtaccctaacttccgaacctacgtcctacccgaagtaacgaacctaaacttacccgaaaagtaaacctaccggttacttttacggttttaccttaacaaaacgttcgaaaaccgacggtacccggtaggaaacggtaccgacccggtaaatccggaaacccggtccgggttacccgttaagttaacgtttaccgtggtacgggaacggaaggaacggtacgggttacgggaccccgtaaacggttaacccgtttacgaccggttaatacggtcgggaaccgtcgggttaccggggaaccgaacggggtaaccccg

SEQ ID NO: 380596 - DNA, 660 bp, Homo sapiens
  misc_feature: GZ8MTXP01D0C18.13.76.G10.1.454.CMB.2.raw
  modified_base (470)..(470): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatccagccgtgggggtccctgagactctcctgtgcagcctctgggtcaccgtcagtcacacctacatgagcgtcgggtcccgccgaggcctaccggaggggaaggggctgggagtgcgttctttcttttatttagtagttagtggtagtacatactccgcagacctccggtgggacgggtcccgtattccgacctactcctaccaagacaactaactaccaaagaactacgtcttgtttactacaaatcgaaacncggcctaggagtacgacccgaagtcgaaccgtaccggtaccgttagttaacttacgtggtcggaacggaaggacgggtacggttccgggggaaaccccctaagggttaaaacccgtttcgttaacccgtcgttacggtaacggggtaccggtccgggttacgggggaacccgaaaacgggggtaaccccg

SEQ ID NO: 380597 - DNA, 596 bp, Homo sapiens
  misc_feature: GZ8MTXP01C8EDZ.13.76.G10.1.454.CMB.2.raw
  modified_base (365)..(365): a, c, t, g, unknown or other
  modified_base (369)..(369): a, c, t, g, unknown or other
  modified_base (478)..(478): a, c, t, g, unknown or other
  modified_base (510)..(510): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttctgttgctatttaaaggtgccagtgtgaggtgcagctggtggagtcgtggaggaggcttgatccgagccgtgggggtccctgagactctcctgtgcacgcctcgtgggttcaccggtcagtcacacctacagtgagcgtggtccgccaggctacggagggggaagggcgtgggagtcgtcgtctttcttttattagtagttagtggtagtacntacnccgacagcgtcgtgggacggggccatccacatcctacagagactaattacccaaagacacgtcttgttacttacaaatcgaactagccgtagagacgccgatcggaacncgggtccgttagtacgtttaacgtggtacggnggaggaggacgggtcgggacccgttaacggttaccgtttaaccgaacgtcgttaagcgggttaccggttcggaacgggggaacccg

SEQ ID NO: 380598 - DNA, 595 bp, Homo sapiens
  misc_feature: GZ8MTXP01EAVB5.13.76.G10.1.454.CMB.2.raw
  modified_base (382)..(382): a, c, t, g, unknown or other
  modified_base (408)..(408): a, c, t, g, unknown or other
tcagtcacgtactacacgaccggtgctcgatttagtcactcatacagggggggagaggagcccagcactgggattccgaggtgtttccattcggtgatcagcactgaacacagaggactaaccatggagttttggctgagctgggttttccttgttgctattttaaaggtgcccagtgtgaggtgcagctggtggagtcgtggaggaggcttgatccagccgtgggggtccctgagactctcctgtgcagcctcgtgggttccaccgtcacgtcacacctacatgagcgtgggtccgccgaggctccgagggggaggcgtgggagtgcgttcttactttttattagtagttagtggtagtactactacctcgcagactccgngggcggggctattcaccatctcaganactaacttccaaagaccacgttctgttttcacaaatcgaacacgcctagggacggagtcccgagtcgaccgacggttccagtttaactcgtgtcgcggaagcgaggtccggggaccctaacggtaacggttacccttggctaagggtcggcgttcggcgggggacctaacggggttccctaaccggg

SEQ ID NO: 380599 - DNA, 676 bp, Homo sapiens
  misc_feature: GZ8MTXP01CEX7V.13.76.G10.1.454.CMB.2.raw
  modified_base (558)..(558): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctaattttaaaaggtgcccagtgtgaggtgcagcgtggtggagtcgtggaggaggtcttgatccgaggccgtcgggggtccctgacgactctcctgtgcagcctcgtgggtccaccgtcacgtcacactacatgacgcgtcggtccgcgaggcgtccggagggaggggcgtaggagtcgtcgtttctttacttttattagtagtagtggtacgtactactactcgcacgaacctcggtggacgggcctattcacctactctaccaggaactaacctaacgtaccaaaggaccctacggttcctttagtttacctaacgaaattaccgaaactcgtaccgtaggaacggaccgaccgtaagtaccgaccgaccggggttaccttagttaacctttaacgggnggtaacggaacggtaaggacgggtaccggttcccgggtaaaccctaacggttaaccgttacgttacgtaacgtacggtcgggtcggtacgggaccgggtaacccgaacgggtaacccg

SEQ ID NO: 380600 - DNA, 742 bp, Homo sapiens
  misc_feature: GZ8MTXP01BWGD4.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatccagccgtcgggggtccctgagtactctccgtgtgcacgtcctcgtcgggttccaccgtcagtcacacctacatgagcgtgggtcccgcaggctccggaggggaggggctgggagtcgtcgttctttcttttagttatagtagtggtagtacctatactccgcacgtaaccgtccggtgggacggggccctagttccacctagtcctaccgagaacgaacctaaagttacccaaaagtaacctaaccggtctttacggttttaccctaactaaaaagttcgaaaacgtcgggtaccctaggggaaacgtaccggacccgtaagttccggaacccggtaaccgggttcccgttaaggttaactttaacgtccggggtagtaaccggggaaggttaacggggtaccggttacccgggggtaaccccgtaaaacgggttaacccggtttaacccgacgtcgttaaacgggtcggggttaacccgggtcggggttaccgggggaacccgttaaaccggggggtaaccccg

SEQ ID NO: 380601 - DNA, 701 bp, Homo sapiens
  misc_feature: GZ8MTXP01EBC8X.13.76.G10.1.454.CMB.2.raw
  modified_base (250)..(250): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccaggccgtgggggtccctgagactctctgtgcngcctcgtggtcaccgtcagtcacacctacatgacgcgtcgggtcccgccgaggcctaccggaggggaacgggggcgtgggagtcgtcgttctttacttttatttagttagttaggtaggtagtaccatactccgcacgtaaccgtccggtgggacggggccgtattccgacctactcctaccgaagacgaactaacttaccaaaaggaacctaccggttctttacgttttacctaacgaaaacttacggaaactccggtaccgttaggaacggtacgacccggaagtacggaccgaccgggtaccgttgttaacttaccgtggtggaacggtaaggacgggtacggttccgggggaccccgaacgggtttaaacccgttacgaaccggtcgttaaggtcgggtaacccgggttcgggacgggggtaaccccgaaacgggggtaacccccgg

SEQ ID NO: 380602 - DNA, 615 bp, Homo sapiens
  misc_feature: GZ8MTXP01AG3SG.13.76.G10.1.454.CMB.2.raw
  modified_base (237)..(237): a, c, t, g, unknown or other
  modified_base (249)..(249): a, c, t, g, unknown or other
  modified_base (288)..(288): a, c, t, g, unknown or other
  modified_base (295)..(295): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataatggcagataaatntacttctggtancagcagaagtcaggccagtcccctgtgctggtcatctanacaagtntacgccctaaacggcccggtaccccgtagaacggggtacctccccccgtaggacgtccgtactttccgtaacgtcgggccctacccaaacgttcgtacggggtaaacctcgacgccctactctacgaccacgtacgacggcccgggaacccagggtacctagtacggagtgggaacggtcgtagtaccgttaattcgtgtacgagggtcggtagggactacggacacgtcaacgtcgccgtcttagtcggtccgttacgggacgttaccgggaacctacggtcccgtaacccggttcgttaacgtccgaaccgaaccccg

SEQ ID NO: 380603 - DNA, 580 bp, Homo sapiens
  misc_feature: GZ8MTXP01BT58C.13.76.G10.1.454.CMB.2.raw
  modified_base (445)..(445): a, c, t, g, unknown or other
  modified_base (454)..(454): a, c, t, g, unknown or other
  modified_base (465)..(465): a, c, t, g, unknown or other
  modified_base (492)..(492): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggtcaccgtcagtcacacctacatgagcgtgggtcccgccgaggcctccggaggggaaggggcgtggagtgcgtctttcttttattatagtagtggtatacatactcgcagaactcgtggacgggccgattccaccatctaccagagactaataccaaagaacacgtcttgtttctacaaaatgaaacngctagagcnccgatcgaacncgggccttgtattacgtgtgaacgagngacggttcggggacccctaaggttaacccgttacttacggcttaaggtcgggaccgttcggacgggggtaacccaagggggtaacccc

SEQ ID NO: 380604 - DNA, 569 bp, Homo sapiens
  misc_feature: GZ8MTXP01BXRM8.13.76.G10.1.454.CMB.2.raw
  modified_base (295)..(295): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataatggcagataaatatacttcctgtatcagcagaagtcaggccagtcccctgtcgctggtcatctatacaagntgccaaggccggccctgacggggactccccccgtagagcggtattcctcgtggcctccaactcgtacgggaacctcgacgcccactctacgaccagtcgacggaccgggaccctaggcctagtggactggacgtcgtagtaacttattacgtggtacgcgggtcgtacgggactagcagcaacgtcgcccgtcgttacgtcgttccgttacggttacgttacggggaacctacggggtccacccggtaccgttaacggtaaccgccgaaccccg

SEQ ID NO: 380605 - DNA, 750 bp, Homo sapiens
  misc_feature: GZ8MTXP01D86EB.13.76.G10.1.454.CMB.2.raw
  modified_base (380)..(380): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtgggaggaggcttgatccgaggccgtgggggtccctgagactctcctgtgcagcctcgtcgggtcaccgtcacgtcacacctacatgacgtcgtcgggtcccgccgaggccgtaccggaggggacggggcgtgggagtgtcgttctttcttttattagtagtagtgtagtaccatacncgcacgtaacgtcggtggacgggcctacgttccacctactcctaccgagaacgaaacctaacgttaccaaaggaacctaaccggttcttttacggttttaccctaaacgaaaaacgttacggaaaacccgtacggtacccgggttaaggaaacggtaaccggaccccggtaagtaccgggaacccgtaccggggtaccgtttaagtttaacgttaacgttgggtcgggaacgtaaacgggacggtaaccggggttaccgggggaaccccttaaacgggttaaaacccgtttccgttaccggaacgtttaacgggtcggggtaacccggtcggggttaccgggggaaccccggaaacggggtaacccccgg

SEQ ID NO: 380606 - DNA, 686 bp, Homo sapiens
  misc_feature: GZ8MTXP01BSANE.13.76.G10.1.454.CMB.2.raw
  modified_base (510)..(510): a, c, t, g, unknown or other
  modified_base (631)..(631): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccgagccgtgggggtccctgagactctcctgtgcagcctcgtgggttcaccgtcagtcacacctacatgagcgtcggtcccgccgaggcctaccggaggggaaggggctgggagtgtcgttctttctttttaagtttatagttagtaggtacgtactatactccgcacgaactcccggtggacggggcctacgttaccacctacgtcctaccgaatacttaaccaaacgttaccaaaagtaaccacgtctttagtttacctacaaaatcgaaactgtccgtaggaacggaaccnccgggtaaatcggaaaccgtacccgggtacccgttgttaaccgttacgtggtcggaacggaaggttacggacggttcccgggggaaacccctaacggttaaaaccgttccgttaaacccgngtttaaggcgggtaaccggttcgggacgggggtaacccaaacgggggtaaccccg

SEQ ID NO: 380607 - DNA, 551 bp, Homo sapiens
  misc_feature: GZ8MTXP01E4APN.13.76.G10.1.454.CMB.2.raw
  modified_base (520)..(520): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagctgggtccgccaggctccgaggggaagggggctggagtgcgtcttcttttattatagtagtggtagtaccatactccgcagaacctccgtggaggggccgatcaccatcctccagagacaattaccaaagaacacgcttgtttcttacaaatgaacacgcctgaagagcccgaatgacgacggtccgtgtattacgtgtgcgagagagttcggggacccaacgacgttacacgntagtggcgtcgcggggccgaacgggaacccg

SEQ ID NO: 380608 - DNA, 675 bp, Homo sapiens
  misc_feature: GZ8MTXP01EXAYO.13.76.G10.1.454.CMB.2.raw
  modified_base (253)..(253): a, c, t, g, unknown or other
  modified_base (519)..(519): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgtctattttaaaaggtgcccagtgtgaggtgcagctggtggagtcgtggaggaggcttgactccgagccgtcgggggtccctgagactctcctgtgcngcctcgtgggttccaccgtcagtcacacctacatgacgcgtcgggtcccgccgaggccgtccggaaggggaacgggggcgtgggaggtcgtccgttctttacgtttttaattagttagtaggttggtattaccattactccgacacgtaaccgtccggtgggacggggtccgtacttccaacctatccctaccaggtaacaacctaaagttccccgaaaaggaaccctacggtccttttagttttacctaacaaaacgtgaaaacncgtccgtaggaacggtaccgcccgtaagtccgaaccgtaccggggtaccttagttacgttactggtacggaacgagaggacggttccggggaaccctaacgttaacggtttcacggtctaggtcggccggtggttacggggccgaaacgggccccg

SEQ ID NO: 380609 - DNA, 703 bp, Homo sapiens
  misc_feature: GZ8MTXP01CIGET.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtctggaggaggcttgatccagccgtgggggtccctgagactctcctgtgcagcctcgtgggttcaccgtcagcacacctacatgagcgtgggtcccgccgaggcctccggagggggaaggggcgtgggagtgcgtcttacttttattatagtagtggtagtactatctccgacagcgtccgtgggacggggccattcaccatcctaccgaagaacgtaactaaacttacccgaaagtaaacctaccgtactttacgtttacctaaaccaaaagttaggaaaacctacggtacccgttaggaacggaacggcccgaagttaccggaaccggtaacccggtcccggttagttaaactttaaccggttggtacggaccgggtaaggacggtaacggggtcccggggggttaaacccccttaaacggggttaaaacccgtttaacgaccggtaacgttaacgggtacggggttacccggtttaaccgggcggggggtaaaaccccggg

SEQ ID NO: 380610 - DNA, 585 bp, Homo sapiens
  misc_feature: GZ8MTXP01A2E1V.13.76.G10.1.454.CMB.2.raw
  modified_base (170)..(170): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctctaggaaataatggcagataaatatacttctggtatcagcagaagtcaggccagtcccctgtcgctggtcatctatacaagatcgaccaagccggcctcgagggactcccccgtaggacgtcgtacttcgtcgtcggcctaccgaactcgtacgggaactcgacgccctactctacgaccatccgacggccgggaccaggcttagcggatgggacggtcggtacgtaacttacgttacgtcggtcgaagggtcggtaggggacacggcgacgctaaccgtcgttcccgtcttacgtcgggttacgttaccgggacgttacggggaaccctacgggtccctacccggtacgttaacggtccgaaccggaaccccg

SEQ ID NO: 380611 - DNA, 638 bp, Homo sapiens
  misc_feature: GZ8MTXP01EYG2Y.13.76.G10.1.454.CMB.2.raw
  modified_base (482)..(482): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtcgtggaggaggcttgatccgagccgtgggggtccctgagactctcctgtgcacgcctcgtcgggttcaccgtcagtcacacctacatgagcgtcgggtcccgcgaggcctccggagggacggggctgggagtcgtcgttctttctttttattagttagtaggtggtagtaccatactccgcacgtacctccggtggacggggtcctagttccaccgtatcctacgagacgaactaacttaccaaacgaactacgtctttacgtttactaacaaagttcgaaacncgaccgtaggaacggacgaccgagtacgaccgtaccggtccgttagttacttacgtggtgaacggagacggcggttaccgggaccctaacggttaacgttcttacggtaactaggtcggtaccggtcggacggggtaacccgaacgggtaaccccg

SEQ ID NO: 380612 - DNA, 584 bp, Homo sapiens
  misc_feature: GZ8MTXP01AUGD8.13.76.G10.1.454.CMB.2.raw
  modified_base (442)..(442): a, c, t, g, unknown or other
  modified_base (516)..(516): a, c, t, g, unknown or other
  modified_base (547)..(547): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggtttttccttgttgcttattttaaaaggtgcccagtgtgaggtgcagctggtggagtctggaggaggcttgatccagccgtgggggtccctgagactctcctgtgcagcctcgtgggttcaccgtcagtcacacctacatgagcgtggtccgccgaggcctaccgaggggaaggggctaggaagtgtcgttctttctttttatttagtagtagtggtagtaccatacgtccgcagaaccttccggtggacgggggccattccaccatcctaccagagaacaaattccaaagaacacgtnttcgtttactaacaaatgaaacacgaccgtgaacggacgccgtatcgaccgtacgggccgttagtattacgtgngcgagagagttcgggacccagttaacgttcncgaatagtggcgtcgcggggaaccgaacgggaacccg

SEQ ID NO: 380613 - DNA, 594 bp, Homo sapiens
  misc_feature: GZ8MTXP01CAJBI.13.76.G10.1.454.CMB.2.raw
  modified_base (280)..(280): a, c, t, g, unknown or other
  modified_base (395)..(395): a, c, t, g, unknown or other
  modified_base (413)..(413): a, c, t, g, unknown or other
  modified_base (423)..(423): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctanatgagcgtgggtcccgcaggctccgaggggaggggctgggagtgcgttctttctttttaatttatagtagtggtatacatactccgcagaactcgtggacggggccagttccacntctccagagacatccaanacacgtcttnttctacaatgaacagccgtaggagtacgaccgatcgacgaccgggtccgttgtacttaccgtggtaggcgaaggacggaggttcccggggaaccctaacggttaaaccgttccgttacggtcgtagtcgggaccggtcgggttacgggggaacccgaaaggggtaaccccg

SEQ ID NO: 380614 - DNA, 747 bp, Homo sapiens
  misc_feature: GZ8MTXP01EIWB9.13.76.G10.1.454.CMB.2.raw
  modified_base (433)..(433): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcgttgggttttccttgttgtcttaattttaaaaggtgcccagtgtgaggtgcagcgtggtggagtcgtggaggaggcttgatccgagccgtcgggggtccctgacgtactctccgtgtgcagcctcgtcgggttcaccgtcagtcacacctacatgagcgtcggtcccgcgaggcctccggaggggagggcgtggagtcgtcgttctttacttttattagtagtagtgtagtacccatactcgcacgaacgtcgtggacgggtcctattccgacctactcctaccgaggtaanaacctaaacttaccgaaaacgaaacgtacccggttacttttacggtttacctttaacgaaaacgttaacgaaacccgagtaccccgggttaaggaaggttaaccgacccgtaagtaccggaaccggtaccggttacccggtttagttaacccgttttaaacgggtcggtaacgggtaacggtaacgggttaccgggtaaccggggttacccggggaaaccccgttaaacggttaaccgttacgttaccgtaacggtacggtaaccgggtaccgggtacggggttaccggggtaaacccggaacggggtaacccg

SEQ ID NO: 380615 - DNA, 594 bp, Homo sapiens
  misc_feature: GZ8MTXP01DG8K6.13.76.G10.1.454.CMB.2.raw
  modified_base (284)..(284): a, c, t, g, unknown or other
  modified_base (410)..(410): a, c, t, g, unknown or other
  modified_base (431)..(431): a, c, t, g, unknown or other
  modified_base (551)..(551): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgcccagtgtgaggtgcagcgtggtggagtcgtgggaggaggcttgatccagccgtgggggtccctgagactctcctgtgcagcctctgggttccaccgtcagtcaacacctacntgagctgggtcccgcgaggctccggaggggaagggggctggagtggcgttctttcttttatttatagtagtggtagtacatactcgcagaacctcgtggaggggcccagttcaaccatctcagtanacaatccaaagaacacgcttntttacttacaaatgaaacagaccgttagaaggagttacgatacgaacgtaccggtaccgtagttattaacgtgtggaacgagaggacgttcgggacccgtaacgttacgttacttaccgngtagtcggtacgtcggttacggggtaacccaaggggaaccccg

SEQ ID NO: 380616 - DNA, 627 bp, Homo sapiens
  misc_feature: GZ8MTXP01BW2V0.13.76.G10.1.454.CMB.2.raw
  modified_base (467)..(467): a, c, t, g, unknown or other
  modified_base (521)..(521): a, c, t, g, unknown or other
  modified_base (526)..(526): a, c, t, g, unknown or other
  modified_base (575)..(575): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtcgtggaggaggcttgatccagccgtgggggtccctgagactctcctgtgcagcctcgtggtcaccgtcagtcacacctacatgagcgtcgggtcccgccaggcctccggaaggggagggggctggagtcgcgttctttcttttattatagtagtggtataccatactccgcagaacctccggtggacggggcctattccacctactctaccagaagaacctaacttccaaagaacacgtctttagtttaccttaacaaaatgaaacncgtaccgtaggacgacgaccgagtaccgacgtaccggtccgttagtacttacgngtcgnggaagagacggttccggggacccctaagggttaaaccgtttcgaccgtnttacggcgggtacggttcgggacgggggtaaccccgaaacgggggtaacccc

SEQ ID NO: 380617 - DNA, 727 bp, Homo sapiens
  misc_feature: GZ8MTXP01AINFP.13.76.G10.1.454.CMB.2.raw
  modified_base (268)..(268): a, c, t, g, unknown or other
  modified_base (473)..(473): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttattttaaaaggtgcccagtgtgaggtgcagctggtggagtcgtggaggaggcttgactccaggccgtgggggtcctgacgactctcctgtgcacgcctcgtcggtcnccgtcagtcacactacatgagcgtcggccgccgacggccgtaccggaggggaagggggcgtgggagtcggtcgttcgtttactttttaagtttagttagttaggttaggtacgtaccactactccgacacgtaccgtcgggtggacggggtccgtattccgacctactctaccgagtaactactaaactccaaaaggactacgtnttttacgtttactaccgtaaaattcgggaaacctcggtaccctaggggaaacggacgaccccgtaaatccggaaccgtacgggggtaccctttagttaaccttaacggtggtaccggaaggtaacggcgggtaaccgggttacgggggaaccccccttaaagggttaaacccgtttaaccgttaccggtaaggttacgggtaacggggaacccggttggggaacccgggggaaccaaaacggggggttcccccg

SEQ ID NO: 380618 - DNA, 680 bp, Homo sapiens
  misc_feature: GZ8MTXP01DAOP2.13.76.G10.1.454.CMB.2.raw
  modified_base (562)..(562): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagtttggctgagcttgggttttccttgttgcttattttaaaaggtgcccagtgtgaggtgcagcgtggtggagtcgtggaggaggcttgatccaggccgtgggggtccctgagactctcctgtgcacgcctcgtcgggttcaccgtcagtcacacctacatgagcgtcgggtcccgcgacggccgtaccggaggggaaggggcgtggagtcggtcgtttctttacttttatttagttagtagtggtacgtaccatacgtccgacgacgtaaccgtccggtgggacggggtccgtacttccgacctactcctaccgagaacgaacctaaacttaccgaaaagtaaccacgttcgtttacttttactaacaaaagtcgaaactcgtaccgtagaacgtacgccgaagtcgaaccgacgggtccttagttacttcgtgngaacggtaagacggtacggttccggggaacccctaagggttaaacccgttcttaccggtaacgtaggtcgggtaccgggtcggggttacgggggaaccccgaaacgggggtaaccccg

SEQ ID NO: 380619 - DNA, 773 bp, Homo sapiens
  misc_feature: GZ8MTXP01CBTRP.13.76.G10.1.454.CMB.2.raw
  modified_base (250)..(250): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctgggtggagtcgtggaggaggcttgatccagccgtgggggtccctgagactctctgtgcngcctcgtggtccaccgtcagtcacacctacatgacgcgtcgggtcccgccgaggccgtaccggaggggtaagggggcgtagggagtcggtccgtttccttttacgtttttaagttttagttaaggttaaggttgggttaacgtaaccccgtaacgttacctcccggtaccaaccggtaacccgttccccgggttggggacgggggtcccgtacgttcccaacccgtacttcctacccgaagtaacgaacctaaacttaccccgaaaagaaccctaacggtcccgtttagttttaccttaaccaaagttacgaaaccgtaccgtacccggtagggaacggaccgaccggtaagtccggtaagttcccggggtacccgttagttaactttacgtggtggaaccgggaagttacggtacggttccgggggtacccctaacgggttaaccgtttaccgttaccggtaacttacggtccgggtaccggtcggggttaccgggggtaaccccggaacggggtaaccccg

SEQ ID NO: 380620 - DNA, 603 bp, Homo sapiens
  misc_feature: GZ8MTXP01DMOKW.13.76.G10.1.454.CMB.2.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtcgtccgtgtccccaggacagacagccagcatcacctgctctaggaaataatggacagaataaatatacttctgtatcagcagagtacagccacgtccctgtgctggtcatctatacaagatacgaccgaacgccggcccgtcgacgggacgtcccccgtaggacgcgtacttctccgtcgtccgtaccctaaccgtacgtcgggaaaaaaaaaaccgtcgacgaccctacctacctacgaccactaccgaacggaccgggacccgacggacgtagtaggagtagaggagtacgtaacgttaacgttacgtgtacgtacggacggtacggacgacgacgacgcgaacgtcgccgtcgttacgtcgtcgttacggacgttacgggtaaccgtaacggtaaccgtaccgtacgttacgtaacgaacgaacccg

SEQ ID NO: 380621 - DNA, 629 bp, Homo sapiens
  misc_feature: GZ8MTXP01APF2K.13.76.G10.1.454.CMB.2.raw
  modified_base (495)..(495): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtcgggtcccgccgaggccgtcccggaagggggaacgggggcgtgggagtggtccgttctttctttttatttagtaggtagtggtacgtacctatactccgcacgaaccgtcccggtggacggggccgtacttccaccactcctaccaagacgaaacctaattaccgaaagtaaccacggtctttagtttaccttacaaatcggaaacncgccgtagagacgccgagtcgacgacggtccgtgttacttacgtgtgaacggagttaggcgttcggggacccctaacgttaaccgttcttaacgctagcgggacgtcggttaccggggccgaacgggaaccccg

SEQ ID NO: 380622 - DNA, 603 bp, Homo sapiens
  misc_feature: GZ8MTXP01ANV7I.13.76.G10.1.454.CMB.2.raw
  modified_base (237)..(237): a, c, t, g, unknown or other
tcagtcacgtactacacgaccggtgctcgatttagtcactcatacagggagcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctagaaataattgacagataaatntactctaggtatcagcagaagtcaggcccacgtcccctgtcgcgtggtcattactatacaagactcggaccaaggcccgtacccgtacgacggggtaccctccccgtaggacgtacggtactttccgtccgtcggaccctacccgtaaactccgtagggaacctcgacgccctactccgtacgacctagtacgaccggaccgggacccagggccttagtggactgggacgggtctaggtaacttagtacgtcgtacgagggtccggtagggactagccaggctacgttcggcccttgttacgtcgttccgttacgggaacgtcgggaacctaacgggcccaccggttactaacgttcgaaccccgg

SEQ ID NO: 380623 - DNA, 614 bp, Homo sapiens
  misc_feature: GZ8MTXP01BYEIR.13.76.G10.1.454.CMB.2.raw
  modified_base (375)..(375): a, c, t, g, unknown or other
  modified_base (574)..(574): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtcgtggaggaggcttgactccgacgtccggtcgggggtccctgacgactctcctgtgcagcctcgtcggttcaccgtcagtcacacctacatgagcgtcggtccgccgcggctcggagggagggcgtggagtgtcgttctttcttttattagtagtagtcggtatacataccncgacacgtcgtcggtgggacgggccgtactccactactccacaagacgactaataccaaagactctcttgttacctacaaatcgaaacgcgtaccgtagaacgtagtcccgagtcgaaccgtccggtccgttaagttacgttcgtgtcggagacgttacggtacgggtccgggaaccccgttaggttaaacccggtttnacggtaactggtacgggccgttcgggaacggggaacccgg

SEQ ID NO: 380624 - DNA, 588 bp, Homo sapiens
  misc_feature: GZ8MTXP01BQ3K4.13.76.G10.1.454.CMB.2.raw
  modified_base (236)..(236): a, c, t, g, unknown or other
  modified_base (531)..(531): a, c, t, g, unknown or other
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctcagtgcccgtgtccccaggacagacagccagcatcacctgctctagaaataatgcagataaatntactctggtatcagcagagtcaggccagtcccctgtcgctggtcatctaatcaagactgaccaagccggccctcgacgggtactccccgtggacgcgtacttcctcgtcggtcctacccgaaacgttccgtacggggaaaccttcgaaacgccctacgtcctacggaccctagtccgaacggtcccgggaacccagggccttagtagggatcggaacgggggtcttaggtaacctttaagttacgtgtaccggagggtcgtacggggacacggcaggccaacgttcgccccgttntacgtgttcgttacggacgtcgggaccaacggtccaccgttactaagttcgaacccg

SEQ ID NO: 380625 - DNA, 571 bp, Homo sapiens
  misc_feature: GZ8MTXP01DND5K.13.76.G10.1.454.CMB.2.raw
  modified_base (359)..(359): a, c, t, g, unknown or other
  modified_base (392)..(392): a, c, t, g, unknown or other
  modified_base (402)..(402): a, c, t, g, unknown or other
  modified_base (412)..(412): a, c, t, g, unknown or other
  modified_base (419)..(419): a, c, t, g, unknown or other
  modified_base (424)..(424): a, c, t, g, unknown or other
  modified_base (428)..(428): a, c, t, g, unknown or other
  modified_base (436)..(436): a, c, t, g, unknown or other
  modified_base (447)..(447): a, c, t, g, unknown or other
  modified_base (457)..(457): a, c, t, g, unknown or other
  modified_base (467)..(467): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatcagccgtgggggtcctgagactctcctgtgcagcctcgtgggttcaccgtcagtcacacctacatgagcgtcggtccgcaggctccgagggaggggcgtggagtgcgttctttcttttattatagtagtggtatacatactcncagacctcgtggacgggctatcacatcacaganacactacaanacacgtcttnttactanaaatnaacngctgagcnccgatcgaccncggtccgttnttaacttcgngtggaacgaagggttacggacggttcgggggacccctaacggttaccgtttcgacgtctaggtcgggacggtcggttacgggggaacccgaacggggaaccccg

SEQ ID NO: 380626 - DNA, 535 bp, Homo sapiens
  misc_feature: GZ8MTXP01C7O0D.13.76.G10.1.454.CMB.2.raw
  modified_base (331)..(331): a, c, t, g, unknown or other
  modified_base (394)..(394): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataatggcagataaatatacttctggtatcagcagaagtcaaggccagtcccctgtgctggtcatctatcaagatgccaagcggccctcgagggactccccctgagcgattcnctggcctccaaactcgtagggaactcacgtccactctcgaccatcacgcggaccccaggctanggataggacggctagaacttattacgtgtacgaggcggtagggacaggccaaggccaactcggcccgtcttagtgtcgtttacgggacttacgggggaaccctaagggtcctaaccgtcgttaacgtccgaacgaaccccg

SEQ ID NO: 380627 - DNA, 714 bp, Homo sapiens
  misc_feature: GZ8MTXP01A0KWO.13.76.G10.1.454.CMB.2.raw
  modified_base (172)..(172): a, c, t, g, unknown or other
  modified_base (492)..(492): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctnagtgtcccgtgtccccaggacagacagccagcatcacctgctcgtaggaaataattggacaagaataaatactacttctggtatcagcaagaagtcacggccacgtccccgtgtcgctggtctatctatacaagtatcgaccaacggcccggacccgtagacggggtacctccccccgtaggacgtccgtactttcccgtaccgttcgggtcccttacccgtaaaccgttccggtacgggtaacctcgaacgtccctacctaccgtacgaacccgtacgtccggaacgggaccccggggaccctagggtaccgttaaggngggtaacgttacgggaacggtcggttaacggtaacttagttaaccggtcggttacgaggggtcgggtacggggactacgggcctaacggcctaaccggtccggacccgttacgttacggttacggttacccggttaaccggggaaccggttaccggggaaaccctaacgggttcccgtaacccggttacgttaaccggtaacccgaacccggaacccccggg

SEQ ID NO: 380628 - DNA, 571 bp, Homo sapiens
  misc_feature: GZ8MTXP01DP0OP.13.76.G10.1.454.CMB.2.raw
  modified_base (365)..(365): a, c, t, g, unknown or other
  modified_base (485)..(485): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggtcaccgtcagtcacacctacatgagcgtcgggtccgccaggcctaccgaggggaagggggctggagtgtcgtcttcttttattatagtagtgtagtaccatactccgnagaacctcgtggagggccattcaccatcaccagacgacaacttacaaagaacacgtcttgtttacctacaaatcgaaactagccgtgaagacgccgatcgacacggccgtagtattacgngtgcgaagagtagcggggacccaaggttaacgtttacacgctaagtcggaacggtcgttacgggggaacccaacggggtaaccccg

SEQ ID NO: 380629 - DNA, 714 bp, Homo sapiens
  misc_feature: GZ8MTXP01BBNBG.13.76.G10.1.454.CMB.2.raw
  modified_base (553)..(553): a, c, t, g, unknown or other
  modified_base (615)..(615): a, c, t, g, unknown or other
tcagtcacgtactacacgaccggtgctcgatttagtcactcatacaggggtctgggagaggagcccagcactgggattccgaggtgtttccattcggtgatcagcactgaacacaggggactcaccatggagttttggctgagcttgggttttccttgttgctattttaaaaggtgcccagtgtgaggtgcagctggtggagtcgtgggaggaggcttgatccgagccgtgggggtccctgagactctcctgtgcagcctcgtggtcaccgtcagtcacacctacagtgagcgtcgggtccgccgacggccgtaccggagggggaacggggcgtagggagtcggtccgtttctttacgtttttatttagttaggttaggttaggttaacgtactactaccgtcccgacgaacgtaccgtccgggtagggaccgggggtccctaacgttccaacccgtacttacccgacccgaaggaaaccgtaaacctaaacttacccgaaaagtaaccctaccggttctttacgtttaccttaaacaaaagttacgaaaccncggggtacccgttaggaacgaccgaccgagtacggaccgtaccggtccgtagtactttacgnggtaacgacggaggacggacggtaccggggaaccccaagggttaccgttacgaacgtcgtaaggtcgggacgttcgggcggggttaacccgaaacgggg

SEQ ID NO: 380630 - DNA, 713 bp, Homo sapiens
  misc_feature: GZ8MTXP01AD5IB.13.76.G10.1.454.CMB.2.raw
  modified_base (259)..(259): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctctggnttctactttagtagctatggatgagcgtgggtccgcaggcctccggaggggaaggggctgggacggtggggtcggacccaaactaagtaaaacgcgtaaaggttaggaaaggttacgaaaggtaaaatacgtaagtggtaacggtacgttcgtagggtagggaacggggtacccgtattccaacctactccctacccgaaggacgaaccaaccgaccaaaacggtacttacgacttagtactcgtaagaacctaaaaggtcgaaacgcgacccgtaggaaacggccgaccgggttaagggacccgtacggggtctttacggtacttaacggtttccgttgggttaccgacggggtaagggtacgggttacggggtttaggggggggaccggtaaaggggttataaccggggtacgtaagggggttcggtaacccgttaacgttttaaacccggg

SEQ ID NO: 380631 - DNA, 554 bp, Homo sapiens
  misc_feature: GZ8MTXP01BA8GH.13.76.G10.1.454.CMB.2.raw
  modified_base (423)..(423): a, c, t, g, unknown or other
  modified_base (432)..(432): a, c, t, g, unknown or other
  modified_base (509)..(509): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtgggtccgcaggctccgaggggaggggctggagtgcgtcttcttttattatagtagtggtagtaccatactcgcagaactccgtgacggggccattcacatctccagagacaatccaaagacacgtcttgtttctanaaatgaacngccgtgagcgccgatcgacgcggccttgtattacctgtgaacgagaggacgttcggggacccaacggttaacgttcncggctagtcgggaacgtcgttagggggaacccaaggggaaccccg

SEQ ID NO: 380632 - DNA, 555 bp, Homo sapiens
  misc_feature: GZ8MTXP01D0A2D.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcacgtcagtcacacctacatgagctgggtccgccaggctccgaggggaaggggctggagtgcgtcttcttttattatagtagtggtagtacatacctccgacagctccgtgacggggcattcacatctcagacgacaattccaaagacacgccttagttactacaaatgaaacagcctagagacgccgatacgacacgggtccgttgtaattcgtggtcgcggtaagagacgtcgggacccgaccgttaacggtaactacgcgtactaggacggtcggttcgggaaccgggg

SEQ ID NO: 380633 - DNA, 625 bp, Homo sapiens
  misc_feature: GZ8MTXP01ATEQC.13.76.G10.1.454.CMB.2.raw
  modified_base (416)..(416): a, c, t, g, unknown or other
  modified_base (454)..(454): a, c, t, g, unknown or other
  modified_base (519)..(519): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctgggtggagtctggaggaggcttgatccagccgtggggggtccctgagactctcctgtgcagcctctggggttcaccgtcagtcacacctacatgagctgggtcccgcaggcctccgaggggagggggctgggagtgccgttcttctttttaatttataggtacgtggtagtacccatactccgcagaaccttccggtggacgggggcccattccaccatctccagngaactaatcccaagaaacacgtcttgtttacccttaanaaagtacgaaacacgacgtaggaagacgaccgatcggaccgaccggtacgttgttattacgtggnggaacggaaggaggacggttccggggaaccctaacgggttaaccgttacgacgtaacgttaggtcgggtaccggtcgggacgggggtaaccgaacggggtaacccg

SEQ ID NO: 380634 - DNA, 668 bp, Homo sapiens
  misc_feature: GZ8MTXP01DUUEG.13.76.G10.1.454.CMB.2.raw
  modified_base (616)..(616): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtctggaggaggcttgatccagccgtgggggtccctgagactctcctgtgcagcctctgggtcaccgtcagtcacacctacatgagcgtcgggtcccgccgacggctaccgaggggaaggggcgtggagtgtcgttcttcttttattatagtagtgtagtacatactcgcagtactcgtggacgggccgacttccaacctatcctaccgaagacgaaactaacttacccaaagaaccgtacgtactttagttttacctaacaaaagttacgaaacctacgacccgttaggaaacggtacggaccccgaagttcggaacccgaccggggtacccgtttgtttaacgttacgttggtcggaacggtaaaggacggtacgggttcgggaaccccgtaacgttaaaaccggttcttaaccgngttacgcgggtaccggtcgggttacggggtaacccgaaaggggtaacccccg

SEQ ID NO: 380635 - DNA, 571 bp, Homo sapiens
  misc_feature: GZ8MTXP01DKW7C.13.76.G10.1.454.CMB.2.raw
  modified_base (430)..(430): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtggtccgcaggctccgaggggaggggcgtggagtgcgtctttcttttatttatagtagtgtagtaccatactcgcagacctcgtggacgggccgtatcaccatctccagacgacaacttccaaagaacacgtcttgtttctanaaatgaacagcctgagcgaccgatcgaccacgggtcccgttgtaacttctggtgaacggagaggagttcgggggacccaacggttaacgttcgacgcttagtcgggacgtcggttacgggggaaccgaaggggtaaccccg

SEQ ID NO: 380636 - DNA, 655 bp, Homo sapiens
  misc_feature: GZ8MTXP01CNVD4.13.76.G10.1.454.CMB.2.raw
  modified_base (293)..(293): a, c, t, g, unknown or other
  modified_base (331)..(331): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcgtggtttcctgtgctatttaaagtgccagtgtgaggtgcagctggtggagtcgtggaggaggcttgatccaggccgtggggggtccctgagacttctcctgtagcagcctcgtgggttcaccgtcagtcacacctacatgagcgtgggtcccnccgaggcctccgagggtaggggctggagtgcgtctttntttattatagtagtggtagtaccatactccgcagtactcccgggtggcggggcctatttcgacctatcacccgaagacgtacaaacttcccgaaagaacccgacgttaccgttttcgttaacctaacgaaacgtaacgtaacgtacgacggtaggaacggacggaccgtacgtacgaccgtacggtacgtacgttacgttacgtggtcggtaacggacggacggtacggttaccgggtaccggtaaccgttaaccgttaccgttacgtaacgtacggtaacggtacggtacggttaccgggtaaccgggaaccgggtaacccgg

SEQ ID NO: 380637 - DNA, 802 bp, Homo sapiens
  misc_feature: GZ8MTXP01BQUUT.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtcgtgggaggaggcttgatccagccgtgggggtccctgagactctcctgtgcacgtcctcgtcgggttcaccgtcagtcacacctacagtgacgtcgtcgggtcccgccgacgggtccgtaccggaaggggggaacgggggtccgtagggggtcggtttcggtccggtttacgtttaccgttttttaattttaagttaagggttaggttacgggttaacggttaacaacgttacccgtacccggaacctaacggtaacccgtcccgggtacggggtacgggggaccccgtacgtttacccacccgttaactcccttacccgaaggaacgaaaccttaaaacctttacccgaaaaacggtaacccgtaaccggttaccgttacggttttaaccttaacgtaaaactcgggtaaaccacggtaccgtacggaacggtaccgaccccggagtacccggaacggtacccgggtccgttaggttaaacttccggtaaggttccggaggaaaccggaggtacgggttacccgggggacccttaaacggttaaccgttaacgtaacgcgttaacgggcggttacggtccggttaacgggggaacccg

SEQ ID NO: 380638 - DNA, 613 bp, Homo sapiens
  misc_feature: GZ8MTXP01EL3BK.13.76.G10.1.454.CMB.2.raw
  modified_base (382)..(382): a, c, t, g, unknown or other
  modified_base (463)..(463): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtcgggtcccgccgaggcctccggagggggaacgggggctagggagtcgtcgttctttactttttatttagtagttagtggtagtaccatactccgnagaactccggtggacggggccattccacctatctcagagactaatccaaagaactacgtctttgtttctacaaatgaaacngaccgtgaggacgccgaatcgaaccgcggtcccgttagtaactttacgtggtgcggaagacggacggttcgggggacccctaaggttaaccgtttacgttacgtcgtaggcgggtacgttcgggacgggggaaccaacgggggtaacccg

SEQ ID NO: 380639 - DNA, 682 bp, Homo sapiens
  misc_feature: GZ8MTXP01A9ZD7.13.76.G10.1.454.CMB.2.raw
  modified_base (272)..(272): a, c, t, g, unknown or other
  modified_base (554)..(554): a, c, t, g, unknown or other
  modified_base (574)..(574): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttaattttaaaaggtgcccagtgtgaggtgcagctggtggagtcgtggaggaggcttgatccgagccgtgggggtccctgacgactctcctgtgcagcctcgtggtcacgtcngtcacacctacatgagcgtcgggtcccgccgaggccgtccggaagggggaaggggcgtgggagtcgtcgttctttactttttatttagtaggtagtggtacgtaccattactcgcacgtaaccgtccggtgggacggggtcccgtattcccgacctactcctacccagtaacgaaactaacgtaccaaacgaactaccggtccttttagttaccttaacaaagtacgaaactacggcccgtaggaacgccgacccgatacggaccgtaccggtaccggtttntacgtttaccgtgtaccggngaaacgggttaggaccggttaccgggggaacccctaacgttaacccggtttcacggtcgttagtaacgggtcgttccgggaccggggtaacccgaaacggggtccccg

SEQ ID NO: 380640 - DNA, 667 bp, Homo sapiens
  misc_feature: GZ8MTXP01BTV57.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctatttaaaggtgccagtgtgaggtgcagctggtggagtcgtggaggaggcttgatccagccgtgggggtccctgagactctcctgtgcagcctcgtgggtccaccgtcacgtcacacctacatgagcgtcgggtcccgccgaggcctccggaggggaggggcgtgggagtcgcgtttctttctttttatttagtagtagtaggtagtacctatactccgacacgtaacctccggtgggacggggcctagttccacctactcctaccagacgaacaattaccaaagaactacgtccttagtttctaacaaatcgaaacacgccgtaggacgtacgaccgagtccggaaccgtaccgggtccgttagttaacgttcgtggtcggaacggtaaggacggtacgggttccgggggaacccctaaacgggttaaaccgtttaccgttacggtccgttagggaacgggtaccgggtcgggttaccggggggtaacccgaaacgggggtaaccccg

SEQ ID NO: 380641 - DNA, 638 bp, Homo sapiens
  misc_feature: GZ8MTXP01A61BK.13.76.G10.1.454.CMB.2.raw
  modified_base (424)..(424): a, c, t, g, unknown or other
  modified_base (461)..(461): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtgggttcaccgtcagtcacacctacatgacgcgtcgggtcccgccgacggcgtccggaggggaaggggcgtggagtgtcgtctttcttttattatagttagtggtacgtactatacgcgacacgtaaccgtcggtggacggggtccgattccaccactcctaccagganaactaactacaaagaactacgtcttagtttacctaanaaacttgaacctacgaccgtaggaacgacgacccgtaagccgaacgtaccgggtcccggttataccgttacgcgggtgaaggagacggtacggttccggggtaaccccaacggttaaaccgttccgaaccgtgtaggcggtaacgtccgggttacgggtaaccaacggggaaccccg

SEQ ID NO: 380642 - DNA, 663 bp, Homo sapiens
  misc_feature: GZ8MTXP01AYLAT.13.76.G10.1.454.CMB.2.raw
  modified_base (498)..(498): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccgagccgtgggggtccctgagactctctgtgcagcctcgtgggttccacgtcagtcacacctacatgagtcgtcgggtcccgccgacggcgtccggaagggggacgggggcgtgggacgtcgtcgttcttactttttattagtacgtagtggtaatacgataccgtccgacaacgtcctccggtagggacggggtcctaattccgacctactcctaccgaaggaacgtaacctaaacttaccgaaaacgaaccgtaccgtctttacgtttaccctaanaaacttcggaactacggctaggacgacgccgagtacgaccgtacggtcgtagtaacttctaaggtgacggaagacggtacggtaccgggggacccaaccggttaaacggtaacctacggtcgtaacggtacgggttaccggttcgggttaacgggggaacccggg

SEQ ID NO: 380643 - DNA, 623 bp, Homo sapiens
  misc_feature: GZ8MTXP01EAIH9.13.76.G10.1.454.CMB.2.raw
  modified_base (246)..(246): a, c, t, g, unknown or other
  modified_base (258)..(258): a, c, t, g, unknown or other
  modified_base (263)..(263): a, c, t, g, unknown or other
  modified_base (274)..(274): a, c, t, g, unknown or other
  modified_base (468)..(468): a, c, t, g, unknown or other
  modified_base (514)..(514): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctggttttccttgttgctatttaaaggtgccagtgtgaggtgcagcgtggtggagtcgtggaggaggcttgatccagccgtgggggtccctgagactctctgtgcngcctctgggtcncgtcngtcacacctantgacgcgtcgggtccgccgaggcgtccggaggggaggggcgtggagtcgtcgttctttcttttatttagtagtagtggtagtaccatactccgcacgaaccgtccggtggacggggccgtacttccacctactctaccaagacaactaactaccgaaagtaacacgttactttgttacctacaaaatcgaaacncgtcgtaggagacgcgagtcgacgtacggtccgttagtacttacgnggtgaacgaggacgtacggttccggggaaccctaaggttaaaccgtttccgacgcgtttacggcgggtaacccggtcggaccgggggaaccgaaaccggggtaaccccg

SEQ ID NO: 380644 - DNA, 734 bp, Homo sapiens
  misc_feature: GZ8MTXP01EVTO0.13.76.G10.1.454.CMB.2.raw
  modified_base (339)..(339): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtcggggggtccctgagactctcctgtgcagcctcgtgggtcaccgtcagtcacacctacatgagcgtcgggtccgccgaggcctccggaggggaaggggctgggagtgcgtctttntttttattatagtagtggtagtaccatactccgacacgtaaccgtccggtgggacggggtccctagtttcccaaccctacttcctacccaaaggacgtaaacctaaacgttacccgaaaagtaaacccgtaccggtacctttaggttttaccttaactaaaacgtcgtaaaaccgtacgtacccgttaagggaacgaaccggtcccgaagttacgaaacccgtaaccggggtcccgtttaggttaacgtttaccgttggttcgggaacggaagggttaacggtaccgggttacggggggaacccctaaacgggttaaaccggtttaccgttaccggtcgttagtcggggtacggtccgggttacgggggtaacccggaaacgggggtaaccccgg

SEQ ID NO: 380645 - DNA, 666 bp, Homo sapiens
  misc_feature: GZ8MTXP01AZ1WS.13.76.G10.1.454.CMB.2.raw
  modified_base (449)..(449): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagcacacctacatgagcgtcgggtccgccgaggctccgaggggaggggctgggagtgcgtcttcttttattatagtagttggtagtacatactccgacacgcgtccggtggacggggccgtattcaccatcctccaggacgactaacttaccaaagaccacgtccttagtttacctanaaattcggaaacaacggtccctaggaacggacgccccggaattaccgggactacccggggtcccggttaggttaacttacccgtggtcggaccgggaaaggttagggtaaccggtacccggggggttacccccttaaacgggttaacccggtttaacccgtacggtccgttaaaggttccggggaacccgggttaacggttcgggggggaaaccccg

SEQ ID NO: 380646 - DNA, 668 bp, Homo sapiens
  misc_feature: GZ8MTXP01B41K6.13.76.G10.1.454.CMB.2.raw
  modified_base (297)..(297): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagcccaccctcagtcgtccgtcgtccccaggacagacagccagcatcacctgctagtagaaataagtggacaagaataaatatacttctgtatcagcagagtcaggccagtcccctgtcgctggtcatctatcaagntcgacaaggccgcctcgacgggactcccccgtagacgtcgtacttcgtactcggcctaccaacgtcgtacgggacctcgacgtccactctacgaccagtaccgacggtacccgggacccgaggaccgtagtacgggtaatacgggaacggtccgtacggtaaacgtttacgtttaacggttcggtaaccggtacggggtaccgggttaacgggggaacctacgggtaccggaaacgtccggtaaacccgttcccgggaccccgttacgttacggttccggttacccggtttaacgggaaccggttaccggggaacccgtacgggttaaccctaccccgggtaccgttaacgtcccgaaccggtaacccccg

SEQ ID NO: 380647 - DNA, 635 bp, Homo sapiens
  misc_feature: GZ8MTXP01E3B2S.13.76.G10.1.454.CMB.2.raw
  modified_base (477)..(477): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagctctcctgtgcagcctcgtggtcaccgtcagtcacactacatgagcgtggtccgccgaggctccggaaggggacggggctgggagtcgtcgttctttacttttattagtagtagtgtagtaccatacgtccgcagaaccgtcggtgggacggggccgtacttccacctactcctaccgagtaacaactaacttacccaaaagtacccacgtctttacgtttacctaaacaaattacgaaacncgtccgtaggacgtacgacccgagtccgggaccacgggtccttagttaacttacgtggtcgaacggtaaggacggcgggttaccgggacccctaaaggttaaccgttcacgtcgtagtccgggacgtccggacgggggaacccaacggggtaaccccg

SEQ ID NO: 380648 - DNA, 712 bp, Homo sapiens
  misc_feature: GZ8MTXP01D5GES.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtggtcaccgtcagtcacacctacatgagcgtgggtcccgccgacggcctaccggagggggaagggggcgtgggtagtggtcgtttcgtttacttttttaatttagtaggttagttggtagtactatacctcccgactagccgtcggtaggacggggccgtacttccaccatcctaccaagacgaactaacttacccgaaaagaaccgacgtctttacgtttaccttaacaaaagttcggaaacctaacggtcccgttaaggaacggtaccggaacccgtaagttccggaaaccgtacccgggtccgttacgttaatttaacccggtggtacgggaccggaaaggttacggaacgggtccgggggaacccccttaaaggggttaaaacccgtttaacctaacggtcgttacggtacggggttaacccggttcgggttaacggggaaacccccgg

SEQ ID NO: 380649 - DNA, 700 bp, Homo sapiens
  misc_feature: GZ8MTXP01ECTO8.13.76.G10.1.454.CMB.2.raw
  modified_base (492)..(492): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagtttggctgagctgggttttccttgttgcttaattttaaaaggtgcccagtgtgaggtgcagcgtggtggagtcgtggaggaggcttgatccaggccgtgggggtccctgagactctcctgtgcagcctcgtgggttcaccgtcagtcacacctacatgagcgtcgggtcccgccgaggccgtccggaggggaagggggctgggagtcgtcgttctttacttttattatagttaggtggtagtaccatactccgacacgtaccgttccggtggacggggtccctattacccaacctactcctacccaaggaactaaacctaaacttacccaaaaggtaacctacgtcttttacgtttacctaanaaaacgtcgaaactacgtccgtaaggacggaaccgaccgaagtaccgaccgtacggtaccgttagttaaccgtttacgtggtggaacggagttacggtacgggttaccgggggaaccccttaacggttaaaccgtttaccgttaccggtaacgtacggtcgggtacgggtaccggttacgggggaacccgttaacggggtaacccccg

SEQ ID NO: 380650 - DNA, 663 bp, Homo sapiens
  misc_feature: GZ8MTXP01EJI6W.13.76.G10.1.454.CMB.2.raw
  modified_base (571)..(571): a, c, t, g, unknown or other
  modified_base (619)..(619): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtgggtcaccgtcagtcacacctacatgagcgtcgggtccgccgaggccgtaccggaggggaagggggcgtgggagtcgtcgttctttactttttaatttagttagttagtaggtagtacctactactccgcacgaaccgtccggtgggacggggtccgtattccacctactctacccaagaacgtaactaacttaccgaaacgtaactaaccgttctttacgttttaccttaacgaaaacgtcgaaaaccgtacgtacccggttaggaacggtacgacccgagtcggaaccgacggtccgttagtaacttacgtgnggaacgagaggtacgttcggggacccctaacggttaacgttcaaccgnttagtcgggacgttccggacggggcccgttaaacgggaaccccg

SEQ ID NO: 380651 - DNA, 611 bp, Homo sapiens
  misc_feature: GZ8MTXP01A8I62.13.76.G10.1.454.CMB.2.raw
  modified_base (461)..(461): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagtcctctgggttcaccgtcacgtcacacctacatgagcgtcggtcccgccacggcgtccggaggggaagggggctgggagtgtcgttctttcttttagttatagtagtggtatacatactcgcagtactccgtggacggggcctacgttcaccgactctaccagacgacaacttaccaaagacacgtctttagttcctacaaagtcgaaancgccgtagaacggtagacccgaatccgacgtacggaccgttgttacgttactggtcgcggtaagaggtacgttcggggaaccctaacggttaaacgttcgacgtcgtaagtcgggacgtcggttcggggaacccgttaacgggaaccccg

SEQ ID NO: 380652 - DNA, 795 bp, Homo sapiens
  misc_feature: GZ8MTXP01B1D8K.13.76.G10.1.454.CMB.2.raw
  modified_base (303)..(303): a, c, t, g, unknown or other
  modified_base (321)..(321): a, c, t, g, unknown or other
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgcccagtgtgaggtgcgagcgtggtggagtcgtgggaggaggtcttgactccgacggccggttcgggggtccctgacgtacctctccgtgtcgcacgtcctcgtcggttccaccgtcactcaccacctacngtgacgcgtcgggtcccnccgaggccgtaccggagggggacggggcgtagggtaggtcggtccgtttctttacgtttttaagtttagttagtaggttaggttaaccgtactacgttaccgtcccgacgtaaacgtaccgttccgggtacgggaccggggtaccctacgttacccaacctacgttccctaccgaagtaactaacctaaacgttacccgaaaagtaacccgtaccggttcctttacgttttaacctaaaccgtaaaattacggaaacctacgggtcccgttaaggaacggtaccgaccggtaacgtaccggaaccggtaaccggggtccgtttaaggttacgtttaccggtgggtaaccggacggttaaagggtaggttaccgggttccgggggaaccccttaaacgggttaaccgttaaccgtaacggtacgttaacggacggggtccggttacggggtaaccggggaaccggaaaccccggg

SEQ ID NO: 380653 - DNA, 641 bp, Homo sapiens
  misc_feature: GZ8MTXP01BXYYM.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtcgggtcccgccgaggcctccgaggggaggggcgtggagtgcgtcttcttttattatagtagtgtagtaccatactccgcagaacctccggtggacggggcccgtattccacctactcctacccaagacgaactaacgttccaaagaacaccggtcttgttttctaacaaatcgaaactcgaccgttgaaggacgccgaatcggaaccgacgggtcccgttagttacgtttacgtgggtggaacggaaggttacggacggttcgggggaaccccctaaggttaaaccgtttccttaccggcttaaggtcgggtaacccgtgggttacgggggtaacccaacgggggtaaccccg

SEQ ID NO: 380654 - DNA, 839 bp, Homo sapiens
  misc_feature: GZ8MTXP01A38AQ.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctatttaaaaggtgcccagtgtgaggtgcagctggtggagtcgtggaggaggcttgatccgaggccgtgggggtccctgagtactctcctgtgcacgtcctcgtcgggttccaccggtcacgtcaacacctacatcggagtcggtcgggtccccgccgacgggccgtaccgggaagggggaacgggggtcgtagggtacggtcgtcggtttcttttacgtttttaatttaagtaggttaaggttaggttaactacgtaacgttacccgtcccgaactaacggtaacccgttccgggtaggggtacgggggtcccgtaacttacccaacctacttcccgtaaccgaagggaaacgaaaccttaaacttaacccgaaaaacgtaacccgtaacgttccgtttacgtttaacccgtaaataaaacgttaccgggaaaaacctcggtaccccgttaaggggaaacggtaccgtacccggaaggtacccgtaaaccgggtaaccggggtcccgtttagttaaacccgtttcggtggttacggggttaagggaaccggttaaagggtacgggttacccggggggaaccccttaaacgggttaaaccccggtttaacgtaccgggttaacgttaacgggtaccgggggttaacccggtccgggttaaccggggggaaaacccccggg

SEQ ID NO: 380655 - DNA, 627 bp, Homo sapiens
  misc_feature: GZ8MTXP01B6WN8.13.76.G10.1.454.CMB.2.raw
  modified_base (578)..(578): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtcctgagactctcctgtgcacgcctcgtcgggttcaccgtcagtcacacctacatgagcgtcgggtccgcgaggcctcggaggggaggggcgtggagtcgtcgttctttcttttatttagtagtagtggtataccatactccgcacgaaccgtcggtggacggggtccagttccaccactcctaccgagaacgaactaacttaccgaaagtaacctacggtctttagttttactaacaaattacgaaactacgccgtaggacgaccgccgtaagtccggacgaccgggtcgttagttatacgtggtggaacggagagggacggttcgggaaccctacggttaacgttcncgtctaggtcggaacggtccggttacggggaacccgaagggtaaccccg

SEQ ID NO: 380656 - DNA, 630 bp, Homo sapiens
  misc_feature: GZ8MTXP01BWLLI.13.76.G10.1.454.CMB.2.raw
  modified_base (372)..(372): a, c, t, g, unknown or other
  modified_base (515)..(515): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagcgtggtggagtcgtggaggaggcttgatccgagccgtgggggtccctgagactctcctgtgcagcctcgtggtcaccgtcagtcacacctacatgagcgtcgggtcccgcgaggccgtaccggaggggacgggggctgggagtcgtcgttctttcttttattagtagtagtggtagtacatacncgcacgaactcgtggacgggcatccactactcaccagacaactaactccaaagaactacgtctttagtttactacaaaatcgaaacacggtccgtaggaacgacgtcccgaatccggaccgacggtccgttattaacttacgngtcggaacggagacgggtacggttcccggggacccctaaggttaacccgtttcgaccggtaacgtaaggtccgggaaccgttcgggacgggggaacccgaaacggggtaaccccg

SEQ ID NO: 380657 - DNA, 648 bp, Homo sapiens
  misc_feature: GZ8MTXP01D6FMT.13.76.G10.1.454.CMB.2.raw
  modified_base (298)..(298): a, c, t, g, unknown or other
  modified_base (435)..(435): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagcccaccctcagtcgtccgtcgtccccaggacagacagccagcatcactgctctagaaataatgacaagataaatatacttcctagtatcagacagaagtcaggccacgtcccctgtcgctggtcatctatacaagngtcgaccgaagccggaccctgacgggtactcccccgtggacgtcgtacttccgtcgtcggtcctacctaaacgtcgtacgggactcgacgtccctactctacgacgactcgaacggcccggacccgaggtcctaggngagtacggacgtacggtacgtaacgttacgttacgtacggttcgaacggggtcggttacggggaactacgaccgtacggaccgtaaccgtcgccccgtagtttacgtaccgggtttaccgttaccggggttaaccttacgggggtaaaccccgtacgggtaaccgtaaccccggtaccgttaaccgggtaacccgaaccggtaaccccccggg

SEQ ID NO: 380658 - DNA, 819 bp, Homo sapiens
  misc_feature: GZ8MTXP01AN88A.13.76.G10.1.454.CMB.2.raw
  modified_base (297)..(297): a, c, t, g, unknown or other
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggaggaggcttgatccagccgtgggggtcctgagactctcctgtgcagtcctcgtggtcacgtcagtcacactacagtgacgcgtcgggtccnccgaggccgtaccggaagggggaacgggggcgtagggaggttcgtccgtttactttacgtttttaagtttataggttaggttcgggttaactaacctacttacccgtccgacgtaaacgggtacccgttccgggtagggaaccgggggtaccgtactttccgaaccctacgtaccctacccgaagtaaacgaacctaaacgttaccccaaaaggtaacccgtacgttcgtttacgttttaccttaaacgaaaatacggtaaaccctacgggggtacccttaaggggaacggaaaccggcccggtaaacgttaccgggaccccgtaacccgggggttaccgtttaacggtttaactttaacccggtggggttaaccggacgggttaaggtacgggttaaaccgggtccccggggggtaaccccttaaacgggttaaccgtttacccgtaaacggtcgttaaacgggttccggggtaacccgtttaccgggggtaaccgggggaaccccggtaaaacccggggg

SEQ ID NO: 380659 - DNA, 767 bp, Homo sapiens
  misc_feature: GZ8MTXP01B1TWZ.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccaggccgtgggggtccctgagactctcctgtgcagcctcgtgggtcaccgtcagtcacacctacatgagcgtcgggtcccgccgaggcctccggaaggggaaggggcgtgggagtcggtcgttctttactttttaatttagtaggttaggttaggtaacgtaaccattaccgtcccgactacggtaaacccgttccgggtgggacggggtcccgtaatttacccgaccctattccctacccgaaaggacgtaacctaaacttcccgaaaagtaacccgtaacccggttcttttacggttttaccttaacaaaaagtttcggaaaacctcgggtcccttaaggggaaacggtacggaccccgtaaagtccggaaccgtacccggggtaccgtttaagttaactttaaccggtgggtacggccggtaaaggacgggtaacggttccgggggaaaccccctaaaggggttaaacccgttaccgttaacggtctaacgggtcgggtacccggttacggttaccggggggaaccccgaaacgggggtaacccccg

SEQ ID NO: 380660 - DNA, 585 bp, Homo sapiens
  misc_feature: GZ8MTXP01EJNY6.13.76.G10.1.454.CMB.2.raw
tcagtcacgtactacacgaccggtgctcgatttagtcactcatacaggggggagaggagcccagcactgggattccgaggtatttccattcggtgatcagcactgaacacagaggactcaccatggagttttggctgagctgggttttccttattactattttaaaaggtgtccagtgtgaggtgcagttggtggagtctgggaggaggcttgggtccaggccggggggtccctgagactctcatgtgcggcctcgtgggctcaccgtcaacaccaactacatgagctgggtccgcaggctccgagggaagaggccggagtgggtctcagtttattatgtcgacggtgccagatctacgcagactccggtggaacgggggcccgttcacctatcctaccgagacgacaaacttaccaaagaacacggtgtatcttacaaatgaacactgagagtcgacggggacgacggaccgtcgtacttacgtgtgtacgaaagatgcagaaggacgggccccgtaaagcggggcgtcgggttgggttcggttcgttcgttgtcgtggcgttcgggccgaagggtaaccccgg

SEQ ID NO: 380661 - DNA, 612 bp, Homo sapiens
  misc_feature: GZ8MTXP01EFKQ1.13.76.G10.1.454.CMB.2.raw
  modified_base (295)..(295): a, c, t, g, unknown or other
  modified_base (375)..(375): a, c, t, g, unknown or other
  modified_base (492)..(492): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtgggtcaccgtcagtcacacctacatgagcgtcgggtccnccgaggctccggaaggggaaggggctgggagtggtcgttctttacttttatttatagttagtaggtagtacatactccgnacgaactccgtggacgggccgattcaaccatctaccagacactaatccaaagacacgtctttagttcctagaaatgaacagccgtaggagacgccgaatcggaccacgggtccgttnttattaccgtgtacggaagaagaggtaacggttcgggggacccctaaaggttaacccgtttacacggtccttaggaacgggtaccgtcgggttacgggggaaccccaaagggggtccccg

SEQ ID NO: 380662 - DNA, 830 bp, Homo sapiens
  misc_feature: GZ8MTXP01EOVV2.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccaggccgtgggggtccctgagactctctgtgcagcctcgtgggtcaccgtcagtcacacctacatgagcgtcgggtcccgccgaggcctccggaagggggaacgggggtctagggacgttcggtccgtttccgtttacttttttaagtttaagttaaggttaaggttagggggttaacttaaccccgtaacttaaccgtaccccggtacgaacggtaaaccccgttcccgggttggggtaaacccgggggggtaccccctaaagttttaccccgaaacccctacgttaccccgtttaacccgaaacggggaaacgtaaaccctaaaacgtttaccccgaaaaaacggtaaacccgtaaacccggtttccgttttaccggtttttaacctttaacgaaaaacgtttcggaaaaccgtacggtacccggttaaggaaaccggaacggtccccgaaagtccggaaccgtaccgggtaccgttagttaacgttacgtggtgaaccggaaggttaaggacggttcccgggggaaccctaaacgggttaaacgttaccgacgtgttaacggtcgggtaaccggtcgggttaccggggtaaccgaaaccggggtaacccg

SEQ ID NO: 380663 - DNA, 613 bp, Homo sapiens
  misc_feature: GZ8MTXP01ENHV2.13.76.G10.1.454.CMB.2.raw
  modified_base (370)..(370): a, c, t, g, unknown or other
  modified_base (417)..(417): a, c, t, g, unknown or other
  modified_base (450)..(450): a, c, t, g, unknown or other
  modified_base (460)..(460): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagcgtggtggagtcgtggaggaggcttgatccgagccgtgggggtccctgagtctctctgtgcagcctcgtggtcacgtcagtcacacctacagtgagtcgtcggtcccgccgaggccgtaccggaggggagggggctggagtgtcgttctttattttattagtagtagtggtactaccatacncgcagaccctccggtggacgggtcctattccacctactctacgaganacaattaccaaagacacgtctttagttactaanaaatgaaacncgaccgtaggacgacgaccgtagcgaccgacgggtacttagttacttacgtggtggaacggtaggaggtacggttacgggacccctaaagggttaaccgttcgttacgtcgtaggtcggacgtcgggttacgggaacccgttaaagggtcccg

SEQ ID NO: 380664 - DNA, 594 bp, Homo sapiens
  misc_feature: GZ8MTXP01B9029.13.76.G10.1.454.CMB.2.raw
  modified_base (279)..(279): a, c, t, g, unknown or other
  modified_base (420)..(420): a, c, t, g, unknown or other
  modified_base (498)..(498): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtggtcaccgtcagtcacactacntgagcgtggccgcaggctccgagggagggctggagtgtcgttcttacttttattatagtagtgtagtaccatactcgcagaactccggtggacgggccgtatccacctactctaccagactacaaattcccgaaagaaccncgtccttgttttacaacgaaatgaaacctcgcgtagaacgcgcccgaatcgaacgacggtccgttataacgttctggngaacgtagagtacgttcggggaacccctaaggttaaccgttcacggtcttaaggtccggaacgtcggttacggggaacccttaacggggaaccccg

SEQ ID NO: 380665 - DNA, 774 bp, Homo sapiens
  misc_feature: GZ8MTXP01C55RO.13.76.G10.1.454.CMB.2.raw
  modified_base (469)..(469): a, c, t, g, unknown or other
tcagtcacgtactacacgaccggtgctcgatttagtcactcatacagggggggagaggagcccagcactgggattccgaggtgtttccattcggtgatcagcactgaacacacaggactcaccatggagttttggctgagctgggttttccttgttgctattttaaaaggtgcccagtgtgaggtgcagcgtggtggagtcgtggaggaggcttgatccagccgtgggggtccctgagactctccgtgtcgcacgtcctcgtcgggtccaccgtcacgtcacacctacagtgacgcgtcggtccgccgacggcctaccggaaggggaagggggccgtagggagtcggcgttcgtttacttttagtttagtagttaggtggttaacgtacctacttacgtccgactacggtaaccgttccggtcgggacgggggacctaacgttccaacctactcctacccaaaggtaanaaacctaaacgttaccaaaaggtaaaccctaccggttccgtttagttttaccccttaaaaacgtaaacgtacgaaaccgtacggtaccggtacggtaacggacgtacggtaacgtaccggaacccgtaccgggttacgttacgttaacgttacggtcggtaacggaacggtaagggaccgggtaccgggttacccggggtaaaccccgtaaacggttaaaccgttaccgttaccgtaacgtacgggtaaccggggtaccggtaccggggttaacccggggaacccggttaaaccggggtaacccg

SEQ ID NO: 380666 - DNA, 618 bp, Homo sapiens
  misc_feature: GZ8MTXP01BTJMR.13.76.G10.1.454.CMB.2.raw
  modified_base (297)..(297): a, c, t, g, unknown or other
  modified_base (383)..(383): a, c, t, g, unknown or other
  modified_base (452)..(452): a, c, t, g, unknown or other
  modified_base (511)..(511): a, c, t, g, unknown or other
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtggttcaccgtcagtcacacctacatgagcgtcgggtccnccgaggcctccggaggggagggcgtggagtgcgttcttcttttattagtagtagtgtacgtacatacgtccgcaacgaccgtcggnggacggggccattccaccgatcctaccgagagacaattaccaaaggaaccacgtcttacgtttcctaanaaattcgaacgtaggtcctaggagacgccagtcgaccgacgggtcgtgtaacgtttccnggtcgcggttagagggttcgtccgggggtacccaacgggttaacttacgtaaccgtacgttcggtaccgggtacgttcgggtaaccgggggaacccgtaaccggggg

SEQ ID NO: 380667 - DNA, 641 bp, Homo sapiens
  misc_feature: GZ8MTXP01AZT67.13.76.G10.1.454.CMB.2.raw
  modified_base (278)..(278): a, c, t, g, unknown or other
  modified_base (405)..(405): a, c, t, g, unknown or other
  modified_base (510)..(510): a, c, t, g, unknown or other
  modified_base (549)..(549): a, c, t, g, unknown or other
  modified_base (600)..(600): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagcgtggtggagtctggaggaggcttgatccagccgtgggggtcctgagactctcctgtgcagcctcgtggtcacgtcagtcacacctanatgacgcgtcgggtccgccgaggccgtaccggaagggggaggggcgtgggagtcgtcgttctttacgttttatttagtagttagtaggtacgtacctacttactcccgcacgtaacccgttccgggngggacggggccctacttaccaccgtactcctaccagaacgtacctaaacgtaccaaaagaaccctaccgtctttgtttacctaagaaatgaactacgcgtaaggnaccgacatacgacgtccggtacgttgtaacttcgtaggngaacggaaggttggaccgggaccggaaccctaaacgttaaccgttcacgtntacggtcggtacggtcgggacgggaacccgaacgggtcccg

SEQ ID NO: 380668 - DNA, 707 bp, Homo sapiens
  misc_feature: GZ8MTXP01D7DOB.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgcttattttaaaaggtgcccagtgtgaggtgcagcgtggtggagtcgtgggaggaggcttgatccagccgtgggggtccctgagactctcctgtgcacgcctcgtcggtcaccgtcacgtcacacctacatgacgcgtcgggtccgccgacggcctaccggagggggaacgggcgtgggagtcgtcggtttctttacgtttttattagtaggttagtacggtagtactatacctccgacagtaaccgtcggtagggacggggcctattaccgactactccctacaaggaacgtaacctaaacgttacccaaaaggtacctaacggttctttaacgtttacctaaactaaaagtacgaaacgacgtaccgttagaaacggacgtaccccggatacggaaaccgtcgggtccgttagttacctttaagtgggtcggacggtaaggttacggacgggttaccccgggggaacccttaaacgttaaacgggtttaacccacggtaacgttacggtcggggttaaaccggttcggttaaccgggggaaccccg

SEQ ID NO: 380669 - DNA, 720 bp, Homo sapiens
  misc_feature: GZ8MTXP01EQCQM.13.76.G10.1.454.CMB.2.raw
  modified_base (582)..(582): a, c, t, g, unknown or other
  modified_base (637)..(637): a, c, t, g, unknown or other
  modified_base (643)..(643): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgtcttaattttaaaaggtgcccagtgtgaggtgcagcgtggtggagtcgtggaggaggcttgactccgacggtccggtcgggggtccctgacgtactctcctgtgcagtcctcgtcggtcaccgtcacgtcacacctacatgacgtcggtcgggtcccgaccgacggccgtaccgggaagggggaacgggggtcgtagggtacggttcggttccgtttaccgtttttacgttttttaagttttaagtttaaggttaaggttacggttaacgttaacctacgttaccgtacccggacgtaacgtaacccgttccgggtcgggaccggggtacctaaccgttacccaacctactacctacgagaacgaacttaactaccgaaaacgtacgtaccgttacttttcgttactaacaaacgtacgaaaccncgtaccggtaggaacgacgcctaagccgacggtacgtacgttatactttacgggngacggngagacggacggttaccgacctaacgttacgttacgcgtaatcggtaacggtccggcggaccggtaaccgcggaaccg

SEQ ID NO: 380670 - DNA, 626 bp, Homo sapiens
  misc_feature: GZ8MTXP01DMK8U.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggacccaccatggagttttggctgagctgggttttccttgttgctattttaaaaggtgcccagtgtgaggtgcagctggtggagtctgggaggaggcttgatccagccgtggggggtccctgagactctcctgtgcagcctcgtgggttcaccgtcacgtcacacctacatgagcgtcgggtccgccgaggcctccgagggggaacgggggctagggagtgtcgttctttactttttatttagtagtaggtggtaacgtacatacctccgacaacgactcggtggacgggggccattccgacactcctaccagagaacaattacccaaagaacacgtcttgtttacttacaaagtgaaaccgaggtccctaggaacgacgaccgaagtcgacgaaccgggtcctaggttacttacgtggtaacgcggagaaggacggtcgggggacccttaacgggttaacgttactcgatggtacggacggttcgtaacgggggaaccctaaccgggg

SEQ ID NO: 380671 - DNA, 754 bp, Homo sapiens
  misc_feature: GZ8MTXP01DN01H.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccaggccgtgggggtccctgagactctcctgtgcacgcctcgttcgggttcaccgtcacgtacacacctacatgagcgtcgggtcccgcgacggcgtccggagggaacggggcgtggagtgtcgttctttcttttatttagtagtagtgtagtaccatactcgacacgtaaccgtcgtggacgggacccgtacttaccaccgactcctaccgagtaacgaactaaacttaccaaacgtaacctaacggtcttttagtttaccttaacaaaagttacgaaactcggtacccgttaaggaacgggaaccgtccggtaaacgtaccgggtaaccgtaccggggttaccccggttagttaaaccgttttaccgtgggggttaaccggaagggtaaacgggagggtaccggggttacccgggggtaaccccgttaacgggttaaaacccggttttaccgttaccggtaacgttacggggttaacggggtacccgttcgggggttaacccgggggtaacccgaaacgggggttaaaccccccgg

SEQ ID NO: 380672 - DNA, 634 bp, Homo sapiens
  misc_feature: GZ8MTXP01D69UH.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtcgggtcccgccaggcctccgaggggaagggggctggagtgtcgtcttctttttatagtagttgtagtagtacatacgtccgcacgtaacctccgtggacggggcccgtattccaccctagtcctaccgagagactaacgttacaaagaacaccgtctcgtttactacgaaattcgaaacacgccgtgaaggcgaccgatcggaaccgtacgggccgttagtacttacgtgtggaacgaaggttaggccgttagggggacccctaaacggttaaccgtttacgttaccggtcgttaggtaacgggacgggttaccggacgggggtaacccgaacgggggtaaccccg

SEQ ID NO: 380673 - DNA, 685 bp, Homo sapiens
  misc_feature: GZ8MTXP01AMX0F.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgccagtgtgaggtgcagctggtggagtctggaggaggcttgatccgagccgtgggggtcctgagactctctgtgcagcctcgtcgggtcaccgtcagtcacactacatgagcgtcgggtcccgcgacggcctcggaggggaagggctggagtgtcgttctttcttttagttagtagtagtaggtacgtactactacgtccgacgacgtaaccgtcccggtggacggggtccctattaccgaccctatcctaccgaaggactaacctaacgttaccccgaaaggaacctaaccgtcgtttacgttttacctaacgtaaaacgtcgaaacctaccggtcccgtaagggaacggacggaccccggtaaagtcgaacccgtacggggtcctttagtaccgtttaagcgtggaacggaagttaggacgttacccggggaccctaacgaaccgtttcgaaccggtgttaacgtcggggtaaccgttcggacggggggaacccgttaacgggtaaccccggg

SEQ ID NO: 380674 - DNA, 723 bp, Homo sapiens
  misc_feature: GZ8MTXP01EV2KW.13.76.G10.1.454.CMB.2.raw
  modified_base (264)..(264): a, c, t, g, unknown or other
  modified_base (401)..(401): a, c, t, g, unknown or other
  modified_base (404)..(404): a, c, t, g, unknown or other
  modified_base (488)..(488): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgtcttaattttaaaaggtgcccagtgtgaggtgcagcgtggtggagtcgtggaggaggtcttgactccgaggccggtcggggggtccctgacgtactctcctgtcgcncgtcctcgtggttcaccggtcacgtcacacctacatgagcgtcgggtcccgcgacggcctaccgggaaggggaagggggcgtgggaggtcggtcgtttcgtttactttttaagttagtagttagtggtatacatacncgnacgaaccgtcggtggacgggcctacgtcaacctactctaccgagtacgaactaacgttaccaaacgaacctacggtaccttttntttaccgttaaaacaaacgtaacgaaacgtccggtacggtaggaacggtaccgaccgtaagtaccggaaacccgtaccgggttacgttacgttaacgttaccggtggtacggaacgggtaaggacgggtaccgggttacccggggaaaccctaaacgggttaaccgttcgttacggtaacgtacggtaaccgggtacggtccgggaaccgggtaacccggaaccggggtaacccg

SEQ ID NO: 380675 - DNA, 590 bp, Homo sapiens
  misc_feature: GZ8MTXP01EZH8J.13.76.G10.1.454.CMB.2.raw
  modified_base (295)..(295): a, c, t, g, unknown or other
  modified_base (345)..(345): a, c, t, g, unknown or other
  modified_base (440)..(440): a, c, t, g, unknown or other
  modified_base (462)..(462): a, c, t, g, unknown or other
  modified_base (509)..(509): a, c, t, g, unknown or other
tcagtcacgtactacacgaccggtgctcgatttagtcactcatacaggggggagaggagcccagcactgggattccgaggtatttccattcggtgatcagcactgaacacagaggactcaccatggagttttggctgagctgggttttccttattactattttaaaaggtgtccagtgtgaggtgcagttggtggagtctggaggaggcttggtccaggcccgggggggtcctgagactctcatgtgcggcctcgtgggctcaccgtcaacaccaactacatgagcgtgggtccnccaggctccgaggggaagagggccggagtggggtctcgtagtttatttanggtcgacggtgccagtattcgtaaccgcaggacctccggtaggaacgggggccgttcacatctccaagacgacaaattcccaaagaacacgggtntatcttacaaatagaacgtacngagagtcgagtcgacaccgggctctaattctagtagagtaaagatgngaagaggacgggaccccgttaagtcggggcgttgggttggagggtttcttcgttgacgttggcgtggggcccgtaacgggg

SEQ ID NO: 380676 - DNA, 800 bp, Homo sapiens
  misc_feature: GZ8MTXP01BQA9E.13.76.G10.1.454.CMB.2.raw
  modified_base (270)..(270): a, c, t, g, unknown or other
tcagtcacgtactacacgaccggtgctcgatttagtcactcatacagggggcccagcactgggattccgaggtgtttccattcggtgatcagcactgaacacagaggactcaccatggagttttggctgagctgggttttccttgttgctattttaaaaggtgccagtgtgaggtgcagctggtggagtctggaggaggcttgatccagccgtgggggtccctgagactctcctgtgcagcctcgtggtcaccgtcagtcacacctacangagcgtcgggtccgccgaggccgtaccggagggggaacggggcgtgggaggttcgtccggtttctttacttttttaagtttagttaaggttaggtgggttaagtacacttaaccgtcccccggcacggtaccgtccggtacgggaacgggggtccctaacgtttccgaaccctacgttccctaccgaaggtacgaacctaaacttaccgaaacggaactacgtctttacgttttactaacgtaaatacggaaacacgtcccgtaggaacgacggggacccgtaagttacggaacccgggtaccggttcccgggttagttaaccgtttaccggttaggtaccggaacgggtaacgggaaggtaacggggttacccgggggaccccgttaaaaccgggttaaaccggttttaacccgtaaccgggttaccgttaagggtttaccggggaacccggggtttaccggggtaaccggggggaaaccccgtaacgggggttaacccccgttaaccggggttccccgtaaccccggg

SEQ ID NO: 380677 - DNA, 657 bp, Homo sapiens
  misc_feature: GZ8MTXP01CY6IF.13.76.G10.1.454.CMB.2.raw
  modified_base (374)..(374): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccaggccgtgggggtccctgagactctcctgtgcagcctcgtgggttcaccgtcagtcacacctacatgagcgtcgggtcccgcgacggcctaccggaggggaacgggggcgtggagtgtcgttctttacttttatttatagtagtggtagtacatacncgcacgaacgtcgtggacgggcattcacactctccagacgaactaacttaccaaagaaccacggtctttacgtttacttaacaaagtcgaaaccgcgccgtaggaacggacgacccgaagtcggaaccgtacgggtcccgttagttaaccgttacgtggttcggaaccggaaggaacggtacggttaccgggggtaaccccaacgggttaaaccgttcgttaccggtcgttaacgtcgggtaacggtccgggttaccggggtaacccgaacggggtaaccccg

SEQ ID NO: 380678 - DNA, 725 bp, Homo sapiens
  misc_feature: GZ8MTXP01CSEO4.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtcgtggaggaggcttgatccacggccggtgggggtccctgagtactctccgtgtgcacgcctcgtcgggttccaccgtcacgtcaccacctacagtgacgtcgtcgggtcccgccgacggccgtaccggaaggggacggggcgtgggagtcggtcgtttctttacttttaagtttagttagttaggttggttaacgttaccctacgttacgtcccgacaacgtaaccgttccgggtcgggacggggtccctaacttcccgaacctacttcctacccaaggactaaacctaacgttaccgaaacgtaaacctcgttctttagtttaccttaacaaagtcgaaacctcgtaccgtaggaacggaccgtaccgtaagtcgaacccgtcggtaccgttagttaactttacgtggtacggaacgggtaacgacgggtacgttaccgggggaacccctaacggttaaaccgtttcaccgtaaccgtaggtccggaccgttcgggacggggtaaccccgaacgggtaaccccg

SEQ ID NO: 380679 - DNA, 649 bp, Homo sapiens
  misc_feature: GZ8MTXP01BPQ2T.13.76.G10.1.454.CMB.2.raw
  modified_base (290)..(290): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatcggtggcctcgaatggcctgactcagccacccgcaatcgtccgtcgtccccagggcagacagccaccataacctgctctggattatttgtgaggtatagatatgtcttgttggtatacaagagaacggccggccagtcacctactattggttanctatagaagacaacgaagccggccctacgagggtactcccgtgacgcgtacttccctcgtcgcctaccaactcgtacggaacacacgacccactctacgacctactcgacgccgggaacccagaccctagtacggagttgacggtcacgtaacttattaaccgtcggtactaagttaaccgagttacgggaaacctaaagatttaagtacggtgtagggtcttacgggtcggggaacggttaaacggggtaaacccttaaacggttcggtaacccggttaccggttacgggttaccaaaccgggaccccgtaacgggtcccctcccgggttccccccgttcgggttaaccttaaccccg

SEQ ID NO: 380680 - DNA, 572 bp, Homo sapiens
  misc_feature: GZ8MTXP01B4D0L.13.76.G10.1.454.CMB.2.raw
  modified_base (338)..(338): a, c, t, g, unknown or other
  modified_base (445)..(445): a, c, t, g, unknown or other
  modified_base (455)..(455): a, c, t, g, unknown or other
  modified_base (468)..(468): a, c, t, g, unknown or other
  modified_base (500)..(500): a, c, t, g, unknown or other
  modified_base (508)..(508): a, c, t, g, unknown or other
tcagtcacgtactacacgaccggtgctcgatttagtcactcatacaggggtgggagaggagcccagcactgggattccgaggtgtttccattcggtgatcagcacttaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggtcaccgtcagtcacacctacatgagcgtggtccgccaggctccgaggggagggctggagtgcgtcttctttttagttanagtagtggtagtaccatactccgcaggaacctccgtggaggggcccgtattcaccgactctcccagagaacctaattacccgaaagaacacgtcttgttttacctanaaatgaaacngccgtagaggacnccgagtcgacgacggtccgtgttattacgtgngcgtaggngacgttgggggaccccagttaaccggttcacgctagtcgggactcggttggggccaaggggccc

SEQ ID NO: 380681 - DNA, 600 bp, Homo sapiens
  misc_feature: GZ8MTXP01CRP9H.13.76.G10.1.454.CMB.2.raw
  modified_base (170)..(170): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtgtccgtcgtccccaggacagacagccagcatcacctgctctaggaaataaagttggacagaataaatatacttcctggtatcagcagagtcaggccagtcccctgtcgctggtcatctatacaagatgccaagccggcctacgagggactcccccgtgacgcgtattccgtcgtcggcctacccgtaaacttccgtaggggaacctcgaacgcccctaactccgtacgaacccgtattaccgaacgggacccgggtaaccccgagggtacctaggtacggaagtggacggtcgtaggtaacttacttacggtcgtacgagggtcggtaggggactaggcgacgctaacgtcggacccgtcttagtcgtacgttacggacgttcgggaacctacggtccaccgttacgttacgtccgaacgaaccccg

SEQ ID NO: 380682 - DNA, 622 bp, Homo sapiens
  misc_feature: GZ8MTXP01BSRYI.13.76.G10.1.454.CMB.2.raw
  modified_base (170)..(170): a, c, t, g, unknown or other
  modified_base (297)..(297): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctactaggaaataagttggacagaataaatatacttctggtatcagcagaagtcaggccacgtcccctgtcgctgtcatctatcaagntcgcaacgccggccctcgacgggtactccccccgtggacgcgtacttcgtcgtcgggcctaccaaacgttcgtacgggaacctcgacgccctacttccacgaacctactaccgacgggacccgggaacccgaggtccgttaaggtgggtagtaggacggtacgttacgtacgtttacgttacggtcggtcggacgggtacggtacggacgtcgacgacgccgtaacgtccggccgtcttacggttcggttacgttacgggacggttaccgggtaaccgtacggtaacccgtacccgtacgttaaccgtcccgaaccggtaacccg

SEQ ID NO: 380683 - DNA, 673 bp, Homo sapiens
  misc_feature: GZ8MTXP01B3A48.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgccagtgtgaggtgcagctggtggagtcgtggaggaggcttgatccagccgtgggggtccctgagactctcctgtgcagcctcgtcgggttcaccgtcagtcacacctacatgagcgtcgggtcccgccgaggcctccgaggggaggggctggagtgcgttcttcttttattatagtagtgtagtaccatactcgcagtaactcggtggacggggccgtattccgaccattcctacccaaggacgaacctaaacttccgaaaaggtaaccctaaccggttctttacggttttacctaactaaaacgtcgaaactacggcccgttaagggaaccgaacggacccgtagtaccggaacccggaccgggtacccgttagttaaccgtttaccgtggttacgggaacggtaaggacgggtacggttccgggggaacccctaaggttaacccgtttacgacgtcgtagtcgggacggtggttaccggggaaccgaacggggtaacccg

SEQ ID NO: 380684 - DNA, 582 bp, Homo sapiens
  misc_feature: GZ8MTXP01C8E67.13.76.G10.1.454.CMB.2.raw
  modified_base (339)..(339): a, c, t, g, unknown or other
  modified_base (370)..(370): a, c, t, g, unknown or other
  modified_base (443)..(443): a, c, t, g, unknown or other
  modified_base (461)..(461): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggaggaggcttgatccgagccgtgggggtccctgagactctcctgtgcagcctcgtgggtcaccgtcagtcacacctacatgagcgtcgggtcccgccaggcctccgaggggaagggggctggagtgcgttctttntttatttatagtagtggtatacatactccgnagaactcgtggagggccgattccaccatctacagagacaactcaagaacacgcttgttactacaaatgaaacncgcgtagagacgaccgancgacgtcggtacgttgtattacgtggtggaacgaaggagacggttccgggaccctaaacggttaacgttcttacgtaacgtagtaacggtcggtcgggacgggtaaccgaacgggaacccg

SEQ ID NO: 380685 - DNA, 709 bp, Homo sapiens
  misc_feature: GZ8MTXP01BDKEK.13.76.G10.1.454.CMB.2.raw
  modified_base (654)..(654): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctatttaaaggtgccagtgtgaggtgcagctgggtggagtcgtggaggaggcttgatccgagccgtgggggtccctgagtactctcctgtgcagcctcgtcgggtccaccgtcagtcacacctacatgagcgtcgggtcccgccgaggccgtaccggaggggacggggcgtggagtcgtcgttctttctttttatttagtagttaggtggtagtaccactacgtccgctacggacctccgggtggacggggtccctattccaccactcctaccgaggaataacctaacttacccgaaaagtaacctaccggttctttacggttttacctaaacgaaacgtcgaaaaccgcggtaccggttagggaaccggacggtacccggagttacccggaaccggaccgggttaccgttagttaccgtttactgggtacggaacgggtaaggagggtacccggttacgggggaacccctaacgggttaaaccgtttcaccgggtnttacggtcggggtaccggtcgggttacgggggaacccttaaacgggggaaccccg

SEQ ID NO: 380686 - DNA, 739 bp, Homo sapiens
  misc_feature: GZ8MTXP01C0T1Z.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggtagttttggctgagcttgggtttttccttgttgcttaattttaaaaggtgcccagtgtgaggtgcagcgtggtggagtcgtgggaggtaggtttgactccgaggtccggtcgggggtccctggacgtacctcctcctgtcgcacgtccttcgtcgggttccaccgtcacgtccacacctacatgacgcgtcgggtcccgccgacggccgtaccggaggggaacggggcgtgggagtcgtcgttctttactttttagttagttagtaggtagtatactactacctcgcgacgtaccgtacggtaggcgggaccgtataccacactcaccaagacaactaaactaccgaaagtaaacgtcttagttttaactaactaaagtacgaaactcggtaccgtaggaacgggacggtaccgtaagtaccggaaccgtaccggtccgtttagtttaacttccgtaggtcggaacgtaaggaacggtacgggttaccggggtaaccccaaacgggttaaacccgtttcaccggttcgttacggggtaaccggtaaccggttccggggtaaccggggggaacccgttaaacccgggggtaacccgttccggggttaaccccg

SEQ ID NO: 380687 - DNA, 666 bp, Homo sapiens
  misc_feature: GZ8MTXP01DT8GV.13.76.G10.1.454.CMB.2.raw
  modified_base (472)..(472): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgctattttaaaaggtgcccagtgtgaggtgcagcgtggtggagtcgtggaggaggcttgatccaggccgtgggggtccctgagtactctcctgtgcacgcctcgtgggttcaccgtcagtccacacctacatgacgcgtcgggtccgccgaggcctaccggaggggaaggggcgtggagtcgtcgttctttacttttatttagtagtagtgtagtaccatacgtccgcacgtaccgtcgtgggacgggtccgtacttccaacctatcctaccagaacgactaaactcaaacgaactacgtcttagttttaccaaanaaacgtacgaaactcgtacggtaggaacgaccggacgtagtaccgaccgtacgggttcttagttacgttacgtggacggaacggtaaggacgggtacgggttacccgggtaaccctaaaccgggttaaacgttcgttaccgtaagtacggtcggggtaccgtcgggacggggtaacccgaacggggtaaccccg

SEQ ID NO: 380688 - DNA, 566 bp, Homo sapiens
  misc_feature: GZ8MTXP01AJRO4.13.76.G10.1.454.CMB.2.raw
  modified_base (394)..(394): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggtcaccgtcagtcacacctacatgagctgggtccgccaggctccgagggaggggctggagtgcgtcttcttttatttatagtagtggtagtaccatactcgcagaactccgtgaggggccgattcacatctccaganacaattccaagaacacgcttgtttctacaaatgaactagcctgagagcccgatcgacgacggccgtgtacttacgtgtgcgaagagtacgttcgggggaccccaaggttaaccgttacacgtaacctagtcgggaaccgtcggttacgggggaacccaagggggtaaccccg

SEQ ID NO: 380689 - DNA, 697 bp, Homo sapiens
  misc_feature: GZ8MTXP01EWFRJ.13.76.G10.1.454.CMB.2.raw
  modified_base (504)..(504): a, c, t, g, unknown or other
  modified_base (515)..(515): a, c, t, g, unknown or other
  modified_base (571)..(571): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgcccagtgtgaggtgcagcgtggtggagtcgtggaggaggcttgatccgagccgtcgggggtccctgagactctcctgtgcagcctcgtggtcaccgtcacgtcacacctacagtgacgcgtcgggtcccgccgacggcctaccgggaaggggacggggcgtgggtagtcgtccgttctttctttttaattagttagttagtaggtacgtacctacgttactccgcgacgtaccgttccgggcgggacggggccgtacttcccgacctactcctacccgaaggtactaacctaaacgttaccgaaagtacgtaccgtcgttttactttactaanaacgtagaacncgtccgtaggacggacgccgtagcgaaccgtcggtaccgttatttacgtcgttggnggaacggtaaggacggtagggttacccgggaacccctaaacgggttaaaccgtttccgttaacggtccgttaggttccggggaacggttccggggacgggggtaacccgaacgggggtaacccccg

SEQ ID NO: 380690 - DNA, 613 bp, Homo sapiens
  misc_feature: GZ8MTXP01C7CCT.13.76.G10.1.454.CMB.2.raw
  modified_base (379)..(379): a, c, t, g, unknown or other
  modified_base (447)..(447): a, c, t, g, unknown or other
  modified_base (459)..(459): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagtttggctgagctgggttttccttgttgctattttaaaaggtgcccagtgtgaggtgcagcgtggtggagtcgtggaggaggcttgatccgagccgtgggggtccctgagactctcctgtgcagcctcgtgggttcaccgtcagtcacacctacagtgagcgtcgggtcccgcgacggccgtccggaggggaagggggcgtagggagtggtcgtttctttacttttatttagtagtagtgtagtaccatacncgcagactcgtggacgggcacttcaccatctcagacactaactacaaagaacacgtcttagttactanaaagtcgaaacncgcgtagacgacgaccgtatcggacctcgggaccgttagttaacttacgtgtcggaagaggaggtcggttaccggggaaccctaggttaaacgttccgttacggaacttaggtcggaccgtcgggttaccggggaaccgaacggggtaaccccg

SEQ ID NO: 380691 - DNA, 582 bp, Homo sapiens
  misc_feature: GZ8MTXP01DUBS5.13.76.G10.1.454.CMB.2.raw
  modified_base (268)..(268): a, c, t, g, unknown or other
  modified_base (430)..(430): a, c, t, g, unknown or other
  modified_base (434)..(434): a, c, t, g, unknown or other
  modified_base (444)..(444): a, c, t, g, unknown or other
  modified_base (467)..(467): a, c, t, g, unknown or other
  modified_base (509)..(509): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagctctcctgtgcagcctcgtgggtcaccgtnagtcacacctacatgagcgtggtccgcaggcctcggagggaagggctagggagtcggtcgtcgttactttttagttataggtagttggtacgtacatactcccgacacgcgtccgtgggaggggccctagttccacatctacagagaacattacaaagaacncgtntagttactanaaatagaacacgccgtagacganaccgatgaaccgacggtccgttagtaacttgtgtgttggaanaggtacgtcggggacccaaggttaaacgttaacctacgaacgttagcgggacgttccggaacgggggaacccg

SEQ ID NO: 380692 - DNA, 665 bp, Homo sapiens
  misc_feature: GZ8MTXP01BJEDV.13.76.G10.1.454.CMB.2.raw
  modified_base (334)..(334): a, c, t, g, unknown or other
tcagtcacgtactacacgaccggtgctcgatttagtcactcatacagggggggagaggagcccagcactaggattccgaggtgtttccattcggtgatcagcactgaacacagaggactcaccatggagttttggctgagctgggttttccttgttgctatttaaaggtgcccagtgtgaggtgcagctggtggagtctggaggaggcttgatccagccgtggggggtccctgagactctcctgtgcagcctctgggttcaccgtcagtcacacctacatgagcgtcgggtccgccgaggcctccgaggggagggggctgggagtgcgtctttnttttattatagtaggtggtagtacatactcgcagaaccgtccggtggacggggccgtattccgacctatccgtaccagacgaactaaactacccaaagacctaaacggtctttacggtttacctttaacaaagttaggaaacctacgccgttagggacgtaccggacccgtaagtacgacccggtacgggtacccgttgttaacttaccgtggtcgaacggaggttaggacggttccgggggacccctaacgggttaaccgtttcgaaccgtctacgggtaacgggtaccgggtacgggttacgggggaaccgttaacgggggtaaccccg

SEQ ID NO: 380693 - DNA, 702 bp, Homo sapiens
  misc_feature: GZ8MTXP01D7O9T.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttattttaaaaggtgcccagtgtgaggtgcagcgtggtggagtcgtggaggaggcttgatccagccgtgggggtccctgagactctcctgtgcagcctcgtgggtcaccgtcagtcacacctacatgagcgtcggtcccgccgaggcctccggaggggaaggggcgtggagtgtcgttctttacttttatttagtagttagtggtataccactacgtccgcacgtaacctcggtggacggggccgtacttccacctactcctacgaagacgtaactaacttaccgaaagtaaccaaccgtctttacgtttaccttaactaaacgtacgaaactccggtaccggtaggacggaccgaccgaacgtcgaccggtaccgggtaccgttagttaacgttccgtaggtcggaaccggtaagggacgtaacgggttccgggggtaaaccccgtaaaccggttaaacccggtttaaccgttaccgtaacgttacggaacgggttttacccggcgggttacgggggtaaccccgaacggggtaacccccgg

SEQ ID NO: 380694 - DNA, 660 bp, Homo sapiens
  misc_feature: GZ8MTXP01CVUM3.13.76.G10.1.454.CMB.2.raw
  modified_base (290)..(290): a, c, t, g, unknown or other
  modified_base (329)..(329): a, c, t, g, unknown or other
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagcccaccctcagtgtccgtgtccccaggacagacagccagcatcacctgctctaggaaataatggacagataaatatacttctgtatcagcagagtcaggccacgtccctgtcgctggtcatctancaagatgaccaagccggcctagagggacctccccgtagngcgtattccgtctggcctcctaaactcgtcgggaaactcgacgtcctaacgtcctacgaacctactccgaacgggcccggggaacccacggggacttaacggtagggtacgtacggaaggggtcttacggtaactaacgtttaactggttaccggaggggtaccggtggggtaaccaggtaccgaggtaaccgaaccggttccgggtaccccgacgtttaaacggttccggtttaccgggtttaccggggaaacccggttaacgggggaaccccgtaaaccggggttcccgtaaccccgggtttacccgtaacgttaaccgaaaccccggg

SEQ ID NO: 380695 - DNA, 617 bp, Homo sapiens
  misc_feature: GZ8MTXP01BNHYF.13.76.G10.1.454.CMB.2.raw
  modified_base (520)..(520): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcacgcctcgtgggttcaccgtcagtcacacctacatgagcgtcgggtccgccgaggctccgagggggaaggggcgtgggagtgcgttcttcttttattatagtagtggtagtacatactccgacagcgtccgtggacggggccgtattcacgtactcctaccaggacaacaacttcccgaaagtaacctacgtcttacgtttactacaaattcgaaacgtgccgtagaagacgccgaagtcgaacgaccgggtccgtgttaactttacggnggtcggacggtaaggacggtacggtaccgggaacccgttaacggttaacgttaacgacgtaacgtaggtcggttaccggtcgggttaacgggaaccg

SEQ ID NO: 380696 - DNA, 738 bp, Homo sapiens
  misc_feature: GZ8MTXP01DDJ7C.13.76.G10.1.454.CMB.2.raw
  modified_base (263)..(263): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggtagttttggctgagtcgttgggttttccttgttgtcttaattttaaaaggtgccagtgtgaggtgcagcgtggtggagtcgtggagggaggcttgactccgaggccggtgggggtccctgacgactctcctgtgcncgtcctcgtcggtcacgtcacgtcacacctacatgagcgtcgggtcccgccgacggccgtccggaggggacgggggcgtagggtagtcggtcgtttcttttacttttaatttagttaggttaggtggtaactaacctactacgtccgactacgaaccgttccgggtgggacgggtaccgtacttccaacctactcctaccgaacgacgtaaactaactaccgaaagtaacccacgttcctttagtttactaaacaaacgtcgaaacctacggccgtaaggaacggacgacccgtagtaccgaaccggtacgggtccttagttaacctacgtggtacggaacggaagttaacgggtacggttcccggggtaaaccctaaacggttaaaccgtttaccgttaccggtaacggttaacggtcggggtaaccgggttccggggaccgggggaacccggttaaaccggggtaacccccgg

SEQ ID NO: 380697 - DNA, 624 bp, Homo sapiens
  misc_feature: GZ8MTXP01EI1QZ.13.76.G10.1.454.CMB.2.raw
  modified_base (405)..(405): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtcgggttcaccgtcagtcacacctacatgagctgggtccgccaggcctccgagggaggggctggagtgcgtcttcttttatttatagtagtggtagtaccatactcgcagaaccgtcgtaacgggggctagttcaccatctaccaaganaactaacttacaaagaaccacgtacttgtttactacaaattcgaaacagtcccagggacgacgaccgatacggaccacggtcccgtaggttactactggtgcggaagacggttaggccggggacccgaaacgtaaaccgtttacgttaccgttacttaacgtagggtaaccgttcgggtagggggaccccggaaaggggttaaccccgtaaccccgggg

SEQ ID NO: 380698 - DNA, 616 bp, Homo sapiens
  misc_feature: GZ8MTXP01DIA39.13.76.G10.1.454.CMB.2.raw
  modified_base (473)..(473): a, c, t, g, unknown or other
  modified_base (482)..(482): a, c, t, g, unknown or other
  modified_base (520)..(520): a, c, t, g, unknown or other
  modified_base (522)..(522): a, c, t, g, unknown or other
  modified_base (571)..(571): a, c, t, g, unknown or other
  modified_base (576)..(576): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgcttattttaaaaggtgcccagtgtgaggtgcagcgtggtggagtcgtggaggaggcttgatccgaggccgtgggggtccctgacgactctcctgtgcagcctcgtcgggtccaccgtcacgtcacacctacatgagcgtcgggtcccgcgaggcctccggaggggaaggggcgtgggagtgtcgttctttacttttagtttatagttaggtggtaataccgactactccgacacgacctccggtgggacgggccgtacttccacctactctaccgaagtacgaactaactaccaaagtaaccacgtcttgttactanaaatgaacngcgtagagacgcgatcgacgacggtccgtgtattacgngngaacgagacggacgttccggggaaccctaacggttaacgttcttacgtntacgngggtaccgtcgggttacggggaaccgaacgggtaaccccg

SEQ ID NO: 380699 - DNA, 708 bp, Homo sapiens
  misc_feature: GZ8MTXP01AV3O8.13.76.G10.1.454.CMB.2.raw
  modified_base (273)..(273): a, c, t, g, unknown or other
tcagtcacgtactacacgaccggtgctcgatttagtcactcatacagggggcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacangagcgtcgggtcccgccgaggccgtaccgagggggaacggggcgtgggagtcgtcggttcttacttttatttagtaggttagtggtagtacatctcccgcgagtaccgtccggtggaacgggggtcctaacttccaacccgacttcccgtaccaacgtaacgaacctaaaccgttaccaaacggaaacctccggtacttacgttttacctaactaaaagtgaaaccacgcccgttaggaacggacgggacccggtaagtccggaacccgtaacgggtcccgttagttacttaccggtgtacggacgaaggacggaacggtccgggggaaccctaaacggttaccgttaaccgtacggccgtttaaggcccgggtaacgtcgggtaaccgggaccgggtaaacgggaccccggtaacggttccccgttaaccccgg

SEQ ID NO: 380700 - DNA, 711 bp, Homo sapiens
  misc_feature: GZ8MTXP01AVXAO.13.76.G10.1.454.CMB.2.raw
  modified_base (288)..(288): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgcttattttaaaaggtgcccagtgtgaggtgcagcgtggtggagtcgtggaggaggcttgatccgaggccgtcgggggtcctgacgtactctctgtgcacgtcctcgtggtcaccgtcacgtcacacctacntgacgtcgtcggtccgcgacgcgtacggaggggacgggcgtggagtcgtcgtttctttacttttaagttagttaggttagttagtagtacctagtactccgcgacgtacgtccggtggacgggccgtactaccacctactctaccgaagtactaaactaacgtaacccgaaagaaccgtacccgttacttttacgtttaacccctaaagaaaacgttacgggaaacctacggtaccggtaaggaacggaccgtacccgtaagtacccggaccgtacgggttacccttagtttaacccgtacgtggtcggaacggaggttacggtaaccgggccgggtaaaccccgaacggtttaaaaccgttccgttacgtcgttaacgggtcgggtaaccggttcgggaccgggtaaccgaacggggtcccc

SEQ ID NO: 380701 - DNA, 626 bp, Homo sapiens
  misc_feature: GZ8MTXP01BPMU3.13.76.G10.1.454.CMB.2.raw
  modified_base (471)..(471): a, c, t, g, unknown or other
  modified_base (529)..(529): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtctggaggaggcttgatccagccgtgggggtccctgagactctcctgtgcagcctcgtgggttcaccgtcagtcacacctacatgagcgtggtccgccaggcctccgaggggaagggctggagtgcttcttacttttattatagtagtggtagtacatactccgacacgctccggtgggacgggggccctattccgacctactcctaccgaggacgaactaagttacccaaaaggacctacgtcttagtttacctacaaatcggaaacncgtcccgtagacgacgtcccgagtcggaaccgtacgggtcctttagtacgtttaacgnggtacgacggaggacgtacggtcggggaaccccgaacggttaaaccgttaacgacgtcgtttaacgcggggttaccgttcggttcgggggaaccccg

SEQ ID NO: 380702 - DNA, 695 bp, Homo sapiens
  misc_feature: GZ8MTXP01DGQOC.13.76.G10.1.454.CMB.2.raw
  modified_base (343)..(343): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgacgactctcctgtgcagtcctcgtcgggtcaccgtcagtcacacctacatgagcgtcgggtcccgcgaggcctccggaaggggaaggggcgtgggagtgtcgttctttnttttatttagtagtagtggtacgtaccatactccgcacgtaaccgtccggtggacggggtccgtattccaacctatcctacccaaggaactaacctaaacttacccgaaaaggtaaaccctaccggttacctttacggtttttacctaaacaaaagttcggaaaacctcggacccgttaaggaacggaaccgtcccgaagtaccgaaccgtaccgggtccgttagttacgttacgtgggtgtaaggaggaacggtcggttcccggggaacccctaaggttaaaccgttttacgaaccgtcttaaggtcgggtaaccggtcggttaccgggtaacccgaacggggtaaccccg

SEQ ID NO: 380703 - DNA, 697 bp, Homo sapiens
  misc_feature: GZ8MTXP01B1HBR.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtgggtcaccgtcagtcacacctacatgagcgtcgggtcccgccgaggccgtaccggagggggaacggggcgtgggagtggtcgttctttcttttatttagttagtagtggtatacccatactccgacagaaccgtccggtggacggggtcccgtattccacctactctacccgagaacaactaacgttaccaaagaaccctacgtcgtttacgtttacctaacaaaagtcgaaaacctcggcccgttaggaacggaccgacccggtaatccggaaccgtaccgggtccgttagttaactttaccgtgggtacggaacggaaaggacggtaacgggttcccgggggacccctaaacgggttaaaccggtttccgacggtaacccgttaggtcgggaacccgggttcggaccggggggaacccgttaaacgggggtaaccccg

SEQ ID NO: 380704 - DNA, 561 bp, Homo sapiens
  misc_feature: GZ8MTXP01DJO84.13.76.G10.1.454.CMB.2.raw
  modified_base (398)..(398): a, c, t, g, unknown or other
  modified_base (452)..(452): a, c, t, g, unknown or other
  modified_base (472)..(472): a, c, t, g, unknown or other
  modified_base (474)..(474): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggccgccaggcctccgagggaaggggctggagtgcgtcttcttttatttatagtagtgtagtacccatactcgcagaacctcgtgacggggccaattcaccatctccaganacaattccaaagaacacgcttgttctacaaaatgaacagcctgagaagccgaangacgacgacgtgtatactgngngagagaggacgggaccgaacgttaacgttaacgttacgtaacgtacgtaacggtacggtcggttacgggtaaccggaacgggaaccg

SEQ ID NO: 380705 - DNA, 713 bp, Homo sapiens
  misc_feature: GZ8MTXP01BRG2H.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccgagccgtgggggtccctgagactctcctgtgcagcctcgtggtcaccgtcagtcacacctacatgagcgtcgggtcccgccaggcctaccggaggggaacgggggtcgtgggagtgtcgttctttctttttatttagtagtagtggtagtaccactacgtccgacacgaaccgttccggtggacggggcctattcccgactactcctacagaagaacctaacttaccgaaacgtaacgaccgttcgttttacgttttaccttacgaaaacttcgaaaacgccggtaccgtaaggaacggaccgacccgtaagttaccggaaccgtaccgggtaccgttagttaacttaccgtgggtcggaacggtaaggaagggtacgggttacccgggggtaaaccccgtaaacgggttaaaccgtttaaccgttaccggtaacttagggtcgggaacccggttcggggttaccggggggaacccgaaacggggggtaacccccg

SEQ ID NO: 380706 - DNA, 566 bp, Homo sapiens
  misc_feature: GZ8MTXP01B57K4.13.76.G10.1.454.CMB.2.raw
  modified_base (380)..(380): a, c, t, g, unknown or other
  modified_base (473)..(473): a, c, t, g, unknown or other
  modified_base (481)..(481): a, c, t, g, unknown or other
  modified_base (483)..(483): a, c, t, g, unknown or other
tcagtcacgtactacacgaccggtgctcgatttagtcactcatacagggggcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtcaagcctctgggttcagcttcagtgtatattggatgagcgtgggtccgccgagacctccgaggggaaaggggctggagtgcgtcttcttttatttatagtagtgtagtacatactcccgcagacgtcccgtggaacgggccgnttcaccatctccagagacattcaagaacacgtctagtttactacgaaatgaacagcctagagaggccgatcgacgacggccgtgtacttacgngtgacagngngtcggggaccctacggaaacgtactacgcttagttcgggaaccgtcggtggggacccgaaggggacctcgggttcctaacccg

SEQ ID NO: 380707 - DNA, 586 bp, Homo sapiens
  misc_feature: GZ8MTXP01CB2PS.13.76.G10.1.454.CMB.2.raw
  modified_base (368)..(368): a, c, t, g, unknown or other
  modified_base (384)..(384): a, c, t, g, unknown or other
  modified_base (401)..(401): a, c, t, g, unknown or other
  modified_base (405)..(405): a, c, t, g, unknown or other
  modified_base (410)..(410): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctctgtgcagcctcgtggtcaccgtcagtcacacctacatgagcgtcggtcccgccacggctccggaggggaacggggcgtggagtgtcgtctttcttttatttagtagttagtggtagtaccatacncgcagtaacctccggnggacgggccgactcacnctcncaganacaactaccaagaacacgtcttagtttctacaaatacgaacacgccgtaggacgacgaccgagtacgacgacggtccgtattattacgtgtgcgaggagacggcggggaccctaacggttaacgttacgacgtctagtcgggacgtcggttacggggaaccgaacggggtaacccg

SEQ ID NO: 380708 - DNA, 566 bp, Homo sapiens
  misc_feature: GZ8MTXP01DWUB9.13.76.G10.1.454.CMB.2.raw
  modified_base (492)..(492): a, c, t, g, unknown or other
  modified_base (497)..(497): a, c, t, g, unknown or other
  modified_base (501)..(501): a, c, t, g, unknown or other
tcagtcacgtactacacgaccggtgctcgatttagtcactcatacaggggtgggagaggagcccagcactgggattccgaggtgtttccattcggtgatcagcactgaacacagaggactcaccatggagttttggctgagcttgggttttccttgttgctattttaaaaggtgcccagtgtgaggtgcagctggtggagtcgtggaggaggcttgatccagccgtgggggtccctgagactctcctgtgcagcctcgtggtcaccgtcagtcacacctacatgagcgtggtccgccgaggccgtccgaggggaaggggctggagtgcgttcttctttattatagtagtgtagtacatactcgcaagactcgtgacgggcctatcacatctacagaacacaatccaaagaactacgtacttagttacttaacaaatgaaaccagggaccgtagacgacgccgtaatcgaacgaacggccgttagtattacgngtcgngagngagtcggggccaacggttacgttaactcgactaagtcggacgttcggtcgggaacgaaaccgggg

SEQ ID NO: 380709 - DNA, 755 bp, Homo sapiens
  misc_feature: GZ8MTXP01A6XEC.13.76.G10.1.454.CMB.2.raw
  modified_base (511)..(511): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttccaccgtcacgcccacaccctacatggagcgtcgggtcccgccgaggcctacccggagggggaagggggctgggagtcggtcgttctttctttttatttatagtaggtggtagtaccatactccgcacgaactcccggtggacgggggccctagttccacctactcctacccgaagaacgaacctaaacttccgaaacgtaacctaccggtcttttacgtttacctttaacaaaacttacggaaaaccncgtacccgttagggaacggtaaccgccggtaagtaccggaacccgaccggggtacccgttaggttaactttaacgtgggtacggcgggaaaggttaacgggtacgggttacccgggggtaaccccgtaaaccgggttaaaccggttttacccgttaccgggtaaccgttaacggttccgggggtaacccgggtttccggggttaccggggggaacccccggttaaaacgggggtaacccccggg

SEQ ID NO: 380710 - DNA, 693 bp, Homo sapiens
  misc_feature: GZ8MTXP01EQEBC.13.76.G10.1.454.CMB.2.raw
  modified_base (484)..(484): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccaggccgtgggggtccctgagctctcctgtgcagcctgtcggttcaccgtcagtcacacctacatgagcgtgggcccgcgacggcctccggaagggggaacggggcgtgggagtcgcgtttcttacttttagtttagtaggttaggtaggtagtacagtacctcccgaacacgcgtccggtgggacggggcctacttcgactactcctacaaggacgaactaacttaccgaaaacggaacctacgtacgtttcgtttaccttaanaaaacgttcgaaacgtcggtaccctaggacgacgtacccgatacggaccgtaccggtccgttagttaaacgttccgtggtacggacggaggttacgggtaacgggtcccgggggttaacccccttaacggttaaacccggtttaaccgaccggtaacgtttacgggtacggggaacccgggtttccggaaccggggggtaaaccccggg

SEQ ID NO: 380711 - DNA, 607 bp, Homo sapiens
  misc_feature: GZ8MTXP01A2WAS.13.76.G10.1.454.CMB.2.raw
  modified_base (398)..(398): a, c, t, g, unknown or other
  modified_base (434)..(434): a, c, t, g, unknown or other
  modified_base (492)..(492): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatcagccgtgggggtcctgagctctctgtgcagcctcgtggttcaccgtcagtcacacctacatgagcgtcgggtccgcgaggcgtccgaggggaggggctgggagtgcgtctcttttatatagtagtggtagtacatactccgcagtacgtccgtggacggggcctattccgacatctccagganacaaattccaaagacacgtcttgtttactacaaatnaaacgcgccgtagaaggctaccggatcgaccgaccgggccgttagtacttacgttggngaacgggaagaggttacggaccgggggacccctaaacggttaaacccgtttcacggtccttaaggtcgggaaccgggttccggttacgggggaacccgaaacgggggtaaccccg

SEQ ID NO: 380712 - DNA, 734 bp, Homo sapiens
  misc_feature: GZ8MTXP01EJC5G.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtctggaggaggcttgatccagccgtgggggtccctgagactctcctgtgcagctcgtgggtcaccgtcagtcacacctacatgagcgtggtccgcaggcctccgagggaaggggcgtggagtcgtcgttcgtttctttttattagttagttagtggttactacacttacgtcccgactacggtaacctcccgtgggacggggtcccgtaattccaacctatccgttaccaaggactaacaacttaccgaaaggtaacctacgtcttcgtttacctacaaagtacgaaactcggaccgtaggacggacgtacccggattcggaaccgtaccggggtacccgtttaggttaacccgtttacggttgggtcggaaaccgggtaaggttaaacgggacgggtttacccgggggaacccccccgtaaagggttaaaccccggtttaccgttaccgggtaaccgtttaaacggtcgggggttaaccccgggtaccgggttaccggggggtaaaccccggaacgggggttaaacccccccgg

SEQ ID NO: 380713 - DNA, 565 bp, Homo sapiens
  misc_feature: GZ8MTXP01DV0WV.13.76.G10.1.454.CMB.2.raw
  modified_base (488)..(488): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcacgcctcgtgggttcaccgtcagtcacacctacatgagcgtggtccgcgaggctcgaggggaagggctggagtgtcgtcttcttttattatagtagtggtagtacatactccgacagtcgtcgtggacgggcctagtcacatcctcagagacaattaccaaagacagtcttgttactacaaatcgaacacgtcctagacgacgccgtatcggaaactcggtccgttaggtattacgngtcgacgtaggacgtacggtcggggacccaggttaacgttcacgtcgttaggtcggacgtcggttcggggaacccgg

SEQ ID NO: 380714 - DNA, 570 bp, Homo sapiens
  misc_feature: GZ8MTXP01ANRZQ.13.76.G10.1.454.CMB.2.raw
  modified_base (452)..(452): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagctgggtccgccaggctccgaggggaaggggctggagtgcgtcttcttttatttatagtagtggtagtaccatactccgcagaactccgtgacggggccgattccacatctccagtacgacaattcccaaagaacacgtcttgtttactacaaatgaacagcctgancgccgatcgacacggccgtgtattactgtgcgtaggagacgttcggggaccccaaggttaaccttttcgacgctagtcgggaacgtcggttcggggaacccgttaagggggaaccccg

SEQ ID NO: 380715 - DNA, 682 bp, Homo sapiens
  misc_feature: GZ8MTXP01B7W94.13.76.G10.1.454.CMB.2.raw
  modified_base (464)..(464): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggtcaccgtcagtccacacctacatgagcgtcgggtcccgccgaggcctcccgaaggggaacggggccgtgggagtcggtcgtttcgtttctttttaatttagtagtagtggtaacgtacactactccgacacgtaaaccgtcggtgggacgggggaccctattaccgacctagtcctacagagacaattacaaacaacacgtcttntttacctataaatacgaaacacgttcccgaggtaacgggaacgacccggaagtcgaacccggtacggacccgtttagtagtttaaccctggtcggaaccggaagttacgggacggttcccggggtaaaccccgaacggttaaaccggtttaccaccggtaacgtacgtcgggaacccggttccggacgggggaaccccgttaaacggggaacccccgg

SEQ ID NO: 380716 - DNA, 680 bp, Homo sapiens
  misc_feature: GZ8MTXP01A7Y3C.13.76.G10.1.454.CMB.2.raw
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctcagtcgtccgtgtccccaggaccagacagccagcatcacctgctcaggaaataatggacagataaatatacttctggtatcagcagaagtcaggccagtcccctgtcgctggtcatctatcaagctagaccaaggccggaccctcgacggggtacctccccgtaggacgtcgtattcccgtcgtcggtacctacccaaacgttccgtacggggaaaccttcgaacggtaccctacttaccgtacggaaccctaacgttccgaaaccggggcccgggaaccccgaggggtacccttaagtacgggagttacgggacgggggtcttaggtaacctttacgttaacgtcggttccgaacgggttcccggtaggggtaaccacgggtaccacgggaacctaaccggttcggaccccggttcttaacgttcggttccgttaccggggaaccgttaacggggaacccgtaacggggtccctacccgggttaaccgttaacggcccgaaccccgg

SEQ ID NO: 380717 - DNA, 619 bp, Homo sapiens
  misc_feature: GZ8MTXP01E0FKQ.13.76.G10.1.454.CMB.2.raw
  modified_base (475)..(475): a, c, t, g, unknown or other
  modified_base (522)..(522): a, c, t, g, unknown or other
  modified_base (571)..(571): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtcgggtcccgccgaggcctaccgaggggaagggggctggagtgcgtctttcttttatttatagtagtggtagtacactacgtccgcacgaacctccggtggacggggccgtacttcacctacgtcctaccgaagaacgtaacaaacttccgaaaagacacgtcttagtttacctaacaaatcgaaacncggcctaggagacgaccgaatcggaaccgacggtccgtatattacgngtgaacgagaggcgttccgggggacccctaaggttaacgttcttaccgnttacgcgggtaacgtcgggttacggggaaccgaacgggggtaaccccg

SEQ ID NO: 380718 - DNA, 722 bp, Homo sapiens
  misc_feature: GZ8MTXP01DY25T.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgcttaattttaaaaggtgcccagtgtgaggtgcagcgtggtggagtcgtggaggaggcttgatccgagccgtgggggtccctgagactctcctgtgcagcctcgtggttcaccgtcacgtcacacctacatgagcgtcggtcccgcgaggcctaccggaggggaaggggcgtagggacgtcgtcgtttacttttacttttatttagttaggttaggttggtaacgttaccatacgtccgacacgtaaccgtccggtgggacgggtcctaacgttccacctactcctaccgaagtaacgaactaaacttacccgaaaacgtaaccgtaaccggtcttttacgttttacctaaactaaaaacttaaccgacgtcccgttaggggaacggacggacccgtaaagtcggaaccgtaccgggttccgttaaggtttaacttcggtggtacgcggaagtacggttacgggtacccggggaacccctaaacgggttaaacccgttacgacgttacgtaacggtacgggtaaccgttcgggacgggggacccaaacggggttcccgtaaccggg

SEQ ID NO: 380719 - DNA, 673 bp, Homo sapiens
  misc_feature: GZ8MTXP01D8189.13.76.G10.1.454.CMB.2.raw
  modified_base (371)..(371): a, c, t, g, unknown or other
  modified_base (495)..(495): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagcgtggtggagtcgtggaggaggcttgatccgagccgtgggggtcctgagactctcctgtgcagcctcgtgggtcaccgtcagtcacacctacatgacgcgtcggtccgccgacggctccggagggaggggctgggagtggcgttctttcttttagttagtagttagtgtacgtacactacncgcacgtacctccggtggacgggacctacgttccacctactcctaccaagtacgtaactaacttacccgaaaagtaacctaccggttctttacgttttaccctaacgaaaacgttcggaaaacncggtacccgtagggaacggtaccgaccgtagtaccgaccgaccgggtaccgtttagtaacgttacgtggccggaagaggaggtaccggttcggggaacccctaacggttaaccggttcaccggaattggtaacgggtacccgtgggttaccgggggaacccgaaagggggtaaccccg

SEQ ID NO: 380720 - DNA, 607 bp, Homo sapiens
  misc_feature: GZ8MTXP01DB52I.13.76.G10.1.454.CMB.2.raw
  modified_base (433)..(433): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtgggttccaccgtcagtcacacctacatgagcgtcgggtcccgccgaggctccgaggggaagggggctggagtgcgtttctttacttttatttatagtagtggtagtacctatactcgcacgaacctcgtggaggggcctacttcgacatcacagagaacaacttaccaagaacacnctttagtttactacaaatcgaacacgctaggagacgccgatccgacgacggtccgtagtattacgtggtgcggagacggtacggcgggggtaccccaacggttaaacgttccgttaacgtccgttagtcgggtaccggtacgggttacggggaacccgaacgggggtaaccccg

SEQ ID NO: 380721 - DNA, 739 bp, Homo sapiens
  misc_feature: GZ8MTXP01B4U68.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatccaggccgtgggggtccctgagactctcctgtgcacgcctcgtcgggttcaccgtcacgtacacacctacatgacgcgtcggtcccgccgaggccgtccggaggggaacgggggcgtggagtgtcgttctttactttttattagttagttaggttggttacgtacctactacgtccgacgacggtaaaccgttccgggtaacgggacgggggtcccgtacgtttacccgaacctacttaccgtacccgaaggaaccgtaaacctaaacttaccccgaaaagggtaaaccctaaccggtttctttacggtttttaaccccttaacgaaaaagttacgggaaaacctaccgggtacccgttaagggaaaccggtccggtaacccgtaagtaccggaacccgtacgggggttacccttagttaactttcgaggtcgaacggaagttaggacggttcgggaaccctaaggttaacgtttcgacgtgtacgtcgggcgttcgggacggggaacccgcggggtaaccc

SEQ ID NO: 380722 - DNA, 739 bp, Homo sapiens
  misc_feature: GZ8MTXP01CB7C8.13.76.G10.1.454.CMB.2.raw
  modified_base (525)..(525): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctattttaaaaggtgcccagtgtgaggtgcagctggtggagtctggaggaggcttgatccagccgtgggggtccctgagactctctgtgcagcctcgtggttcaccgtcacgtcacacctacatgagcgtcgggtcccgcgaggcctccggaggggaaggggcgtgggagtcgtccgttctttctttttagtttagttaggttaggttaggttaacgtaaccctacttaccgtcccgcgtaacgtaacccgttccgggtgggacggggtacccgtacgtttccccaccgtactcccgtaccaacggacgtaaaccctaagtttacccgaaaggaaccctacggtaccttttaggtttacccttaaanaaacgtacggaacgtaccgtaccgggtagggtaccgaccgaccggtaagtaccggaacccgtacggttaccgtttagttacgttacggtcggtggaacggtaaggttacgggtaccggttaccgggtaaccccgtaacggttaaaccgtttccgacgtaacgttaggtccgggtacggtccggggacggggtaaccccgaacggggtaaccccg

SEQ ID NO: 380723 - DNA, 702 bp, Homo sapiens
  misc_feature: GZ8MTXP01BIAGY.13.76.G10.1.454.CMB.2.raw
  modified_base (610)..(610): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctggttttccttgttgctatttaaaggtgccagtgtgaggtgcagcgtggtggagtctggaggaggcttgatccgagccgtgggggtcctgagactctcctgtgcagctcgtggtcaccgtcagtcacacctacatgacgcgtcgggtcccgcgtacggccgtaccggaagggggaacgggggcctaggggtacgtcggtcgttcttttacttttttaagtttagttaaggttaggttaggttacgttaacctacgttaccgtcccggacgtaacgaaacccgttccgggtcggggacggggtacccgtacttacccaacctacttccgtacccgaaggtaactaacctaaacgttcccaaaagaccgtaccggttcttttaggttacctaaacaaagttggaaaacctcggtccgtagggaacgaaccgccgtaaatccggaaaccgcggtccgttagtactttacggnggtacgaacggtaaggacggtacggccgggaaccctaaggttaacgttcgacgtgtacggtcggtacggtcgggacgggtaaccgaacggcc

SEQ ID NO: 380724 - DNA, 668 bp, Homo sapiens
  misc_feature: GZ8MTXP01DAB89.13.76.G10.1.454.CMB.2.raw
  modified_base (482)..(482): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcacgccaccctcagtcgtccgtcgtccccaggacagacagccagcactcacctgctactaggaaataagtggacaagaataaatactacttcctaggtatcagacagaacgtcaggccacgtcccctgtgctgtcatctatacaagatcgacgaacgccggccctacgaggactcccccgtggacgacgtacttccgtcgtacgggtccctaccgaaaccgttccggtacgggtaaccctcgaccgtaccctaaccgttccgtaccgaacctacgaccgacgggaccggtaccgacggtactacgtggagtagtacgggtnttacggtaacttacgttacgtacgttcggacggtcggtacggggacgtagaccgacgctaaccggtcgacccgtacgttacgttaccggttcgttaaaccgggccggttaaccggggtaacccgtaaaaccgggttccgtaaacccggttacccgttaacggtaacccgaaccggtaaacccccgg

SEQ ID NO: 380725 - DNA, 724 bp, Homo sapiens
  misc_feature: GZ8MTXP01DI4N3.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtcgggttcaccgtcagtcacacctacatgagcgtcggtccgccgaggctaccggaggggaggggcgtggagtgtcgttctttcttttatttagtagtagtgtagtaccatacgtccgcacgaaccgtcccggtgggacggggtaccctactttccgaaccctacttacgtacccgaagacggtaaacctaaacgttacccgaaaaggtaaccctaaccggttcttttacgtttacccttaaacaaacgtacgaaacgtccgtaccggtaggaacggaccgaccgtagtaccgtaaccggtaccggttaccgttagttacgtttacggtcggtacggaacgtaagggttacgggtaccgggttcccggggtaaaccccgttaacggttaaaccgttccgttaacggtcggtaagggtaaccggggtaccggtacggggttaccgggggaacccgaacggggtaaccccg

SEQ ID NO: 380726 - DNA, 659 bp, Homo sapiens
  misc_feature: GZ8MTXP01EM97I.13.76.G10.1.454.CMB.2.raw
  modified_base (251)..(251): a, c, t, g, unknown or other
  modified_base (371)..(371): a, c, t, g, unknown or other
  modified_base (471)..(471): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgcccagtgtgaggtgcagcgtggtggagtcgtggaggaggcttgatccgagccgtgggggtccctgagactctcctgtgcngcctcgtgggtcaccgtcagtccacacctacatgagcgtggtcccgcgaggctccggaggggaggggctggagtcgtcgttctttcttttattatagttagtggtagtaccatactccgnacgaaccgtcgtggacggggccctacttccaacctactcctaccgagaacgtaactaaacttacccgaaaagaaccctacgtcgtttactttacctaaanaaacgtacgaactacgtacggtagacggacgaccgaagtccggaacgtaccggttacgttagttacgttcgtggacggaacggaaggacgggtaccgggaccgggtaaccctaaacggttaaccgttacgttacggtcgtacgggtcgggtaccggtcggggacggggtaacccgaacgggtaacccg

SEQ ID NO: 380727 - DNA, 646 bp, Homo sapiens
  misc_feature: GZ8MTXP01DKJ5V.13.76.G10.1.454.CMB.2.raw
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtcgggtccgccaggcctccgaggggaagggggctggagtgcgttcttcttttattatagtagtggtacgtacatactccgcaagactccggtggacggggcctattccacctatcctaccaagacgaactaacttaccaaagaaccacgtctttacgtttacttacaaaagtcgaaaccacgggtaccctaggaacgacgacccgaagtcggaaccgtaccggggtcccgttagttaactttaccgtggtcggacggaaggacggaacgggtccgggggaaccccaacgggttaaccgttacctaacggacgttaaggtcgggacggttccggtaacgggggaacccgaaaccggggg

SEQ ID NO: 380728 - DNA, 767 bp, Homo sapiens
  misc_feature: GZ8MTXP01CKE9O.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactaaccatggagttttggctgagctgggttttccttgttgctatttaaaaggtgcccagtgtgaggtgcagctggtggagtctggaggaggcttgatccagccgtgggggtcctgagactctcctgtgcacgcctcgtcggtcaccgtcacgtcacacctacatgagcgtcgggtccgccgaggccgtaccggaagggggaacggggtcgtggggtacgtgtcgtttctttacttttttaagtttagttaaggttaggttaggttaacgtaactaacgttaccgtccgacgacgtaccgttcccgggtgggaacgggggcccttaaactttccaacccgtatacccgtacgaaacgggaactaactaaacgttaccccaaaaggaaccgtaaccggttcgttttacttttaccctaaacaaaagttcgaaaacccgacggtaccgtaagggggaacggtacgtaacccgtaagtaccggtaacccggtaccggttaccgtttagttaacgttacggtggtacggaacggtaaaggtacgggttaccgggtacccggggaaccccttaaacggtaaccgttacgttacggttcgttaagggtccggtaacccgggtcgggaaccggggaccggtaaaccggcccgtaaccg

SEQ ID NO: 380729 - DNA, 782 bp, Homo sapiens
  misc_feature: GZ8MTXP01BGO9Q.13.76.G10.1.454.CMB.2.raw
  modified_base (290)..(290): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagtttggctgagcttgggttttccttgttgcttaattttaaaaggtgcccagtgtgaggtgcagcgtggtggagtcgtggaggaggcttgatccgaggccgtgggggtccctgagacctctcctgtgcacgtcctcgtcgggtccaccgtcagtcacacctanagtgacgtcgtcgggtcccgccgaggccgtaccggaaggggaagggggccgtagggagttcggtccgtttctttacgttttttaagtttaagttaaggttaaggttaggttaacgttaacccctacgttaaccgtcccggtacgtaacgtaacccgttcccgggtaaggggaccgggggtaccctaacgtttcccaacccgtacgtccctacccgaaagaacgtaaacctaaacttacccgaaaacgtaaacccgtaccggttacttttacggttttaacccttaagaaaacgttcgaaaaccgtccggtacccggttaaggaaacggaccgaccccggtaatccgggaaccgacgggttcccgttagttacgttaccgtggtagaaccggtagacgggtacggttaccggggaacccctaacgggttaaccgttccacggtcttaagggcgttacccggtcgggttacgggaacccggaaacgggtccccg

SEQ ID NO: 380730 - DNA, 696 bp, Homo sapiens
  misc_feature: GZ8MTXP01A9V52.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagcgtgggtcccgccgaggcctaccgaggggagggggcgtggagtgtcgtctttcttttattattagtagtggtagtacatactccgcagaactccgtggacgggccgtattcgaccatctccagagacaacttccaaagaaccacgtcttagttttacctacaaaagtcgaaacgtcgaccgttggaaagtaccggacccgtaagttccggaaacccgtaccggggttacccgttaggtttaaacttaccgttgggtcggtaaccgggtaaaggacgggtaacgggttcccggggggaacccccctaaacggggttaaaaccgttttacccgttaaaccgggtccttttaacgggaacgggggtaacccgttccggggttacggggggtaacccgaaaaccgggggtaaccccg

SEQ ID NO: 380731 - DNA, 638 bp, Homo sapiens
  misc_feature: GZ8MTXP01B30X6.13.76.G10.1.454.CMB.2.raw
  modified_base (249)..(249): a, c, t, g, unknown or other
  modified_base (386)..(386): a, c, t, g, unknown or other
  modified_base (599)..(599): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctgggtggagtctggaggaggcttgatccagccgtggggggtccctgagactctcctgtncagcctcgtgggtcaccgtcagtcacacctacatgagcgtcgggtcccgccgaggcctccggaggggaagggggctgggagtgcgttcttctttttattagtagtagttggtagtaccatactcgacagaacctcgngggaggggccctagttccaccatcctaccagacgaactaacttaccgaaagacctaacgtcgtttagttttaccttaacgaaaattcggaaactacgaccggtaggaacggccgtacccgggataccggaaccgacgggtaccgttagttagttaaccgtggtgaaccgggagacggtagttccgggggaccctaacgaccgtttacgacgtntagcggtacggtcgttcgggggtaaccaagggaaccccg

SEQ ID NO: 380732 - DNA, 601 bp, Homo sapiens
  misc_feature: GZ8MTXP01EWQ63.13.76.G10.1.454.CMB.2.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcacgccaccctcagttgtcccgtgtccccaggacagacagccagcatcacctgctactaggaaataatggacagataaatatactctgtatcagcagagtcacggccacgtcccctgtgctggtcatctatacaagtactcgaccaacggccgacctacgacgggtactcccccgtggacgtcgtacttccgtcgtcgcctaccaaacgttccggtacgggtaacctcgacgccctactcgacgaccacgtacgacgggacccggaccgaggtacgtagacggatagggacggtacttaggtacttaagttaccgtgtaccgtaggcggtaggacgacgcgaacgcgtccgtcgcccgtacttacgttcgttaccggttaaccggacgttaccgggaaccgtacggtcccgaccgttacgttaacgtccgaaccgaaccccg

SEQ ID NO: 380733 - DNA, 717 bp, Homo sapiens
  misc_feature: GZ8MTXP01EJLVU.13.76.G10.1.454.CMB.2.raw
  modified_base (254)..(254): a, c, t, g, unknown or other
tcagtcacgtactacacgaccggtgctcgatttagtcactcatacaggggggagaggagcccagcactgggattccgaggtgtttccattcggtgatcagcactgaacacagaggactaaccatggagttttggctgagctgggttttccttgttgcttattttaaaaggtgcccagtgtgaggtgcagctgggtggagtcgtgggaggaggcttgatccaggccgtggggggtccctgagactctcctgtgcngcctctgggttcaccgtcagtcacacctacatgagcgtcgggtcccgccgaggcctaccggagggggaaggggcgtgggagtgcgttctttctttttatttagtagttagtggtagtacacttacctcgcaagtaccgtcccgggtggaacgggggcctaattcccaacctactctaccagagaactaaacttacccgaaaagtaaccaacgttctttacgttttaccttacaaaactcggaaaactacggccctagggggaacgaacggtacccgaagtacgaaccggaccggttaccggttagttaactttacgtggtacgcggaaggtaacggcgggtaccgggggacccctaaacgggttaaaaccgtttccgttaaaccggcgttaaacgggtcggggtaacccgggttcgggtacccggggggaaccctaaaaccggggggccccttaacccggggg

SEQ ID NO: 380734 - DNA, 631 bp, Homo sapiens
  misc_feature: GZ8MTXP01BVDQ2.13.76.G10.1.454.CMB.2.raw
  modified_base (458)..(458): a, c, t, g, unknown or other
  modified_base (526)..(526): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtctggaggaggcttgatccagccgtgggggtccctgagactctcctgtgcagcctcgtgggtcaccggtcagtcacacctacatgagcgtgggtcccgccgaggcctccggaggggaagggggctgggagtcgtcgtctttcttttatttagtagttagtggtagtaccatactccgcagaccgtccgtggacgggccgtacttccgacctatcctccagtacgactaactaccgaaagacacggtcttagtttacctaaanaaactacgaacgtacgacgtaggacgacgccgagtacgacgtacggtacgttagttacgttacgtggnggaacggaacggcggtacggttccggggaaccctaacggttaacgttaccgacgtcgtaggtaacgggtaccggtcgggttaccggggaacccgaacggggcccg

SEQ ID NO: 380735 - DNA, 702 bp, Homo sapiens
  misc_feature: GZ8MTXP01BU8BW.13.76.G10.1.454.CMB.2.raw
  modified_base (170)..(170): a, c, t, g, unknown or other
  modified_base (237)..(237): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctctatgagctgactcacgccaccctnagtcgtccgtcgtccccaggacagacagccagcatcactgctactagaaataagtgacagataaatntacttctgtatcagcagagtcaggccacgtccctgtgctggtcatctatacaagatcgacaacggccggacctacgacgggtacctccccccgtaggacgtcgtacttctaaccgtcgggtcctaccgaacgtccgtacgggtaacctcgacgtccctacgtctacgacctacgtaccgacgggaccccgggaaccgtagggtacgtacggtaggtaagtacgggtacgggtcttaacgggttaactttaacgttaccgttaggtccgggtacggggtacgggtacggggaactacgggaccgaacggccgtaacccgtccgggttaccccgttacgttacgttaccgggttacccgtttaaccggggaaccgttaccgggggtaaaccccgtaacgggtttaaccccgtaaaccccggttacccgttaaaccggtaacccgaacccgggtaaaacccccccggg

SEQ ID NO: 380736 - DNA, 554 bp, Homo sapiens
  misc_feature: GZ8MTXP01EGC6C.13.76.G10.1.454.CMB.2.raw
  modified_base (252)..(252): a, c, t, g, unknown or other
  modified_base (297)..(297): a, c, t, g, unknown or other
  modified_base (452)..(452): a, c, t, g, unknown or other
  modified_base (492)..(492): a, c, t, g, unknown or other
  modified_base (496)..(496): a, c, t, g, unknown or other
  modified_base (500)..(500): a, c, t, g, unknown or other
  modified_base (530)..(530): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccaggccgtgggggtccctgagactctcctgtncagcctgtgggtcaccgtcagtcacacctacatgagcgtggtccnccgaggctccggagggggaagggctgggagtgtcgttcttatttttattagtagtagtggtatacatactcgacagccgtcgtggacggggctattcactattccacagacgaactaattaccaaagacacgtcttgttactacaaatcgaacgngcctagagaacgccgatcgaacgcgtcggttattattcgngcgngagngacgtcgggaccttacggttaattccacgntagcggacgttcggcggggaaccg

SEQ ID NO: 380737 - DNA, 724 bp, Homo sapiens
  misc_feature: GZ8MTXP01AJNZ8.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcacccgtcagtcacacctacatgagcgtcgggtcccgccgtaggcctaccggagggggaagggggctgggacggttgccggttctttctttttaatttagtaggttagtggtagtacccattactccgcacgaacgtccggtggacgggggccgtattccaacctatctcccaagtaacgactaaacttacccaaagaacctacggtctttcggttttacctaacgtaaaatcggaaaccctagccccgttaggaacggacgaccccggtaatcgggaacccgaacggggtccccgttaggttaactttacgtgggtacggaaccgggaaggttacgggacggttacccggggggaccccctaacgggttaaaacccgtttttcgaaccccggtcttagggtaacggggtaacccggttcccggggttaacggggggtaaccccgaaacggggggtaacccccg

SEQ ID NO: 380738 - DNA, 685 bp, Homo sapiens
  misc_feature: GZ8MTXP01AHICR.13.76.G10.1.454.CMB.2.raw
  modified_base (520)..(520): a, c, t, g, unknown or other
  modified_base (538)..(538): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccgagccgtgggggtccctgagactctcctgtgcagcctcgtggttcaccatcagtcacacctacatgacgcgtcgggtccgccgaggccgtaccgagggggaacggggcgtgggagtcggtcgtttcgtttactttttatttagttaggttaggttaggttacgttaactattacccgtccggacaaacggtaccgttcccggtagggacgggggtacccgtactttccaaccgtactccctaccgaaggactaactaacgttaccaaagaacctacggtcttcgtttactacaaatcgaaacncggcgtagaagacgcgancgacgacggtccgttgttaacttcgtggtcgcggaggaacgttacgggtaccgggggtaaccccaacggttaaacccgttactaaccgggtcttaacgggtcgggaaccgggttccgggtaacgggggaaccccgtaaaaccggggg

SEQ ID NO: 380739 - DNA, 701 bp, Homo sapiens
  misc_feature: GZ8MTXP01AJG3X.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccggtgggggtccctgacgtactctctgtgcacgctcgtcggtcaccgtcacgtcacacctacatgacgcgtcgggtcccgccgacggtccgtaccggaaggggaacgggggcgtagggagtcggtcgttctttcttttattagtagtagtagtacgtaccactctccgcacgtaaccgtcggtggacggggcctattccgactactctaccgagtacgaactaacttaccgaaagaaccagtctttagtttactactaaacgtcgaacacgtccgtagagtacgaccgtacgtacgacccggccgggtaccgttagtaacgtttcgcgggtacggaacggaaggttcggggtaacggttccgggggtaaaccccgtaagggttaaccccgtttacggttaaccgttcccgtaaggggtccgggttaacccgggttaccgggggttaccggggaaccccgggttaaacgggggtaacccccg

SEQ ID NO: 380740 - DNA, 585 bp, Homo sapiens
  misc_feature: GZ8MTXP01BBM7C.13.76.G10.1.454.CMB.2.raw
  modified_base (515)..(515): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtcgtcccgtgtccccaggacagacagccagcatcacctgctctaggaaataattggacagataaatatacttctggtatcagcagaagtcaggccagtcccctgtcgctggtcatctatcaagatcgccaagccggccctagacgggactccccccgtggacgtcgtacttccgtacgtcgggtcctaccgtaaacgttcgtacggggaactcgaacgtcccacttctacgaccacgtcgacgggacccgggaccccagggtcctagtcgggaatggaacggtctaggtaacttagttacgtagtcgagggcggtagggactaggcacgcaacgtcgcccgtnttagtcgtacgttacgggacttcggggaacctacggtcctaccgtaccgttaacgtccgaacgaaccccg

SEQ ID NO: 380741 - DNA, 591 bp, Homo sapiens
  misc_feature: GZ8MTXP01C5WN3.13.76.G10.1.454.CMB.2.raw
  modified_base (421)..(421): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccacctcagtgtccgtgtccccaggacagacagccagcatcacctgctactaggaaataaattggacagaataaatatacttcctggtatcagcagaagtcaggccacgtcccctgtcgctggtcatctatacaagatcgaccaacggccggccctcgagggactccccccgtggacgcgtacttctcgtcggcctaccaaactcgtacgggaacctcacgcccactctacgaccatcgacggccgggaccaggctagnggataggacggcgtacgtaacttagttacgtgtcgaacgggtcggtaacgggacctagacgacgcgtaaccgtcgcccgtcttacgtcggttccgttaccgggacggttacgggaacccgtaaacggtcccgtaacccggttaccgttaacgtccgaaccgtaaccccgg

SEQ ID NO: 380742 - DNA, 717 bp, Homo sapiens
  misc_feature: GZ8MTXP01BG1I2.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtctggaggaggcttgatccagccgtgggggtccctgagactctcctgtgcagcctcgtgggttcaccgtcagtcacacctacatgagcgtcggtcccgccgaggcctaccggaggggaaggggcgtgggagtcggtcgtttcttcttttatttagttagtagtggtaagtaccatacgtccgcacgaacgtccggtggacgggcccgtattccacctacgtcctacccgaagaacgtaacctaaacttacccgaaaaggtaaccctaccggttcctttaggttttacccctaaaacgtaaaacgtacgaaaccgtacgtaccggtaggaaccggaccgaccgtaagtaccggaaccgtacgggtaccgttagttaaccgttacgtcggtacgggaacggtaaggacgggtaccgggacccggggtaaacccctaaacgggttaaccgttacgttaccggtaacgttacggtccggggtaccggtcggggttaccggggtaaccgaaaccggggtccccg

SEQ ID NO: 380743 - DNA, 621 bp, Homo sapiens
  misc_feature: GZ8MTXP01AUKLG.13.76.G10.1.454.CMB.2.raw
  modified_base (276)..(276): a, c, t, g, unknown or other
  modified_base (428)..(428): a, c, t, g, unknown or other
  modified_base (438)..(438): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttcctgttgctattttaaaggtgcccagtgtgaggtgcagctggtggagtctggaggaggcttgatccagcctggggggtccctgagactctcctgtgcagcctctggggtcaccgtcagtcacacctanatgagcgtgggtccgccaggcctccgaggggaaggggctggagtgcgtcttcttttatttatagtagtggtagtaccatactccgcagaacctcgtggacgggccgattcacatctcagagacaatccaaagacacgtcttagtttcctaanaaatcgaacncgccgtaggacgacgacgatcggaccgtacggtaccgttagttaacgttacgtgggtcggaacggtaaggacgggtaccgggttaccggggtaaccccctaaacggttaaaccggtttccaaccggtcgtaaggtccggggtaccgtaccggggttacgggggaacccgaaacggggtccccg

SEQ ID NO: 380744 - DNA, 631 bp, Homo sapiens
  misc_feature: GZ8MTXP01BONE4.13.76.G10.1.454.CMB.2.raw
  modified_base (256)..(256): a, c, t, g, unknown or other
  modified_base (304)..(304): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagtcttgggttttccttgttgcttaattttaaaaggtgcccagtgtgaggtgcagcgtggtggagtcgtggaggaggcttgatccaggtccgtgggggtccctgacgactctctgtgcngcctcgtgggttcaccgtcagtcacacctacatgagcgtcgggtcccncgaggcctccgaggggaaggggctggagtgcgttcttctttttattagtagtagtggtagtaccatactcgcagtaacctccggtggacggggcctattccacatctaccagagactaatccaaagaccacgtcttagtttactaacaaatcgaacacgcctaggaagcgaccgtagtcgacgaccggtccgttagttacgttacgtggtggaacgtaaggacggacggttccgggggaaaccctaacggttaaaccggtttcgaacgtccgtaaggttcgggtacggtaccgggttacggggaacccgttaagggggtaacccccg

SEQ ID NO: 380745 - DNA, 851 bp, Homo sapiens
  misc_feature: GZ8MTXP01BLF7J.13.76.G10.1.454.CMB.2.raw
  modified_base (322)..(322): a, c, t, g, unknown or other
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtcgtgggaggaggtcttgacttccgaggtcccggttcgggggggtcccctggacggtaccttctcccgtggtcgcacgtcctcgtggttccacgtcagtcacacctacagtgacgcgtggtccncgaggccgtaccggagggggaacgggggcgtagggacggttcggtcgtttccgttttacttttttaagtttaagttaaggtttaggttacgggttaaacgttaacgtaacgttaacccgtacccgtaccgtaaacggtaaacccgttcccgggttaggggaacccgggggtaccctacgttaccccgaactaccgtcctacccgaagaaccgaactaaacgttacccgaaacgtaaacctaacggttctttacgtttaccttaaacgaaaacgttacgaaaccgttacggaccgtttaacggaacggaaccggtaccgaaagttccggaaaccgtacccggggttaccgttaaaggtttaaccgtttaaagtccgggttaacggaacgggttaaagggtaaacggaccgggtttaaaccgggggaacccccttaaaacgggtttaaaccgttaccggttaaccgtacgtttaacggtaccggggtacggttaccggggtaacgggggaacccggttaaaaccccggggg

SEQ ID NO: 380746 - DNA, 703 bp, Homo sapiens
  misc_feature: GZ8MTXP01DAPDT.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtcgggggtcctgagactctcctgtgcacgcctcgtcgggttcaccgtcagtcacacctacatgacgcgtcgggtcccgccgacggccgtccggaggggaacgggggcgtgggagtcgtcgttctttcttttattagtaggtagtggtagtacatacctccgaacacgccgtcggtgggacggggccgtattcacctactccctacaaggtacaactaacttacccgaaaacggaacctacgtctttcgtttacctaacaaagttcgaaacgacgtcccgtaggacgaacgtcccgagttacgaaacccgtccgggtccgtagttaactttacggtggtcggaccggaaggttagggtaaccgggttacccgggggaaacccccttaaacgggttaaacccggtttaacgtaacccggtcgtttaacgggtaccgggggttaccggttccggggttaacccggggggtaaaccccggg

SEQ ID NO: 380747 - DNA, 686 bp, Homo sapiens
  misc_feature: GZ8MTXP01AW2IJ.13.76.G10.1.454.CMB.2.raw
  modified_base (481)..(481): a, c, t, g, unknown or other
  modified_base (555)..(555): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagtacctctcctgtgcacgcctcgtgggtcaccgtcagtcaccacctacatgacgcgtcgggtccgccgacggccgtcccggaggggaagggggcgtgggtagtcggtcgttctttctttttaatttagttagtaggttggtagtaccactactaccgcacgtaaccgtccggtggacggggcctacgttccacctactcctccaagagaactaattaccgaaataacacgtcttgtttaccttaanaaacttggaacacggtaccgtaggacgacgacccggatcggaacccgcgggtacccgtagttacgtttaacggnggtaggaacggaaggacgggtaccggttcccggggtaaacccgtaaccggttaaccggttccgttacggtaacgttacggtccggggtaccggtacggggttacccggggaaccggaaccggggtaacccg

SEQ ID NO: 380748 - DNA, 649 bp, Homo sapiens
  misc_feature: GZ8MTXP01C1D1V.13.76.G10.1.454.CMB.2.raw
  modified_base (288)..(288): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgcttattttaaaaggtgcccagtgtgaggtgcagcgtggtggagtcgtggaggaggcttgatccgagccgtgggggtccctgagactctcctgtgcacgcctcgtggttcaccgtcagtcaacacctanatgacgcgtcgggtcccgccgaggccgtaccggagggggaacggggcgtgggagtcgtcgttctttactttttattagttagttaggtcggttagtactataccgtccgaacacgtccgtcggtagggacggggcctatccactactctaccagaagactaaacttaccaaagaacacgtctttagtttactaacaaagtcgaaacacgtccgtagacgacgacccgaagtacggaaccgtcggtaccgttagttaacgtttcgtggtgacggagaagggtacggtaccgggggacccaaacggttaacgttaaccgacgtaacgtaggtcgggttaaccgtcgggttaacggggaacccg

SEQ ID NO: 380749 - DNA, 650 bp, Homo sapiens
  misc_feature: GZ8MTXP01DSPKO.13.76.G10.1.454.CMB.2.raw
  modified_base (194)..(194): a, c, t, g, unknown or other
  modified_base (238)..(238): a, c, t, g, unknown or other
  modified_base (250)..(250): a, c, t, g, unknown or other
  modified_base (262)..(262): a, c, t, g, unknown or other
  modified_base (381)..(381): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcgtggtttcgtgtagctattaaaaggtgccagtgtgaggtgcagctggtgagtnggaggagcttgatccagccgtgggggccctgagctctctgtgcngctgtgtcactnacgtcacacagngtgacgtcgtcggccgacgagtcgacggaagggacgggtctaggtgtcgtcgtttactttattttagtagtacgtagtacgtaactaccgtactaccgtcgacgtacgtaaccgtcggnggtaccgggtaccctaactacctaaccgtactacgtaccgaagactaactaaactaacgtaacgtaacgtacgtacgttacgttacttaactaacgtaacgtaacgtacgtacggtacgtacgacgtacgacgtacgacgtacggtacgtcgttacgttacgtcgtcgaacgacgacggtacggaccggtaaccgtaacgttaaccgttacgttacgtaacgtacgtaacggtacggtacggttaccgggtaaccggaaccggtaaccg

SEQ ID NO: 380750 - DNA, 680 bp, Homo sapiens
  misc_feature: GZ8MTXP01CFBDB.13.76.G10.1.454.CMB.2.raw
  modified_base (247)..(247): a, c, t, g, unknown or other
  modified_base (250)..(250): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgngcngcctcgtggttcaccgtcagtcacacctacatgagcgtcgggtcccgccgaggcctccggaaggggaaggggcgtagggagtcgtcgtttcctttctttttaatttagttaggttaggttggtaagtacctactacgtccgtacacgaaccgtccggtgggacggggccctagttccaccgtactcctaccgagacgaactaacttaccaaagacaacgttcttagtttactacaaagtcgaaactacgccgttaggaacgtacgaccgactacgaccgacggtccgttagttaacttacgtggtcggaacggtaggaacggtacggttaccggggaacccctaacggttaaacccgtttacgaccgtaaccgttagggtcgggtaacccgttcgggaaccgggggaacccggaaacccggggtaacccg

SEQ ID NO: 380751 - DNA, 706 bp, Homo sapiens
  misc_feature: GZ8MTXP01BRAF2.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgcttattttaaaaggtgcccagtgtgaggtgcagcgtggtggagtcgtggaggaggcttgatccgagccgtgggggtccctgagactctcctgtgcagcctcgtcgggtcaccgtcagtcacacctacatgacgcgtcggtcccgcgacggcgtccggaggggaaggggcgtgggagtcgtcgtttctttactttttagtttagtaggttagtggtagtacctactacctccgacacgaaccgtccggtgggacggggtcccgtacttccaaccctagttacctaccaaggacaacctaacgttaaccgaaagtaacccaacgttctttacgtttaacctaacgaaagtacgtaaaccacgtacccggtaggaacgaacgtaccccggaataccggaacccgtaccgggtacccgttgtaactaccgtaccgttggcggaacggaggacggttacggtacccgggggaaccccttaacgggttaaaccgttaccgtaacggtacgtaacggtcgggtaccgttcgggtcggggaacccgtaaacccgggg

SEQ ID NO: 380752 - DNA, 602 bp, Homo sapiens
  misc_feature: GZ8MTXP01C1PSZ.13.76.G10.1.454.CMB.2.raw
  modified_base (337)..(337): a, c, t, g, unknown or other
  modified_base (451)..(451): a, c, t, g, unknown or other
  modified_base (491)..(491): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgacgactctcctgtgcagcctcgtgggtcaccgtcagtcacacctacatgagcgtcgggtccgcgaggctccggaggggaacggggctaggagtgcgttctttntttatttatagtagtggtacgtaccatactccgacagaacctcggtggacggggcctattccaccatctccagacaacatccaaagacacgtacttgttactacaaatgaaacncgcgtagacgacgacgatcgacgtaggttcgtgtattcgngtgaacgaggacggtacggttaccgggtaacccgtaacggttaaaccgttcttaaccggtcgttaaggtcgggtacggtcgggttacggggaacccggaacgggtaacccg

SEQ ID NO: 380753 - DNA, 718 bp, Homo sapiens
  misc_feature: GZ8MTXP01CFW7L.13.76.G10.1.454.CMB.2.raw
  modified_base (637)..(637): a, c, t, g, unknown or other
  modified_base (682)..(682): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctatttaaaggtgccagtgtgaggtgcagcgtggtggagtcgtggaggaggcttgactccgaggccgtgggggtccctgacgacctctcctgtgcacgtcctcgttgggtccaccgtcacgtcacaccacatgacgtcgtcggtcccgccgacggtccgtaccggaaggggacgggggcgtagggtacgtcggtccgtttctttacttttagtttagttagtagttaggtagtaccctacgtactccgacgtacgtaaacccggttccggtaagggacggggtacccgtattacccgaacccgtaactccgtacccgaaggtaacgtaaacctaacgttaacccgaaacgaaacgttaaccgttcttttaacggtttaccttaaccgaaagtaacggtaacgtaaccggtaccggttaggaacggtaccgtaccggaacgttacggaaccccgtaggtacccggttattaccgtagtggnggaacgaggaggtacggccggggaaccacgttaacgttcaccgtnaggtcggacggtggacgggaaccgaacggtaacccg

SEQ ID NO: 380754 - DNA, 567 bp, Homo sapiens
  misc_feature: GZ8MTXP01BBQT2.13.76.G10.1.454.CMB.2.raw
  modified_base (233)..(233): a, c, t, g, unknown or other
  modified_base (264)..(264): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagaggtcaccatctctgcactgggancagctcaacattgggcacattatgatgtacnctaggtaccagcagtttccaggagcacggtcccagtacctcctcatacaataacgtaacaaacgaagtccggcccgacgacggggtccctggacccgtattcctcgtcggctccgaggtctcggcaccgtcacgtccctcccgtcgtcactcacgtcggcgtccggaggtccgtgaggtagtggacggtcttaggtactttagtttcgtacgtcccgtaagttcccttagttccgacgtacgccgacgttccgttagtgtcgtcgtttcgggtacggttccggggccgggggccctaaccggg

SEQ ID NO: 380755 - DNA, 591 bp, Homo sapiens
  misc_feature: GZ8MTXP01COPTX.13.76.G10.1.454.CMB.2.raw
  modified_base (279)..(279): a, c, t, g, unknown or other
  modified_base (506)..(506): a, c, t, g, unknown or other
  modified_base (517)..(517): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtggttcaccgtcagtcacacctanactgagcgtggtccgccaggctccgaggggaaggggcgtaggagtcgcgtctttcttttatttatagtagtggtataaccgatactccgcagaacctcggtggacggggcctattcaccattcacccagagaactaacgttccaaaggaaccacgtcttgtttactacaaatacgaaacacgcgttgaagacgccgaagtcgaaccgtcggacccgttgtaattacngtgcggtaagngtacggttcgggacccacgttaaacgttcacgtaactagtcggcgtcggttcgggaaccgaacgggaaccccgg

SEQ ID NO: 380756 - DNA, 639 bp, Homo sapiens
  misc_feature: GZ8MTXP01C1EEO.13.76.G10.1.454.CMB.2.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcactgctctaggaaataatggacagataaatatacttctgtatcagcagagtcagccacgtcccctgtgctggtcatctatacaagtatcgaccaaggccgccctagacggggactcccccgtggacgtcgtacttctcgtcggctaccaactcgtacgggaacctcgacgtccctacgtcgtacgaaccctagtaccgacgggacccgggaaccccgtagggtaccgttaggtacgggtagtagggaaccgggtcgttaacggtaacctttaagtttaccggttaggtaccgaaggggtccgggtacggggacctacgggccaaggcccgtaacgtccggccccggtattacggtcgttaccggttcggaacggttcgggtaaccgaaacggttcccgacccggttacttaaccgttccgaaccggtaaccccgg

SEQ ID NO: 380757 - DNA, 649 bp, Homo sapiens
  misc_feature: GZ8MTXP01BNHJ7.13.76.G10.1.454.CMB.2.raw
  modified_base (237)..(237): a, c, t, g, unknown or other
  modified_base (261)..(261): a, c, t, g, unknown or other
  modified_base (407)..(407): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagcccgccctcagtgtcgtcggggccccagggcagaggtcaccatctctgcacgtgggancagctcaacagttgggcacattangatgtacacgtggtaccagctagtttccaggtagcacggtcccagtactcctcatacgaataacgtaaacaaacaacgtcccggacccgaccgtacggggtccctaggacccggtatttccgtcgtacgggccttcccgaggttcncgggaccaccgtcacgtccccgtcccttcggtcctactccgtacgtcgggtccgtaccggacggtccgttaggaacggtaagtcggacgggtccgttaggttactttaacgtttccgtacgtacccgtaacgggttccttacgttcgaacgtacgtccgaacggttcccgttaggtaacgttcggtccgtttacgggggtacgggttccgggggtaacccggggggttaacccgtaaccggg

SEQ ID NO: 380758 - DNA, 725 bp, Homo sapiens
  misc_feature: GZ8MTXP01DDUBO.13.76.G10.1.454.CMB.2.raw
  modified_base (606)..(606): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatccaggccgtgggggtccctgacgactctcctgtgcagcctcgtgggttcaccgtcagtcacacctacatgagcgtcgggtcccgcgaggccgtaccggaggggaacgggggcgtgggacggtcgtcgtttcttttactttttaagttttagttaggttaggttggttaacgttaaccctacttaccgtccgactaacggtaacccgttccgggtgggacgggggtccctaaactttccaaccctacttacctacccgaaagtaacgaactaaacttaccgaaagaaacctacgttctttagttttacctaacaaaagtcggaaaactcgtaccgtaggaacgtacggacccgagtaccggaccgtacgggtaccgttagttacgttacgnggttaggaacgtaagggaggtacggttccgggggtaaccctaacggttaaacgttccgttaacgtcgtaaagtcgggtaacggtcgggttacgggggaaccgttaaacggggaaccccg

SEQ ID NO: 380759 - DNA, 748 bp, Homo sapiens
  misc_feature: GZ8MTXP01AHU5W.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtcgtggaggaggcttgatccgaggccgtgggggtccctgacgactctctgtgcagcctcgtggttcaccgtcagtcacactacatgagcgtcggtccgcgaggcgtacgaggggaggggcgtaggagtcgtcgttctttacttttattagtagttaggtgtagtaccatacgtccgcagtaccgtcggtggcgggccgtacgttaccaccgtactcctaccgaagtaacgtaaacctaaacgttacccgaaaacggtaaccctaccgggttactttacggtttttaacctaaaccgtaaaaagtacgaaaccgtaaccggcccggttaagggaaccggtaaccggacccggtaaagttacggaaccggtacccggggtttaaccgttggttaacgttaccgtgggttaacggaacgggtaaacgggttaaacgggtccccggggaaaccccgtaaaacggttaaccgttaccgttacggttcgttaaggtacgggtaaccggttcggggtaacccggggacccgtaaacggggaaccccgtaacccggg

SEQ ID NO: 380760 - DNA, 648 bp, Homo sapiens
  misc_feature: GZ8MTXP01BVUZX.13.76.G10.1.454.CMB.2.raw
  modified_base (374)..(374): a, c, t, g, unknown or other
  modified_base (423)..(423): a, c, t, g, unknown or other
  modified_base (460)..(460): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtctggaggaggcttgatccagccgtgggggtccctgagactctcctgtgcagcctcgtgggttcaccgtcagtcacacctacatgagcgtcgggtcccgccgaggcctacccggagggggaagggggcgtgggagtgtcgtctttcttttattatagtagtggtatacatactccgnacgtaactcccggtgggacggggaccgtacttcacctatcctaccaganacaacttccaaagacaacgtcttacgtttacctaaanaagtacgaacgtcgtcggtaggacgacgacgagtacggaccgtacggtacgttagttaacttcggtcggtggaacggtaggacggtacgggttcccgggaaacccctaacggttaaacccgttcgttaccgtaagttacgggtcgggtaccggtcgggttacggggaacccggttaacgggtaacccg

SEQ ID NO: 380761 - DNA, 625 bp, Homo sapiens
  misc_feature: GZ8MTXP01BXVXC.13.76.G10.1.454.CMB.2.raw
  modified_base (464)..(464): a, c, t, g, unknown or other
  modified_base (532)..(532): a, c, t, g, unknown or other
  modified_base (576)..(576): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtcgggttcaccgtcagtcacacctacatgagcgtgggtccgccgaggcctccgagggaaggggcgtggagtgtcgtcttctttttattagtagtagtggtagtaccatactccgcagaaccgtccggtggacggggcccgactttccgacctactcctcccagacgaacctaattacccaaaggaaccacgtctttagtttaccttaanaaagttcgaaacacggtccgtaggaacggtcgacccgatcggaaccgcgggtccgttagtatttacgngtggcggaagagggtacgcgggggaccccaaggttaaccgttcncgtaacgtagtcgggacgtcggttcggggaaccgaacggggtaaccccg

SEQ ID NO: 380762 - DNA, 650 bp, Homo sapiens
  misc_feature: GZ8MTXP01D3613.13.76.G10.1.454.CMB.2.raw
  modified_base (276)..(276): a, c, t, g, unknown or other
tcagtcacgtactacacgaccggtgctcgatttagtcactcatacaggggtgggagaggagcccagcactgggattccgaggtgtttccattcggtgatcagcactgaacacagaggactcaccatggagttttggctgagctggtttcttgttgctatttaaaaggtgccagtgtgaggtgcagctggtggagtcgtggaggaggcttgatccagccgtgggggtccctgagactctcctgtgcagcctcgtggttccacgtcagtcacacctanactgagcgtgggtcccgccgaggctccggagggggaacggggcgtaggagtgccgtttcttctttttattataggtagttggtacgtactataactccgcaacgacgtccggtggacggggccattcacgatctacagaacgactaacgttaccaaagaaacctcgttcttacgtttaccttaacaaattacgaaaccgtacggtacccgtagggaaagccggacccgagttacggaacccgtaacgggtccgttagttattaccggttgaaggtaccgaggacgttacgggtaccggggaacccttacggttaacgtttaacgaacggtccttaagcggggacgttcggtaaccgggggaacgaaacccgggg

SEQ ID NO: 380763 - DNA, 759 bp, Homo sapiens
  misc_feature: GZ8MTXP01EHFXH.13.76.G10.1.454.CMB.2.raw
  modified_base (628)..(628): a, c, t, g, unknown or other
tcagtcacgtactacacgaccggtgctcgatttagtcactcatacaggggtgggagaggagcccagcactgggattccgaggtgtttccattcggtgatcagcactgaacacagaggactcaccatggtagttttggctgagcgtggttttccttgttgctatttaaaaggtgccagtgtgaggtgcagcgtggtggagtcgtggaggaggcttgatccgaggtccgtgggggtccctgacgactctcctgtgcacgtcctcgtcgggtccaccggtctacgtcaaccacctacagtgagcgtcgggtacccgccgaggccgtccggaagggggaacgggcgtgggagttcgtccgtttcttttactttttagtttaagtagttaggttacggtaacgtaacacttaaccgtccgacgaacgtaccgtccgggtaggggaccggggtccctaatttcccgaaactcttaccctaccgaaaggaactaaacctaaacgttaacccgaaaaggtaaaccctcgtcttttacgtttactaaacaaaacgtgaaaccgacgggtccgtaggaacggacgaacccgtagtacgtacggaaccggggttcctttaaggttacctttaacggggnggtaacggacggttaaagggtacggttaccggggtaccccgggtaaacccttaaacggttaaccgttacgtaacgtacggttaacgggtccgggtacgggttccgggtaaccgggggaaacccgaaccggg

SEQ ID NO: 380764 - DNA, 648 bp, Homo sapiens
  misc_feature: GZ8MTXP01EYDNS.13.76.G10.1.454.CMB.2.raw
  modified_base (503)..(503): a, c, t, g, unknown or other
  modified_base (549)..(549): a, c, t, g, unknown or other
  modified_base (556)..(556): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgtcttattttaaaggtgcccagtgtgaggtgcagcgtggtggagtcgtggaggaggcttgatccgagccggtcgggggtccctgagtactctcctgtgcacgcctcgtgggtccaccgtcagtccacacctacatgacgcgtcgggtcccgccgaggccgtaccggaggggaacgggggcgtggtacgtcgtcgtttcttttagtttttaagtttagtaggttagtaggttactacctactacgtccgacgaccgtaaccgtcgggtgggaccggggtactacgtaccactactcctacgagtaacactaacgtacaaagactacgttcgtttacttacctaaaanaacgacgaacgcgtacggagacgacgacgagacgacgtcgtagttntagtcgngagaagaggttacgaccggttacccgaaccgtaaacgttacgttacgacgtaacgtaggtccggtacggtcgggaccggtaacgccggaacc

SEQ ID NO: 380765 - DNA, 679 bp, Homo sapiens
  misc_feature: GZ8MTXP01BIJM4.13.76.G10.1.454.CMB.2.raw
  modified_base (291)..(291): a, c, t, g, unknown or other
  modified_base (307)..(307): a, c, t, g, unknown or other
  modified_base (564)..(564): a, c, t, g, unknown or other
  modified_base (577)..(577): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcgtggtttctgttgctatttaaaggtgccagtgtgaggtgcagcgtggtggagtcgtggaggaggtcttgactccgaggtccggtgggggtccctagacgtactctccgtgtgcagtcctcgtcgggttccaccgtcacgtccacacctanatgacgcgtcggcccncgaggcgtcggaggggacgggtcgtaggagtcggtcgttcgtttattttagttagtagttaggtgtacgtaccactcgtccgacacgtaccgtccggtgggacgggtcctacttccaacctcgtcctaccgagaacgtaacctaacgttaccaaagtaccgtaaccgttcttttacgttactaacaaaatcggaaaactccggtacggtaaggtaacggacgttaccccgtagaccgaaaccgtcgggtaccgtttntaagtttaccggnggacggaacgaggttacggtacggaccggtaaccctaacgttaaccgttcacgtaagtacggtcggtacccggtcggttaccgggaaccgttaacggaaccg

SEQ ID NO: 380766 - DNA, 549 bp, Homo sapiens
  misc_feature: GZ8MTXP01A9TBQ.13.76.G10.1.454.CMB.2.raw
  modified_base (325)..(325): a, c, t, g, unknown or other
  modified_base (359)..(359): a, c, t, g, unknown or other
  modified_base (370)..(370): a, c, t, g, unknown or other
  modified_base (483)..(483): a, c, t, g, unknown or other
  modified_base (514)..(514): a, c, t, g, unknown or other
tcagtcacgtactacacgaccggtgctcgatttagtcactcatacagggggagaggagcccagcactgggattccgaggtgtttccattcggtgatcagcactgaacacagaggactcaccatggagttttggctgagctgggttttccttgttgctattttaaaaggtgcccagtgtggggtgcagctggtggagtctggaggaggcttgatccagccgtgggggtccctgagactctcctgtgcagcctctgggttcaccgtcagtcacacctacatgagctgggtccgccaggctccgaggggaagggctgggagtgcgttntcttttatttatagtagtggtagtacatactcgnagactccgtgnggggccattcaccatctccagacgactaattaccaagaaccacgccttagtttactacaaatgaaacagcctaggagagccgatcgacacggcctgtattacgtgtgcgaagngagtcggggccaacgaacgttcacgctaagnggaacgtcgtcggggaccaagggcccgtaaccggg

SEQ ID NO: 380767 - DNA, 624 bp, Homo sapiens
  misc_feature: GZ8MTXP01C36K7.13.76.G10.1.454.CMB.2.raw
  modified_base (329)..(329): a, c, t, g, unknown or other
  modified_base (434)..(434): a, c, t, g, unknown or other
  modified_base (466)..(466): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatcagccgtgggggtccctgagactctcctgtgcagcctcgtgggttcaccgtcagtcacacctacatgacgcgtgggtccgcaggcctccgaggggaaggggctaggagtgcgttntttctttatttataggtagtggtagtaccatactcgcagaaccgtcccgtggacgggggcctattcaccatcctaccagtagaactaaacttccaaaggtaaacncggtacttggtttcttaccaaatcggaaaccncgtacgtagaacgacgaccgaagtcgacgtacggtccgtagtacgttacgtgtaggaagaggacgacgggttccggggaacccctaacggttaaccgttccgttacgtaacgtacggtcgggtaccgtcgggttacggggtaacccgaacgggtcccg

SEQ ID NO: 380768 - DNA, 596 bp, Homo sapiens
  misc_feature: GZ8MTXP01ER9I5.13.76.G10.1.454.CMB.2.raw
  modified_base (302)..(302): a, c, t, g, unknown or other
  modified_base (417)..(417): a, c, t, g, unknown or other
  modified_base (470)..(470): a, c, t, g, unknown or other
  modified_base (511)..(511): a, c, t, g, unknown or other
  modified_base (513)..(513): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcgtgggtttccttgttgctatttaaaaggtgccagtgtgaggtgcagcgtggtggagtcgtgggaggaggcttgactccaggtccggtggggggtccctgacgtactctcctgtgcacgcctcgtgggtccacgtcagtcacacctacatgagcgtcggccncaggctaccggaggggacggggctggagtcgtcgttactttacttttattatagtagttggtataccatactcgacacgaactccggtggacgggtcctattccacctattaccncagaacaactaacttacaaagaacacgtctttactttacaaataactagaacncgacgtagacgacgacgagacgacgtacggtctagtatcgngngaacgagaggtcggttcgggaacctaacggttacgttcgacgtcgtaggtcggtacggtcgggacgggtaaccgaacggtccg

SEQ ID NO: 380769 - DNA, 603 bp, Homo sapiens
  misc_feature: GZ8MTXP01AXED1.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtcctgagactctcctgtgcagcctcgtgggtcaccgtcagtcacactacatgagcgtggtccgcaggctccggagggaggggctggagtcgcgttcttcttttattatagtagtggtagtaccatactcgcagaacctcggtggacggggtccattcactatctaccagagactaatccaaagtacacgtcttagttactacaaatcgaaacagccgtagaacgacgaccgatcgacgacggtccgtgtacttacgtgtggaacggtaagacgggtacggttccgggggaacccctaagggttaaaccgtttccgaccgtggtaacgtcggggaccgtcgggttacgggggaacccgaaacgggggtaaccccg

SEQ ID NO: 380770 - DNA, 809 bp, Homo sapiens
  misc_feature: GZ8MTXP01EXMD9.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctattttaaaaggtgcccagtgtgaggtgcagcgtggtggagtcgtggaggaggtcttgatccgaggccgtcgggggtccctgacgtactctcctgtgcacgtccgtcgttgggttccaccgttcacgtaccaccacctacatggacgtcgtcgggtccccgcgacggcctaccgggaggggaacgggggtcgtgggacgtcgtcgttcttttacttttaagttattagttagtggtacgtacctactactccgactacggaacccgtcggtggacggggtaccgacttaccacctactcctacgaaggaactactaaacttaccaaagaacccgttacgtcttttctttaccttaacaaaacgttagaaaccgtacggtcccgttaaggaaaccggggtaccgaccccgggttaaagtacccgggtaaacccggttacccggggttacgttttaacggtttacgtttaccgggtagggtaaccgggaacggtaaagggaaaccggggttaccggggttaaccccgggtaaaccccgttaaaccgggtttaaccgtttaacccggttaccgttaacgggtacggttaaccggggtaaccggggttaccggggaaacccgggggtaacccggttaaacccggggtaaccccg

SEQ ID NO: 380771 - DNA, 582 bp, Homo sapiens
  misc_feature: GZ8MTXP01DIWJ4.13.76.G10.1.454.CMB.2.raw
  modified_base (389)..(389): a, c, t, g, unknown or other
  modified_base (412)..(412): a, c, t, g, unknown or other
  modified_base (431)..(431): a, c, t, g, unknown or other
  modified_base (480)..(480): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtcctgagactctcctgtgcagcctcgtgggttcaccgtcagtcacacctacatgagcgtcgggtccgccaggctccggaggggaggggcgtggagtgcgttcttcttttattatgtagtgtagtacatctcgcagactcgtggaggggcattcaccatcnccagacataactcaagacacgtnttgttctacaatgaaaccncgacggtagacgacgacgagtacgacgacggtcgttatacgttacgtgngaacgaagcggacggttccgggaaccctaacggttaaccgttacgttacgtaacgtaggtcgggtaccggtcgggaccggggtaacccgaacgggtaacccg

SEQ ID NO: 380772 - DNA, 801 bp, Homo sapiens
  misc_feature: GZ8MTXP01COHKZ.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagcttgggttttccttgttgctattttaaaaggtgcccagtgtgaggtgcagctggtggagtcgtggaggaggcttgatccgagtccgtgggggtccctgacgactctccgtgtgctacgcctcgtcgggttccaccgtcacgtccaacctacctacagtcggacgtccgtcgggtccccgccgagggtcctccggaagggggtaacggggtcgtagggtacgtggtccgttactttacgttttttaagtttaacgttaaggtttaacggttaggttaacggttaacctagttaaccccgtcccggtaaccgtaacggtaacccgttcccgggtaggggtaaccgggggtaccctaacttacccgaaacccgtaacgttaccctacccgaaaggtaaacgtaaccttaaaaccgttacccgaaaagtaaccctaccggttcttttacggttttaccctaaacgtaaaacgttccgaaaacggtcggtaccccgttaaggaaaccggacgacccccggtaagttacggaaacccggtccgggtacccgttagtttaacgttccgtggtacggaccggtaagaggtaaccggtccggggaacccttaacggttaccgttaacgacgtctacgtcgggttaccgtcgggttcggggaacccgg

SEQ ID NO: 380773 - DNA, 726 bp, Homo sapiens
  misc_feature: GZ8MTXP01B84FO.13.76.G10.1.454.CMB.2.raw
  modified_base (245)..(245): a, c, t, g, unknown or other
  modified_base (256)..(256): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcacgcccgccctgagtgtcgtcggggccccagggcaggacggtccacctatcctcctgcacgtgggacncagcctcaagngttgggcactattatgatacgtacacgtacgtaccagctagttccgaggacgcgtacggtacccagtacctacctactaactactaaacgtaaccgtaaaccaaacgtaacggtccccggacccggtaacccggttacccggggtccccgtacgtacccgtacgtttccgtccggtcggttcccgtaaccggtccggttcgtaccgtccgtaaccctccgaccgtcccccgttccgtaggtacctaccgtacgtaccggtcggtaccccgttcggggacgggtaccggttagggaacgggttacgtacgggtaccggttcttacggttactttacgttccggtaccgtaccgttaacgtaaccgtttgacccgttaagtcgtccgttaacggttcccggttaaggtcgggttcgtccgggtttaccggggtacgggttcccgggggtaacccgggttcgttaacccgggg

SEQ ID NO: 380774 - DNA, 612 bp, Homo sapiens
  misc_feature: GZ8MTXP01A9IVZ.13.76.G10.1.454.CMB.2.raw
  modified_base (241)..(241): a, c, t, g, unknown or other
  modified_base (419)..(419): a, c, t, g, unknown or other
  modified_base (449)..(449): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgaccgcacgcccgccctcagtgtcgtcggggccccagggcagagggtcaccatcctctgcacgtgggancagctccaactagttgggcactattatgatacgtaccacgtggtaacccagtctagtttccgaggagcgacggtccccaggtacctcctacatacaaataaccgtaaacaaactacgtcccggacccgacggtaacggggtccctagaccgtacttctaccgtggaccctcgagttcnggtccactccacgtccctccgtgcacgtcncgtcggcctcggagtcgaggagtagtggacggtcttagtactttaccgttgccgaccttaacggtcttacgacgacgtaacgccttaaacggttccgttaaggtcgtcggttaacggttccgggacggttaccggggggaacccgggttaaccgtaaccgggg

SEQ ID NO: 380775 - DNA, 652 bp, Homo sapiens
  misc_feature: GZ8MTXP01BNYSY.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtcgtggaggaggcttgatccagccgtgggggtccctgagactctcctgtgcagcctcgtgggttcaccgtcagtcacacctacatgagcgtgggtcccgccgaggctccggaggggaaggggcgtgggagtgtcgttctttctttttattattagtagtggtataccatacgtccgcacgaacctccggtggacggggccgtacttccacctactcctaccgagaacgtacaaactttacccgaaagtaaacctaaccgggtctttagttttaccttaacaaattggaaaccacgtcccgtaggacggacgtacccgagtacgaccgaccggtccgtagtacgttaccgtggtcggcgtaagacggtacggccggggacccaacgttaccgttaccacggtaactacgtaacgggtccggtcggttcgggggaaccgaacggggtaacccccg

SEQ ID NO: 380776 - DNA, 683 bp, Homo sapiens
  misc_feature: GZ8MTXP01CCPAR.13.76.G10.1.454.CMB.2.raw
  modified_base (301)..(301): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtcgtggaggaggcttgatccagccgtgggggtccctgagactctcctgtgcagcctcgtgggtcaccgtcagtcacacctacatgagcgtcgggtcccnccgagggcctaccggagggggaacggggtcgtagggagtgtcgttctttacttttaattagtaggttagtacggtaagtacagtacctcccgacacgtccgtccgggtagggacgggggtcctaagttcccaacctatccctaccgaagaacgtaactaaacttacccgaaagtaaccacgtctttagtttactaacaaattacgaaacgacgtcccgtaggaacgagcccgtagtcgaaccgaccgggtccgttagttaacgttacgtgggtacgacggaaggacggtaaacgggtcccgggaacccgttaacggttaaccgtttaaccgtacggtcttagggtcgggttaccggttcgggttaaccgggggaaacccggg

SEQ ID NO: 380777 - DNA, 651 bp, Homo sapiens
  misc_feature: GZ8MTXP01BXUD7.13.76.G10.1.454.CMB.2.raw
  modified_base (173)..(173): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcacgccaccctnagtcgtccgtgtccccaggacagacagccagcatccacctgctacgtaggaaataagtggacaagaattaaatatacttcctaggtatcagacaagaacgtcacggcctacgtccccgtgtcgcgttggtacacttctaactacgaaagtcgtacgacccgaacggcccggtacccttacggacgggtacctccccccgtaggacgtcgtacttctcgtacgcctaccaacgtcggtacgggactacgacgtccctactcgtacggaacctacgtccgaacgggtacccgggaaccgtaggtaccgtagtagggaacttgggaaccggtcggttaacgtaaccgtttacgtacgttacggtacggtacggggcggttaagggactggacacggtccaacggtccgcccggtattacgtcggtacgttacggacgttcgggaactcgtccgtaccgtacttacgtccgaacgaaccccg

SEQ ID NO: 380778 - DNA, 829 bp, Homo sapiens
  misc_feature: GZ8MTXP01EZ378.13.76.G10.1.454.CMB.2.raw
  modified_base (261)..(261): a, c, t, g, unknown or other
  modified_base (319)..(319): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagtcttgggttttccttgttgtcttaattttaaaaggtgcccagtgtgaggtgcagcgtggtggagtcgtgggaggaggcttgatccgagtccggtgggggtccctgagctctctgtgcncgtcctcgtggttccaccgtcagtccactaccctacagtgacgtccgtcgggtccccnccgagggcctacccgggagggggacggggctggggtagtcggtcgtttctttacgtttttaatttagtaggttaggttacggttaacgtactacgttaccctccccggaacgtaacggtcccgttcccgggtaggggaaccgggggtccccttaagtttacccccacctacgttacccgttacccaagggtaaccgaaactaaactttacccgaaaacggtaaccttacggtaccttttagttaccccttaaagaaaacgttacggaaaccgtacggtaccccggtaagaaccggaacggtaccccgaaggttaccggaaccccggtacgggttaccccgggtttaattaaacccgttcggtcgggttaagggaccgggaaaggttaacgggtaaccggggttccccggggaaacccccgttaacgggttaaaacccggtttaaccgtacgtaacccggttaggtaccggggttaaccggtttccgggggaaccgggggtaaaccccggg

SEQ ID NO: 380779 - DNA, 687 bp, Homo sapiens
  misc_feature: GZ8MTXP01BYTGR.13.76.G10.1.454.CMB.2.raw
  modified_base (502)..(502): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttattttaaaaggtgccagtgtgaggtgcagcgtggtggagtcgtggaggaggcttgatccgaggccgtgggggtccctgagactctcctgtgcacgcctcgtgggttcaccgtcagtcacacctacatgagtcgtcgggtccgccgaggcgtccggaggggacggggctgggagtcgtcgttactttcttttatttagtaggtagtaggtagtacctatactccgacagtaaccgtcggtggacggggccctattccgacctactccgtaccaaggacgaactaaacgttaccgaaagaacccgtacgtcgtttacgtttacttaacaaaagttcgaaaccncggtccgtaaggaacggaccgaccggtaattcggaaccggtacggtcccgttagttacttacggtggtggaacggaaggacgggtacggttaccggggaacccctaagggttaaccgttccgacggtaacttagggtccgggtaccggttacgggaccgggggaacccgaacggggtaaccccgg

SEQ ID NO: 380780 - DNA, 655 bp, Homo sapiens
  misc_feature: GZ8MTXP01AL4MG.13.76.G10.1.454.CMB.2.raw
  modified_base (554)..(554): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagcttgggttttccttgttgcttattttaaaaggtgcccagtgtgaggtgcagctggtggagtcgtggaggaggcttgatccgaggtccgtggggggtccctgacgtactctcctgtgcacgcctcgtgggttccaccgtcagtcacacctacatgagcgtcggcccgaccgaggcctcggaggggtaagggtccgtgggagtcggtaccgtttctttactttttaattagttaggtttacggttaggtaactactactaccgtcccgaacacggtccgtccgggtagggacggggtccctattccaacctctcctaccgaagacgaactaaccttacgaaaacgaactacgtccttagtttacctaacaaagtacgaacgcgccgtgaagtacgcagtacgaccgtaccggtntagttacttcggtggtcgttagagacgacggttaccgggacccttaaacggttacgttaacgacgtcgtagtcggttaccggtcggttcggggaaccccgg

SEQ ID NO: 380781 - DNA, 680 bp, Homo sapiens
  misc_feature: GZ8MTXP01A27SE.13.76.G10.1.454.CMB.2.raw
  modified_base (488)..(488): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctattttaaaaggtgcccagtgtgaggtgcagctggtggagtcgtggaggaggcttgatccagccgtgggggtccctgagactctcctgtgcagcctcgtgggttcaccgtcagtcacacctacatgagcgtcgggtccgccgaggccgtaccggagggggaagggggctgggagtgtccgttctttctttttagtttagtaggttagttggtacgtaccattacgccgcacgaaccgtccggtggacgggggccctacttccacctacgtcctaccaagacaactaacttaccaaagaacctacgtctttagtttactacaaatgaacngaccgtagacgacgccgatcggaccgaccggtccttaggtaactttaccgtggacggccgaagggacggtacgggttcccgggggaaccccttaaacccggttaaacggtttacccttacggtaacgttaacgggtcggggtaaacccggttcggggaaccggggggttaacccaaacggggggaacccccg

SEQ ID NO: 380782 - DNA, 741 bp, Homo sapiens
  misc_feature: GZ8MTXP01CZE52.13.76.G10.1.454.CMB.2.raw
  modified_base (306)..(306): a, c, t, g, unknown or other
  modified_base (644)..(644): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggtagttttggctgagtcttgggttttccttgttgcttaattttaaaaggtgccagtgtgaggtgcagcgtggtggagtcgtggaggaggtcttgactccgaggccggtcgggggtccctgacgaccttctcctgtcgcacgtccgttcgttcgggttccaccgtcacgtaccacacctanatgagtcgtcggtcccgcgacggccgtccggagggggaacgggggtcgtagggtacgtcggtccgtttacttttacgtttttaagtttaagttaggtttaggttaggttaacgtaaccctagttaccgtcccgtactaacggtaacccgttaccgggtcgggaaccggggtacccgttaaacttacccgtaacctacttcctaacccgtaaaggaaacaaaccttaaactacccaaaagtaaccacgttccttttagtttactaacaaaaagtcaaaaccgtgccgtaaggaacgacgaccgtaagaccgaaccgtcgggtacttagtactttacggngtaggaacggagacggtacgaccgggtaaccctaacggttaacgttcgacgtaagtacggtcggtaccggtacggacggggaaccgttaacgggccc

SEQ ID NO: 380783 - DNA, 631 bp, Homo sapiens
  misc_feature: GZ8MTXP01CAF1C.13.76.G10.1.454.CMB.2.raw
  modified_base (243)..(243): a, c, t, g, unknown or other
  modified_base (256)..(256): a, c, t, g, unknown or other
  modified_base (271)..(271): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcacgcccgccctcgagtgtcgtcggggccccagggcaggagggtcaccatctcctgcacgtgggacncagctaccaacgngttgggcactattangatgtacacgtggtaccagctagtttccgaggacgcacggtcccagacctctacactacaactaacgtaaacaacaacgtcccggcccgacgtacggggtccctcggacccgtacttcctcgtcgggtcctaccgtacggttctcggcctaccgtccacgtccctccgtcggtcactcgacgtcggtacctcgggacggtcgtacggacggtacgtcggtacggtcgtttaggtacttttacgtttcgtcgtacccgttaacggtcccttaagttcgaacgacgtcgacgttccgttgtaacggtcgttccggttcggggtacgggtttccgggggaacccgggggttaacctaacgggg

SEQ ID NO: 380784 - DNA, 639 bp, Homo sapiens
  misc_feature: GZ8MTXP01ATA23.13.76.G10.1.454.CMB.2.raw
  modified_base (373)..(373): a, c, t, g, unknown or other
  modified_base (444)..(444): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttaattttaaaaggtgcccagtgtgaggtgcagctggtggagtcgtggaggaggcttgatccagccgtgggggtccctgagactctcctgtgcagtcctcgtgggttcaccgtcagtcacacctacatgacgcgtcgggtcccgcaggcctccggaggggaggggctgggagtgtcgttctttacttttagttatagtagtggtagtaccatacncgcacgtaactcggtgacgggggcctattccacacgtctaccgagacaacaattaccaaagaactaccgtntttacgtttactacgaaaatcgaaactacgccggtaggaagaccgaccgtagtcgaaccggtaccggtaccgttgttaacgttaccgtggtcggaaggaggttaggacggttcgggggaaccctaacggttaccgttacacggtctaggtcggaaccggttcgggaccgggggaaccgttaaacggggtccccgg

SEQ ID NO: 380785 - DNA, 581 bp, Homo sapiens
  misc_feature: GZ8MTXP01ATBVH.13.76.G10.1.454.CMB.2.raw
  modified_base (361)..(361): a, c, t, g, unknown or other
  modified_base (426)..(426): a, c, t, g, unknown or other
  modified_base (455)..(455): a, c, t, g, unknown or other
  modified_base (502)..(502): a, c, t, g, unknown or other
  modified_base (507)..(507): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtgggtcccgccaggcctccgaaggggaggggctgggagtgcgttctcttttattagtagtagtggtagtanatactccgacagcgtccgtggacggggccgattcacatcctacagacgacaattaccgaaagacncgtcttagtttctaacaaagtgaaaccgngtcctgaagtacgccgtagcggaaccgcggtccgttatacgttacgngtcgngaggagacggtccgggacccaacggttacgttaacgcgtaactagtcgggacctcgggttaacgggaacccggg

SEQ ID NO: 380786 - DNA, 813 bp, Homo sapiens
  misc_feature: GZ8MTXP01AZNJR.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgcttattttaaaaggtgccagtgtgaggtgcagctggtggagtcgtggaggaggcttgactcccggccgtgggggtccctgagactctcctgtgcagcctcgtggttccaccgtcagtcaccacctacatggacgtcgtcgggtcccgccgacgggccgtaccggaaggggggaacgggggctagggggacggtcggtccggtttcttttacgtttttaagtttaagttaggttaggtacggttaacgtactattaacccgtcccgacgtaacggtacccgttcccgggttagggaacggggggtcccgtactttacccgaaccgtacttccctaacccgaaggaacgtaaacctaaaccgtttacccaaaaggtaacccgaacggttcttttaccggttttaccttaaaccgaaaagttacgaaacccgaaggtccccgttaaggaaccggaaccggtacccggaaagttaccggaaccggtaacccgggggtcgttaacggttaaactttaccgggtgggtaacggacgggaacggtaacgggttaccggggtacccgggtaaccccgttaaaccggttaaccgttaccgtaaccggtacgttaacgggtaccgggtaccggttacgggtaaccggggaacccggtaacggg

SEQ ID NO: 380787 - DNA, 678 bp, Homo sapiens
  misc_feature: GZ8MTXP01CWKGS.13.76.G10.1.454.CMB.2.raw
  modified_base (313)..(313): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcacgcccaccctcagtcgtccgtcgtccccaaggacagacagccagcactcacctgctacgtaggaaaataaagttggacaagtaattaaatattacttccgtaggtatcagcaagaacgtcgacggccacgtcccctgtcgctggtcatctancaagatcgaccgaacggccggcctacgaggggtacctccccccgtaggacgtcgtacttccgtacgtcgccctacccgtaaaccgtcggtacgggacctccgacgtccctactctacgaaccagtaccgacgggacccgggaacccgagggtaccgtaaggtggaacgtcgggaacggtccggttaacgtaacgtttacgttaaccgtacggtaaccgtaacgggtaccgggttaggggaaccgtacggacgtaccgacctaaccgtccggcccgttattacgttcggtaccgttacgggaacgttaccgggtaacccgaacggttcccgaaccggtaccttaacgtcccgaaccggtaaccccg

SEQ ID NO: 380788 - DNA, 790 bp, Homo sapiens
  misc_feature: GZ8MTXP01BRS17.13.76.G10.1.454.CMB.2.raw
  modified_base (251)..(251): a, c, t, g, unknown or other
  modified_base (267)..(267): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgcttaattttaaaaggtgcccagtgtgaggtgcagctggtggagtcgtggaggaggcttgatccgagccgtgggggtccctgagactctctgtgcngctcgtggtcaccgtnagtccacacctacatgagtcgtcgggtccgccgacggccgtccggaggggagggggctgggacgtcgtcgtttctttctttttattagtagttagttaggttagtaacctatacctccgacacggtaacttcccggtggacgggcccgtattccaaccgtatcccgtaccgaagtaacgtaaacctaaactttacccgaaaacgggtaaccaacccggttacttttacggttttaacccttaacgaaaaaacttcgggaaaaccaccggtacccggtagggaaacggtaaccgaccccggtaagtacggaaccccggtaccggggtacccgtttagttaaccgtttacgtggggttcgaaccgggaaggttaacgggtccggggttaaccgggggaaccccctaaaccggggtttaaaaccgtttcccggaaacccggttaacggttaacgggttaacgggggtaaccccggttaccggggttacccggggggaaccccgttaaaaccgggggaacccccggg

SEQ ID NO: 380789 - DNA, 704 bp, Homo sapiens
  misc_feature: GZ8MTXP01DMHQG.13.76.G10.1.454.CMB.2.raw
tcagtcacgtactacacgaccggtgctcgatttagtcactcatacagggggcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcacgcctcgtgggttcaccgtcacgtcacacctacatgagcgtcgggtcccgccgacggcctaccgaggggaaggggcgtggagtcgtcgttctttcttttatttataggtagtgttagtacatacctcccgcgtagaccgtccggtggaacgggggtacctaacgttaccaaacctacttaccctaccaaggaacgaaacctaaacttaacccaaagaaaccacgttctttcgtttaaccttaaacaaattacgaaacacgtaccgtaggaacggacgggaccgaagttacgaaccgtaccgggtccctagttaccgttagtgtacggacgaagggagtaacgggtccggggaacccctaaacggttaaaccgttaaccgtacggttaccgttacggttacgggtaacgtcgggtaacgggggaacccgaacggggaccccgtaacgggttcccgtaaccccgg

SEQ ID NO: 380790 - DNA, 655 bp, Homo sapiens
  misc_feature: GZ8MTXP01ADAXV.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttattttaaaaggtgcccagtgtgaggtgcagctggtggagtctggaggagcttgatccagccgtgggggtccctgagactctcctgtgcagcctcgtgggttccaccgttcacgtcacacctacatgagcgtcggtccgccaggcctaccggaggggaaggggctagggacgtgtccgttctttactttttaagtttagttagttagttggtagtaccatactccgacacgtaactccggtggacggggcctattccacctactcctacccagaacgaacctaacgttaaccgaaacgtaaccgtaccgttcttacgttttaccttaacgaaaattacggaaaccacgtacccggtagaacggcgacccgtagtccgaaccgaccgggtaccgttggttaacttcgtcggtgaacggagagtacggttaccgggacctaaccgttacgttcacgtctaggtcgtacggtcgttacggggaacccaaggggaaccc

SEQ ID NO: 380791 - DNA, 733 bp, Homo sapiens
  misc_feature: GZ8MTXP01CITNA.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgcccagtgtgaggtgcagcgtggtggagtcgtggaggaggcttgatccaggccggtgggggtccctgacgactctcctgtgcagcctcgtggtccaccgtcacgtcacacctacatgacgtcgtcgggtccccgaccgacggccgtaccgggaaggggaacgggggtccgtaggggacggttcggtccggtttaccttttacgttttttaagttttagttaggttaaggttagggttaacgttaacctactaccgttacccgacgtaacgtaacccgttcgggtcggggtaacggggtccgtactttaccaaccctactacctacccgaagacgaacctaaacgttaccaaaagaccctacggtctttacgttcttaaacaaatacgaaacacggtccgtaggaacgaccgaccgagtcgaaccgacggttaccgttataacgtttcgtggtggaacggaaggttcggtacgggttaccggggaaccctaacgggttaaaccgtttacacggtctaaggttcgggacggttacgggaccgggaaccggttaacgggaaccccg

SEQ ID NO: 380792 - DNA, 710 bp, Homo sapiens
  misc_feature: GZ8MTXP01E1955.13.76.G10.1.454.CMB.2.raw
  modified_base (486)..(486): a, c, t, g, unknown or other
  modified_base (559)..(559): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgtcttaattttaaaaggtgcccagtgtgaggtgcagcgtggtggagtcgtggaggaggcttgactccgagccgtgggggtcctgagctctctgtgcacgcctcgtcgggttccaccgtcagtcaacacctacatgagcgtcgggtcccgccgaggccgtaccggaaggggaacggggcgtggggagtcgtcgtttctttactttttaagttagttagttaggtaggtaacgtaaccatactccgacacgtaacctcggtgggacggggctacttccactatcctaccgaagacaactaaactaccgaaatacgtacgttgtttaacctanaaaagtcgaaaacgcgtcctaggggacgacggacctaagaccgaccgtaacgggtccgtttagtaactttcgnggcgaacggaagtaacggttacggggtcccggggaaacccctaaacgggttaaaccgtttacgttaaccggttacggtttaacggacgggtaacccgggttcgggaccgggggaaacccgtaaacccgggggttaaccccgtaaccccggg

SEQ ID NO: 380793 - DNA, 728 bp, Homo sapiens
  misc_feature: GZ8MTXP01BL3GX.13.76.G10.1.454.CMB.2.raw
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccgagccgtcgggggtccctgacgactctcctgtcgcacgtcctcgtcgggttccaccgtcagtcacacctacagtgagcgtcgggtccgccgacggccgtaccggaagggggaacggggcgtagggtagtcggtcgttcttttacttttagtttagtagttaggtaggttacgtactacgtacctccgacaacgtacccgtcggtggacgggggcctacttccgacctagtccctaccgaggaacaaactaacttaccgaaaagtaaaccgtcgttacgtttcgttttaccctaaactaaaaggttacgaaaaccgtcgggacccgttaagggaacggtacggacccgtaaacgacggtaaccggtacccgggacgttacgttaaacttcggttggaaccggacggaggaacgggttacgtacccgggggacccttaaaccgggttaccttacggtaaccgacgttaagggtcgggtacggttcgggtaaccggggccgtaaacccgggg

SEQ ID NO: 380794 - DNA, 679 bp, Homo sapiens
  misc_feature: GZ8MTXP01BFZ90.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccgagccgtgggggtccctgagactctcctgtgcagcctctgggtcaccgtcagtcacacctacatgagcgtcgggtccgccaggctccgaggggaaggggctgggagtgtcgtctttcttttattagtagtagtggtagtactatactcgacacgaactcgtgggacggggtccgtacttaccgacctacgtactacccgaaggtacaaacctaaacttccgaaaaggtaacccacccgggttctttagttttacccttaacaaaagtcgaaaccacggtcccggaaggaccggtacgaccgtaatccggaaccgtccggtaccgttagttacgttaccgtgggtaagaacggaaggacgggttacgggcccggtaaacccgtaaaacggtttacccgttcgacgtaacctaaggggtccggtaacgggtcgggttacggggaaccgaaacggggtaacccg

SEQ ID NO: 380795 - DNA, 658 bp, Homo sapiens
  misc_feature: GZ8MTXP01AZ2SS.13.76.G10.1.454.CMB.2.raw
  modified_base (374)..(374): a, c, t, g, unknown or other
  modified_base (418)..(418): a, c, t, g, unknown or other
  modified_base (462)..(462): a, c, t, g, unknown or other
  modified_base (485)..(485): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggagcttgatccagccgtggggggtccctgagactctcctgtgcagcctcgtgggtccaccggtcagtccacacctacatgagcgtcgggtccgcgaggccgtccggaggggaaggggctagggagtgtcgttctttctttttattagtagtagtgtagtacatactccgnacgactccgtggacgggtccgtacttcgaccatcctaccaaganaactaattcccaaagacacgtctgttttacacaaattacaacgnccggtagagtacgacccggtaanccggacgtaccggtacgttagttacgttacgtcggtaggaacggtaaggaacgggtaccggttcccggggtaaaccccgtaaacggttaaaccgtttccgaacggttaacgttaggtaacccggggtaccggtacgggggaccggggtaacccgttaacccgggggtaacccg

SEQ ID NO: 380796 - DNA, 635 bp, Homo sapiens
  misc_feature: GZ8MTXP01D0XPY.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcacgccctcgtgggttccaccgtcagtcacacctacatgacgcgtcgggtccgccgaggcctaccggagggggaagggggcgtgggtagtcgtcgttctttactttttatttagtagtaggtaggtagtacatacctccgacagccgtcggtgggacggggccgattcacatcctacgaagacactaacttaccaaagaccacgtcttacgtttactactaaagtgaaacgaacgtcctaggacgacgcccgagtcgaaaccgcgggtaccgttagttaactttcgtaagggtcgacggaggaaggtacggtcgggggaccccttaacgggttaaactttaacgaacgtcgttaagtcgggttacggttcggcgggggaacccgg

SEQ ID NO: 380797 - DNA, 705 bp, Homo sapiens
  misc_feature: GZ8MTXP01A2XXI.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccgagccgtgggggtccctgagactctcctgtgcagcctcgtgggtcaccgtcagtcacacctacatgagcgtgggtcccgcaggctccggaggggaacggggctgggagtggtcgttctttcttttatttagtagttaggtggtagtaccatacgcgcagaacctcggtggacgggcctagttccactactctaccgagacgactaacttaccaaagaactacgtctttacgtttacctaacaaactagaaactacggtaccgtagggaacggtaaccgaccggtaacgttaccggaacccgtaccggggtcccggtttaagttacgttaccgggtagggttccggaacgggtaagggacgggtaccggttccggggggtacccctaaacggttaaccgggttttaaccaccgggttaaccttaggttcggggtaacccggtttcggggttaccgggggaaccccgggttaacggggtaacccccggg

SEQ ID NO: 380798 - DNA, 676 bp, Homo sapiens
  misc_feature: GZ8MTXP01ET2HT.13.76.G10.1.454.CMB.2.raw
  modified_base (409)..(409): a, c, t, g, unknown or other
  modified_base (555)..(555): a, c, t, g, unknown or other
  modified_base (624)..(624): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctctgtgcagcctcgtggtcacgtcagtcacacctacatgagcgtggtcccgccaggctccggaggggaaggggtctgggagtgctattcttcttttattataggtagtggttacgtacataccgtccgcaaacgtactccggtgggacggggtccctacttccgaaccntcctcccaaggtacaactaaacgttccgaaaagtaaaccgtacgtctttacggtttactaaaccgaaaattagaaacctacgggtacccgttaggaaacgacggaccgtaagtcgacggaccgggtccttaggttacttttacggnggttcggaacgaggaacggcgggttaaccggggaaccccttaacgggttaaacgtttacccgtaacggngttaacggtcggggtacccgttcgggtccgggggaacccgtaaacccggggg

SEQ ID NO: 380799 - DNA, 571 bp, Homo sapiens
  misc_feature: GZ8MTXP01ESIDY.13.76.G10.1.454.CMB.2.raw
  modified_base (170)..(170): a, c, t, g, unknown or other
  modified_base (211)..(211): a, c, t, g, unknown or other
  modified_base (292)..(292): a, c, t, g, unknown or other
  modified_base (477)..(477): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcactgctnagaaataagtgacagaataaatatacttctggtatcagcagaagtcaagccagtcccctgtgctggtcatctatacaagtntcgaccaaggccgcctacgaacggtctccccccgtaggacgtcgtattcccgtacgtcggtcctacccgtaaacttccgtacgggaaaccttcgacgtccctatccgtacgaccacgtaccgacgggaacccgggtaccctaagggcttaggcgggattagggaacgtcgtgtaacttaagttcnggtcgagggtcgtaggcacggcagcgaacttcggcctgttacgtgtccgttagcgttacggaactaggtcacggtacttacgcgaacgaacccg

SEQ ID NO: 380800 - DNA, 693 bp, Homo sapiens
  misc_feature: GZ8MTXP01AHMCF.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggttcagctggtggagtcgtggaggaggcttgatccagccgtgggggtccctgagactctcctgtgcacgtcctcgtgggttcaccgtcacgtcacactacatgacgcgtcgggtcccgccacggcctaccggaggggaacggggcgtggagtcgcggttctttacttttatttatagttagttggtagtactactacctcgactacgaccgtcggtaggcgggggtccacgttccacctaagtcctaccgaagtaacgaaacctaaacttaccgaaacgtaaccgtacccgtactttacgttttacctaacctaaaagttaccgaaaccgacgtacccgttaggggacgtaacggcgtaacgtacgaccggacgtccgttagtacttacgtgtacggcgtaaggcgagggtcccggggaccctaaacgggtaaccgtttaacgccgttacgaacggttacggcccggttcgggaccgggggacccgtaacggggaacccgtaaccccggg

SEQ ID NO: 380801 - DNA, 636 bp, Homo sapiens
  misc_feature: GZ8MTXP01DL5DM.13.76.G10.1.454.CMB.2.raw
  modified_base (384)..(384): a, c, t, g, unknown or other
  modified_base (475)..(475): a, c, t, g, unknown or other
  modified_base (544)..(544): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctatttaaaaggtgcccagtgtgaggtgcagctggtggagtcgtggaggaggcttgatccagccgtgggggtccctgagactctcctgtgcagcctcgtgggtcaccgtcagtcacacctacatgagcgtcgggtcccgcaggcctccggagggggaagggctgggagtgtcgttcttcttttattagtagtagtggtagtacatacgtccgacacgcgtccgngggacggggcctagttccacgtactcctacgaagacgaactaacttaccgaaagaacctacgtctttgttaccttacaaattacgaacgtnacccgttgaaacgtacgacccgtagtcggaaaccgtaccgggtccgttaagttacgttacgtggtacgnggtaacgaggtacggtcccggggaacccgaccgttaaacggttaacctacgcgttacggtcgggttaccgtcgggttccggggaaacccggg

SEQ ID NO: 380802 - DNA, 620 bp, Homo sapiens
  misc_feature: GZ8MTXP01EZ30P.13.76.G10.1.454.CMB.2.raw
  modified_base (578)..(578): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttccaccgtcagtcacacctacatgagcgtgggtcccgccgaggctccggaggggaacgggggcgtgggagtggtcgttctttctttttattagttagttaggtggtagtaccatactccgcacgaacctccggtggacggggccgtattcacctatcctacccagacgaactaattaccaaagaccacgtctttgtttaccttacaaattcgaaacacgccgtaggacgacgccgatccgacgacgggtccgttagtattacgtggtgaacggtagaggacggttccgggggaccctaaacgttaacggtttcacggtntagtcgggacgtcggacgggggtaacccgaaggggaaccccg

SEQ ID NO: 380803 - DNA, 641 bp, Homo sapiens
  misc_feature: GZ8MTXP01DPUDG.13.76.G10.1.454.CMB.2.raw
  modified_base (464)..(464): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagctctcctgtgcagcctcgtggttcaccgtcacgtcacacctacatggacgcgtcgggtcccgccgaggcctaccggagggggaagggctgggagtcgtcgttcttcttttaattatagtagttaggtatactatacgtccgaacagcgtcggtaggtacggggcgtacttcgactatccgtacagagacaattcaaagtacactctagttttcacaaatcgaaacncgtacctaggacgacgaccggatacggaccgccggtaccgttaggttaaactttcggtcggtcggacggaaaggttacgggtacggtacccggggggaccccttaacgggttaaacgtttaacccgaaacgtcgttaaacgggcgggttaccggtcgggttaacgggggaaccccgg

SEQ ID NO: 380804 - DNA, 817 bp, Homo sapiens
  misc_feature: GZ8MTXP01D3U9R.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgtcttaattttaaaaggtgcccagtgtgaggtgcagcgtggtggagtcgtggaggaggcttgatccgagccgtgggggtcctgagctctcctgtgcacgccttcgtcggtccaccgtcacgtcacacctacatgacgtcgtcggtcccgccgacggccgtaccggaaggggaacgggggcgtagggtacgttcggtcgtttacttttacgttttttaagtttaagttaggttaaggttacggttaacgttaacccctacgttaaccgtacccggaccgtaacggtaacccgttacccgggtaacgggggaccggggggttaccctaacgtttacccaacccctacgttacccgtaacccgaaaggtaaacgtaaacctaaaacttacccgaaaaacggtaacccgtaccggttaccttttacggttttaccttaaaccaaaagttaacgaaaccacggttacccgtaaggacggtaaaccgcccggtaaagttacccggaaccggtaccggttacccgtttagtaaaccgttttacggtcgggtacggaacggaagggttaacggtaccgggttacccgggtaaccccttaacggttaaccgttaccggttaccgtcgtacggtccgggtacgtcgggaccgggtaacccgaacggtcccg

SEQ ID NO: 380805 - DNA, 529 bp, Homo sapiens
  misc_feature: GZ8MTXP01AJCEE.13.76.G10.1.454.CMB.2.raw
  modified_base (170)..(170): a, c, t, g, unknown or other
  modified_base (233)..(233): a, c, t, g, unknown or other
  modified_base (290)..(290): a, c, t, g, unknown or other
  modified_base (317)..(317): a, c, t, g, unknown or other
  modified_base (319)..(319): a, c, t, g, unknown or other
  modified_base (328)..(328): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcactgctctaggaaataatgacagataatntacttctggtatcagcagaagtcaggccagtcccctgtcgctggtcatctatcaagntgaccaagccgcctgaggctcccccgngngcgtattcnctcggcctaccaactcgtacgggaacctcgacgccctactctacgaccagtccgacggaccggacccagggcctagtcggatggacggctagaacttattacgtgtcgagggtcgtaggggacaggcacggcaacgtcgcccgtcttagtcgtcgttacggacttcgggaaccacggtcaccgtcgacgtccgcgaacccg

SEQ ID NO: 380806 - DNA, 731 bp, Homo sapiens
  misc_feature: GZ8MTXP01ADZPW.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgcttaattttaaaaggtgcccagtgtgaggtgcagctggtggagtcgtggaggaggcttgatccaggccgtgggggtcctgagactctcctgtgcagcctcgtgggtcaccgtcagtcacacctacatgagcgtcgggtcccgccgaggcctaccggaaggggaacgggggcgtgggaggtcggtcgttctttactttttagtttagttaggttaggttggtacgtaccactactccgacacgtaaccgttccggtgggacggggcccgtattcccgacctactccgtacccaaggtaacgtaaacctaaacttacccgaaaaggtaaccctacgggttccttttaggttttacccttaacgaaaattcgggaaaacctacggaccccggttaagggaacggaccggaccccgtaagttaccgaaccggacccggggttaccgttagttaaccgtttaccgtgggtcgaacgggaagacgggtacggttccgggggaaacccctaggttaaaccgtttccaacggtcgtaagtcgggaccgtcgggttacgggggaacccgaaggggtaaccccg

SEQ ID NO: 380807 - DNA, 663 bp, Homo sapiens
  misc_feature: GZ8MTXP01ENH2M.13.76.G10.1.454.CMB.2.raw
  modified_base (243)..(243): a, c, t, g, unknown or other
  modified_base (278)..(278): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacgaggtcctgggcccagtctgtactgacgcacgcccgccctcgagtgtccgtcggggccccagggcaggaggtcaccatctcctgcacgtgggacncagcctaccaacgtagttcggggacacgtattagngtatcgtacacgttcggtaccagactagtttccgaggagctacggtacccctagtacctcctacactacaacgtaacgtaaccaacgaacgtcccggcccgacgtaccgggtccctacggacctacgttctcgtcggctccgtacgtcgtcggacctacctcgaccgtccccgtcccgtggtaccacgtaccgacgtcgggtcctaccggggacggtccgtagacgggtagcggacggttctagtacgttttaacgttccgtcgtcccgtaacgtcccgttagtacgttaccgtcgacgttacggttccttcgggtaacgttcggtttccggtttacggggtaccgggttcccgggggtaaccgggggttaacccgttcccgggg

SEQ ID NO: 380808 - DNA, 614 bp, Homo sapiens
  misc_feature: GZ8MTXP01D3REI.13.76.G10.1.454.CMB.2.raw
  modified_base (271)..(271): a, c, t, g, unknown or other
  modified_base (283)..(283): a, c, t, g, unknown or other
  modified_base (298)..(298): a, c, t, g, unknown or other
  modified_base (305)..(305): a, c, t, g, unknown or other
  modified_base (469)..(469): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtcgtggaggaggcttgactccgagtccgtcggggggtccctgacgactctcctgtgcagcctctggtcaccgtngtacacacctanatgagcgtgggtccncgaggcncggaggggaggggctgggagtgtcgtctttcgttttattagtagttagtgtagtacatactcgcagtaacctcggtggacggggccctaattcccgaactactctacccaaggaacaactaacttaccgaaaagtaactaaccgtccgtttatttaccttaaanaaagtacgaaactacgacggtaggaacgacgacgagtaccgacgtaccggtcgttagttactagtggagaagaagaggtacggttccggaccctaagaccgttcacgtgtaggcggtacgtcggacggggaaccgaacgggtccg

SEQ ID NO: 380809 - DNA, 693 bp, Homo sapiens
  misc_feature: GZ8MTXP01C4MH5.13.76.G10.1.454.CMB.2.raw
  modified_base (497)..(497): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtggttcaccgtcagtcacacctacatgacgcgtcgggtcccgccgaggcctccggagggggaacggggcgtgggagtgtcgttctttacttttagtttataggttagtggttacgtaccactacgtccgacgacgtaaccgttccgggtgggacggggtcccgtatttaccacctactcctaccgaagtacgaacctaaacttacccgaaagtaaccacgttctttacgttttaccctaanaaaagtcgaaacgtcggtccgtaaggacgaacgcccggtaatcggaaccgtcgggtaccgttagttaacttacgtggtcggaacggtaaggacgggtacggttccgggggaaacccctaacggttaaaaccgtttcgaccggtcgttaaggtcgggtaccgtgggttaccgggggaacccaacgggggtaaccccg

SEQ ID NO: 380810 - DNA, 641 bp, Homo sapiens
  misc_feature: GZ8MTXP01AGHGY.13.76.G10.1.454.CMB.2.raw
  modified_base (264)..(264): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttaattttaaaaggtgcccagtgtgaggtgcagctggtggagtcgtggaggaggcttgatccgaggtccggtcggggggttccctggacgaccttctcctgtgcncgtcctcgtggttccaccgtcagtcacacctacatgagcgtcgggtccgccgaggcctccggaggggaagggggcgtgggagtgcgttcttcttttatttagttagtagtggtagtacctatactccgcacgtaaccgtccgtcggcggggccgtattccgccaaaaaactccttaccagaacgaactaacttaccgaaagaacacgtcttagtttacttactaaatagaacgacgcgtgacgagccgagtcgtacgacggtcgtacgtattacgtcgtggcgaggagacggcgggacccgtaaccggttaaccgttacgttacgtaacgtagtcgggtacggtcggttacggggtaaccggaacgggtaaccccgg

SEQ ID NO: 380811 - DNA, 667 bp, Homo sapiens
  misc_feature: GZ8MTXP01BQGYV.13.76.G10.1.454.CMB.2.raw
  modified_base (270)..(270): a, c, t, g, unknown or other
  modified_base (614)..(614): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggaggaggcttgatccgaggccgtgggggtccctgagactctctgtgcagcctcgtgggtcaccgtnagtcacacctacatgagcgtcgggtcccgccgaggcctccggaggggaaggggctggagtgtcgttctttcttttattagtagtagtggtacgtaccatactccgcagaacctccgtggacggggcctattccgacctacgtctaccgaagcgaactaacttcccaaaggtaaccaccggttcttagttttcctaacaaaagttcgaaaactcggtcccttaggaacgaccggaccgtaatccggaaacccgacgggtaccgtttagtaaagtttccgtggtcggaacgagggaggttacggcgggggtaaccccctaaaggttaaaccgtttccgacccggtntacggttcggaacccgggttcgttccgggggtaaccgaaccggggtaaccccg

SEQ ID NO: 380812 - DNA, 572 bp, Homo sapiens
  misc_feature: GZ8MTXP01BNRIS.13.76.G10.1.454.CMB.2.raw
  modified_base (363)..(363): a, c, t, g, unknown or other
  modified_base (437)..(437): a, c, t, g, unknown or other
  modified_base (474)..(474): a, c, t, g, unknown or other
  modified_base (485)..(485): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagctgggtcccgcaggctccggagggaaggggctgggagtgcgttctttcttttattagtagtagtggtagtacatacnccgcagaactccgtgagggcctatcacatctacagagacaatacaagacacgcttgtttactacaaatgaaacncgacgtagagagacccgagtgacgacgggtaccggtntacttactggngaacggaagaggtaagcgggggaccccaacggttaacgttacgacgtctagtggacgtcgttcggggaaccgttaacggggaacccg

SEQ ID NO: 380813 - DNA, 706 bp, Homo sapiens
  misc_feature: GZ8MTXP01C8330.13.76.G10.1.454.CMB.2.raw
  modified_base (300)..(300): a, c, t, g, unknown or other
  modified_base (319)..(319): a, c, t, g, unknown or other
  modified_base (505)..(505): a, c, t, g, unknown or other
  modified_base (570)..(570): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggtagttttggctgagtcttgggttttccttgttgcttaattttaaaaggtgccagtgtgaggtgcagcgtggtggagtcgtggaggaggtcttgactccgaggtccggtggggggtccctggacgtacctctcctgtgcacgtcctcgttcggttcaccgtcagtccacacctanagtgacgcgtcgggtcccncgaggccgtacggaggggaagggggctggagtcggcgtttctttacttttatttagtacgttagtggttaataccacttactcgacacgtaacccgtcggtgggacgggtcctacgttccacctactactaccgagtaacaaacctaacttacccgaaagaaacctcggttctttagtttactaanaaatcgaaactcggctaggacgacgccgtagtacgaccgcgggttaccttagtaacctttcgggnggtacggaacggtaaggaccgggtacgggttacccggggtaaacccttaaacggttaacccgttcgttaccggttcgttacggtccggggtaccgggtccggggttaaccggggaacccgttaaaccgggtccccg

SEQ ID NO: 380814 - DNA, 689 bp, Homo sapiens
  misc_feature: GZ8MTXP01EU347.13.76.G10.1.454.CMB.2.raw
  modified_base (379)..(379): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggtcaccgtcagtcacacctacatgagcgtcgggtcccgccgaggcctccggaggggaagggggctgggagtgtcgtctttactttttatttagttagtagtggtacgtaaccatactccgnagaacctcggtggacggggcccgtattccaacctatcctaccaggacactaactccaaagaacacgtctttagtttactacaaaacgtcgaaactcggccgttaggaacgaccgacccgtagtaccggaacccgtaaccggggtccgttaggttaaccttttacgggtggtacggaacggtaacgggttacgggtaacgggttacccggggaaacccctaaacgggttaaacccgtttacgttaacccggtaagttacggtaacggggtaccgggtacggaccgggggaacccgttaacggggtaacccg

SEQ ID NO: 380815 - DNA, 611 bp, Homo sapiens
  misc_feature: GZ8MTXP01BXR8H.13.76.G10.1.454.CMB.2.raw
  modified_base (279)..(279): a, c, t, g, unknown or other
  modified_base (298)..(298): a, c, t, g, unknown or other
  modified_base (410)..(410): a, c, t, g, unknown or other
  modified_base (442)..(442): a, c, t, g, unknown or other
  modified_base (448)..(448): a, c, t, g, unknown or other
  modified_base (451)..(451): a, c, t, g, unknown or other
  modified_base (470)..(470): a, c, t, g, unknown or other
  modified_base (510)..(510): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagcgtggtggagtcgtggaggaggcttgactccgaggccggtcgggggtccctgagactctcctgtgcagcctctggtacttcctaccttnagtacgctactggatcgcncgtcggtccgcaacgcgtccgaggggagggtcgtggtggtggtctgtacgttattaagtgtgagtggagtgacagacgcgacgcggacgtcggtaggacggtcactcacctntccgacaagacgaacaacgtaccaagtaaccncgtatntancagaacgtaagtcgaaacnggtacgaggaccggacggtaccgggaagtaccgtacggtnttaggttaacttaagttacggtgaaccgtaaagtaaagttaacgttaacgttaacttaaattaaaatttaagttacgtagttagtaaggttaacggtaagg

SEQ ID NO: 380816 - DNA, 650 bp, Homo sapiens
  misc_feature: GZ8MTXP01BAKK3.13.76.G10.1.454.CMB.2.raw
  modified_base (298)..(298): a, c, t, g, unknown or other
  modified_base (481)..(481): a, c, t, g, unknown or other
  modified_base (579)..(579): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgccagtgtgaggtgcagcgtggtggagtcgtgggaggaggcttgatccagtccgtgggggtccctgagactctcctgtgcagcctgtcggtcaccgtcagtcacacctacatgagcgtgggtccnccgaggcctccggagggggaggggctaggagtgtcgttcttctttttaattagtagtaggtggttaacgtactacgtacctccggaacaggtaaccgtccgggtaggggacggggtcccgtattccgaacctagttccctaccgaagtacgaactaaacttacccgaaaagaccacgttcttntttaccgtaacaaagttacgaacgtacgtcctaggaacggacgcccgagttaggacccgtaccggtccgtttagttaccttagtgtacgggcgaaggngtaacgttccgggggacccttacggttaacgtttaacgactgacgtcgggacgttcggaaggggaaccccg

SEQ ID NO: 380817 - DNA, 611 bp, Homo sapiens
  misc_feature: GZ8MTXP01DGC24.13.76.G10.1.454.CMB.2.raw
  modified_base (398)..(398): a, c, t, g, unknown or other
  modified_base (403)..(403): a, c, t, g, unknown or other
  modified_base (492)..(492): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtcgggtccgcaggcctaccggagggaacgggggcgtggaggtgcggttctttcttttatttagtagtagtggtatacatactcgcagactcgtggacgggcgatcacatcncaganacactcaagacacgtcttgtttactacaaagtcaaacacgtccgtaggagacgaccgagtacgaccgacggtacccgtgttaattacgnggtacgcggtaagaggtacggttccgggggacccctaacggttaaaccgttacgttaaccggtcttaaaggtcggggaacgtccgggttacggggaacccgaaacggggtaacccccgg

SEQ ID NO: 380818 - DNA, 669 bp, Homo sapiens
  misc_feature: GZ8MTXP01EZWX5.13.76.G10.1.454.CMB.2.raw
  modified_base (276)..(276): a, c, t, g, unknown or other
  modified_base (386)..(386): a, c, t, g, unknown or other
  modified_base (497)..(497): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcttgggtttttccttgttgtcttaattttaaaaggtgcccagtgtgaggtgcagcgtggtggagtcgtggaggaggcttgatccagccgtgggggtccctgagtactctcctgtgcacgcctcgtgggttcaccgtnacgtcacacctacatgagcgtcgggtcccgcgacggctaccggaggggacggggctggagtgtcgttctttactttttattagtagtagttggtagtaccatactcccgnacgaaccttccggtggacgggtccgtacttccaacctatacctaccaaggtaacaactaaacttaccgaaaagaacctacgtcttttacgttactaacaaattcgaaaacncgccgtagaacgacgaccgtaagtccgaaaccgtcgggtaccttaggttaacttaccgtgtggaacgaaggttacggtacggttacccggggacccctaaacgggttaacgtttccgacgtcgttagtcgggaaccggttcggacgggggtaacccgaaggggtaacccccg

SEQ ID NO: 380819 - DNA, 670 bp, Homo sapiens
  misc_feature: GZ8MTXP01B12HI.13.76.G10.1.454.CMB.2.raw
  modified_base (505)..(505): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtgggaggaggcttgatccagccgtgggggtccctgacgactctcctgtgcacgcctcgtcgggttcaccgtcacgtcacacctacatgagcgtcgggtcccgccgacggccgtcggaaggggaggggcgtgggagtcgtcgttctttacttttatttagtagttagtggtagtacctactactcgacacgtaaccgtcggtgggaccggggtccgtacttccacctactcctacccgaagactaactaacttaccgaaacgtaaccaccgttctttacgttttacctaacgaaattcggaaacncgtcgtaggaacgccgacgtagcggacgccggtccgttagttattacggtggtgaacggtagaggcgggttacccggggaccctaacggttaaccgttccgttaacggccttagggtcgggtacggtccggggttacggggtaacccggaaacgggtaaccccgg

SEQ ID NO: 380820 - DNA, 738 bp, Homo sapiens
  misc_feature: GZ8MTXP01C1M3V.13.76.G10.1.454.CMB.2.raw
  modified_base (257)..(257): a, c, t, g, unknown or other
  modified_base (381)..(381): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttattttaaaaggtgcccagtgtgaggtgcagcgtggtggagtcgtggaggaggtctttatccgagccgtggggggtccctgagtactctctgtcgcngcctcgtcggttcaccgtcagtcacaccacatgacgcgtcgggtcccgccaggctaccggaggggaggggcgtggagtgtcgttctttctttttattagtagtagttaggtatacactactcgnacgctccgggtgcgggggctacttaccacctactctaccgaagacgaactaacttaccaaacgtaaccacgtactttacgtttacttaacaaacgtacgaaacgacgtccctaagggggaacgacggaaccggttacgaacggtaacccggtaccgggttaccggtttaacgtttaacttaccggttaggtacgggaccgggtaaaagggtcgggttaacggggttacccggggaaccccgttaaacgggttaaacccggtttaaccgttaccggttaccggtaacggttaccggggtaacggttcccgggggttacgggggaccccgtaaaaccgggggccccgttaaccccgggg

SEQ ID NO: 380821 - DNA, 628 bp, Homo sapiens
  misc_feature: GZ8MTXP01AY6YK.13.76.G10.1.454.CMB.2.raw
  modified_base (372)..(372): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgcttattttaaaaggtgcccagtgtgaggtgcagctggtggagtctggaggaggcttgatccagccgtgggggtccctgagactctcctgtgcagcctctgggttcaccgtcagtcacacctacatgagcgtcgggtcccgccgaggcctccggaggggaaggggcgtggagtgcgttctttcttttattagtagtagtggtagtacatactccgnacgtaactccgtggacggggccattcaccatctacagagactaatccaaagacacgcttcgtttactacaaatgaacacgccgtgaacgacggaccgtagtcgaccgtacgggtacccgttagttaattaccgtggtcggaacgaagggacggtacggttccgggggaacccctaaaccgggttaaccgttaacgttaccggtcctaaggttcgggaccggtcggttacgggggtaacccgaacggggtaaccccg

SEQ ID NO: 380822 - DNA, 698 bp, Homo sapiens
  misc_feature: GZ8MTXP01B71D6.13.76.G10.1.454.CMB.2.raw
  modified_base (597)..(597): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtacccagtgtgaggtgcagctggtggagtctggaggaggcttgatccagccgtggggggtccctgagactctcctgtgcagcctcgtgggtcacggtcagtcacaccacatgagctcgggtccgccgaggctccgaggggaacgggctgggacgtgcgttcttctttttatttagtagttagtaggtagtactactacctcgacacggtacctccggtagggcgggggccgtattccacccagttcctacccaaggtacgaactaaacgtttccccaaaaggtaaaccctacggtacccttttaggttttacccttaaccaaaagttacgaaaccacggtaccccttaagggggaacggaacggtaccccgaagtaccggaacccgtaccggggtacccgtttaggtaacttaaccgtggtaccggngtaagggaagttacggtccgggggaccctaaacggtaacgttacgttcgactaaggcgggaacttcgggacgggacccgaacggggttcccgtaacccggg

SEQ ID NO: 380823 - DNA, 689 bp, Homo sapiens
  misc_feature: GZ8MTXP01EX2I5.13.76.G10.1.454.CMB.2.raw
  modified_base (284)..(284): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatccgagccgtcgggggtccctgagactctcctgtgcagcctcgtcggttcaccgtcagtcacacctanatgacgcgtcggtcccgccgaggcctaccggaggggaaggggcgtggagtcgtcgttctttactttttaagttagttagttagttaggtacgtaaccattacgtcgactacgtaaccgtccggtgggaccggggtaccgtacttaccgacctactctacccgaagaacgaacctaaactccgaaaagaacctacgtctttagtttaccttaaacgaaaagttacgaaaacctcgtacccgtaaggaacggacggtaccccgtaagtccgaaccggtaccgggtaccgtttagtacgtttacgcgggtgaacgggaagacggggtacgttcccggggacctaaaccggttaacgttcgacgtaacgtagtccgggacgtcgggagggaacccgaacgggtaacccg

SEQ ID NO: 380824 - DNA, 742 bp, Homo sapiens
  misc_feature: GZ8MTXP01DOZB4.13.76.G10.1.454.CMB.2.raw
  modified_base (596)..(596): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctattttaaaaggtgcccagtgtgaggtgcagcgtggtggagtcgtggaggaggtcttgatccgagccgtgggggtcctgacgactctctgtgcagcctcgtgggttcaccgtcagtcacacctacatgagcgtcgggtccccgcgacggccgtaccggaagggggtaaggggccgtagggacgtcggtcgtttcgttttacttttttaagtttagttaggttaaggttacgggttaacgttaaccctaacgttaaccgtcccgtacgtaacggtaaacccgttcccgggttggggaccgggggtacccttacgtttcccaacctactccgtacccgaagtacgaacctaaacgttaccaaacggtaacctaacgttctttacgtttacctaacaaaagttacgaaaccgtcgacggttagaacggacgacccgttanacggaccgtaccgggtaccgttgttaactaccgtgtacgggaacgtaggttacgacggttccggggaaccctaaggttaacccgttcgttacgccttaaggtcggtaccggtcggttacgggggtaacccgaacggggtaaccccg

SEQ ID NO: 380825 - DNA, 679 bp, Homo sapiens
  misc_feature: GZ8MTXP01EUU9F.13.76.G10.1.454.CMB.2.raw
  modified_base (574)..(574): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccaggccgtgggggtcctgagactctcctgtgcacgcctcgtcggtcaccgtcacgtcacacctacatcgagcgtcgggtccgccgacggccgtaccggagggggaaggggcgtgggtagtcgtcgttcttactttttagttagtagttagttacggtagtactactaccgtccgacgacgcgtccgggtagggaccgggggtccgtacttaccacctacgtccctacgaaggacgaaactaacttacccgaaagtaccgtaccgttctttacgtttacctaacaaaacgttcgaaacgtacgtaccgtaaggaacggacgaccgagtcgaaccgtcggtccgtattaccgttagnggtggacggtagaggtcgggtaccgggacccgttaacggttaaccgttaacgtacggtaacgttacggacgggttaccggttcgggttaacgggggtaaccccgg

SEQ ID NO: 380826 - DNA, 663 bp, Homo sapiens
  misc_feature: GZ8MTXP01C5MA9.13.76.G10.1.454.CMB.2.raw
  modified_base (162)..(162): a, c, t, g, unknown or other
  modified_base (191)..(191): a, c, t, g, unknown or other
  modified_base (243)..(243): a, c, t, g, unknown or other
  modified_base (254)..(254): a, c, t, g, unknown or other
  modified_base (256)..(256): a, c, t, g, unknown or other
  modified_base (264)..(264): a, c, t, g, unknown or other
tcagtcacgtactacacgaccggtgctcgatttagtcactcatacagggggcccagcactgggattccgaggtgtttccattcggtgatcagcactgaacacagaggactcaccatggagttttggctgagctgggttttccttgttgctattttaaaaggngcccagtgtgaggtgcagctggtggagtntggagaggcttgatccagccgtggggggtcctgagctctcctgtgcagcctntggtcaccgtnancacactanagtgagcgtcggtccgccgacgcgtcgagggagggacgtaggagtgtcgttcttctttatttatagtagtagtagtactactactcccgacgacgacgtcgtacggaacgggacgtaactactacctactacctaccgaacgaacgaaactaaactaaccgtaaacgaaacgtaacgtacgttacgtttacttaactaaacgtaacgaacgacgtacgtacgaacgacgggacgaacgtacgacgaaccggtaccgttacgttaacgttaacgttaggtacggacggaagaaggaacggtacgggacccgaaaccgttaaacgttaaacgtaacgttacgttagttacggtaacgtacggtaacgggacgggaacggaacggtaaccgaaccgtaaccg

SEQ ID NO: 380827 - DNA, 742 bp, Homo sapiens
  misc_feature: GZ8MTXP01BX6O8.13.76.G10.1.454.CMB.2.raw
  modified_base (311)..(311): a, c, t, g, unknown or other
  modified_base (538)..(538): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggtagtttggctgagcttgggttttccttgttgcttaattttaaaaggtgccagtgtgaggtgcagcgtggtggagtcgtggaggaggcttgactccgaggccggtcgggggtccctgagtacctctcctgtgcagtcctcgtcgggtccaccgtcacgtccaccacctacatgagtcgtcggcccncgaggccgtacggaggggacggggcgtgggagtcgtcgtttctttacttttaatttagtagttaggtggttaacgtacctacttacgtccgacaacggtaacccgttccgggtcggggaccggggtaccgtaacgttcccaaccgtacttacccgtacccgaaaggaaaccgaaacctaaccgttaacccgaaaaggtaccctacggttctttagttttacccaaanaaagttcgaaacctcgtaccgtaggaaagtccgaccgtaagtccggaacccgacggggttccgttaagttaaaccgttacgtgggtacgggaacgtaaacgggaggtcggggttacccgggaaaccccgttaagttaaacccgtttccgaacgcttagggcgggtaccgttcgggaccgggggtaaccgaaccgggggtaaccc

SEQ ID NO: 380828 - DNA, 647 bp, Homo sapiens
  misc_feature: GZ8MTXP01B728U.13.76.G10.1.454.CMB.2.raw
  modified_base (266)..(266): a, c, t, g, unknown or other
  modified_base (278)..(279): a, c, t, g, unknown or other
  modified_base (291)..(291): a, c, t, g, unknown or other
  modified_base (379)..(379): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggtcacgtnagtcacacctanngagcgtcggccncgaggcacggagggacgggctggagtgtcgttctttacttttaattagtagtagtaggtactaccactactccgacacgaacgtcggnggagggacagtactaccactatccgtacaagaacaactaaactaaccaaacgaaacgtaacgtacgttacgtttacttaactaaactaacgaaacgaacggacgtacggaacgaacgaccgacgtacgaaccgaccggtaccgttacgtaacgttacgtagtaaggacggaggaaggacggtaccgggtaacccgttaaccgttaaaccgttaaccgtaacgtacgtaacgtacggtacggttacggtaaccgggaaccggaaccggg

SEQ ID NO: 380829 - DNA, 648 bp, Homo sapiens
  misc_feature: GZ8MTXP01ESFYN.13.76.G10.1.454.CMB.2.raw
  modified_base (303)..(303): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgcttaattttaaaaggtgcccagtgtgaggtgcagcgtggtggagtcgtggaggaggcttgatccgagccgtgggggtccctgagactctcctgtgcacgcctcgtgggtccaccgtcagtcacacctacatgagcgtcgggtcccnccgaggcctccggaaggggaaggggctgggagtcgtcgttctttctttttatttagtagtagtggtataccatactcgcacgaactcggtggacgggtacctagttaccacctactcctaccgaagaacgaactaaacttaccgaaagaactacgtctttagttacctaacaaatcgaaactcgaccgtaggaaacgacgacccgagtaccgaccgaccgggtaccgttagttaacgttacgtgtacgggaacgtaagacggtacggttaccggggaccctaaacggttaccgttacaccgtaatagtcgggacgtcggacggggtaacccgaagggtaaccccg

SEQ ID NO: 380830 - DNA, 770 bp, Homo sapiens
  misc_feature: GZ8MTXP01AGRK3.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagcttgggttttccttgttgcttaattttaaaaggtgccagtgtgaggtgcagctggtggagtcgtggaggaggcttgactccgaggtccggtcggggggtccctggacgacctctccgtgtcgcacgtccttcgtcgggttccacccgtcacgtccacacctacagtgacgcggtcgggtcccgccggacgggtccgtaccggagggggaaggggcgtgggagtcggtcgtttacgtttactttttaagtttagtaggttaggttacggttaacgtactaacgttacctccgaacgacggtccgtccgggtacgggacggggtccctagttccaaccgtactccgtaccgaagtaacgaaacctaacttaacccgaaacgtaacctacgttactttacgtttaccttaaacgaaattaccggaaacgtacgtaccgtaggaacggacccgacgtacgttaccggaacgtaccgggttccgttagttaacgttacggtcggttcgaacgggacggttaacgggtacgggtaaccccgggggaccccttaaaacgggttaaccgtttaacccgtaggtaaccgttaggtaccgggttaccgggttcggggttaaccggggaaaccccggg

SEQ ID NO: 380831 - DNA, 670 bp, Homo sapiens
  misc_feature: GZ8MTXP01DUQXL.13.76.G10.1.454.CMB.2.raw
  modified_base (300)..(300): a, c, t, g, unknown or other
  modified_base (408)..(408): a, c, t, g, unknown or other
  modified_base (466)..(466): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgtcttaattttaaaaggtgcccagtgtgaggtgcagcgtggtggagtcgtggaggaggtcttgactccgagtccggtcgggggtccctgacgtactcctcctgtcgcacgtcctcgttcgggtccaccgtcacgtcacacctanatgacgcgtcggccgccgaggccgtacggaggggaacggggcgtggagtcgtcgttctttacttttattagttagtaggtgtagtacactactcgacacgaactcggnggacgggtcctacttccactactctaccgaagacaactaaactaccgaaaagtacccncgtttcttacgttttacaacgaaaagtcgaaacaccgtcgtaggaacggtacgaccgtaagtaccgtacgaccggttagttgttacgttaagttaccgtgggcgtaacggaaggacgttacgggacccgggaccttaaacgggttactttacgaagtcgttaacggtcgggtaccgttcgggtaacggggaaccgtaaaccggg

SEQ ID NO: 380832 - DNA, 667 bp, Homo sapiens
  misc_feature: GZ8MTXP01DOTVF.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggagcttgatccgagccgtgggggtcctgagtactctcctgtgcacgcctcgtcgggtcaccggtcagtcacaccttacatggacgtcgtcgggtcccgccgaggcctccggagggggaacggggctgggagtcggtcgtcttctttttatttagtaggttagtggtactacactaccgtccgaacagtccgtccggtgggaacgggggtccctaactttccaacctactccctacgaaaggtacgtaactaacttacccgaaaaggtaacctacggtcttacgtttacctaacaaaagttcgaaacgtaacgccgtaggacgacgcccgtatacggaacctccgggtccgttagttacgttacgtggtggacgaaggacgtacggtccggggaaccccttaggttaaaccgttaacgtacgtcgtttaaggcgggttacgttcggttcgggggaacccg

SEQ ID NO: 380833 - DNA, 690 bp, Homo sapiens
  misc_feature: GZ8MTXP01CASZZ.13.76.G10.1.454.CMB.2.raw
  modified_base (247)..(247): a, c, t, g, unknown or other
  modified_base (258)..(258): a, c, t, g, unknown or other
  modified_base (274)..(274): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgcttaattttaaaaggtgcccagtgtgaggtgcagctggtggagtcgtggaggagcttgatcagccgtggggtcctgagactctctgtgcngcctgtggtcncgtcagtcacacctanagtgacgcgtcgggccgacgacggccgtacggaggggaaggggtctagggtacgtcgtcgtttctttaacgtttttagtttagtaggttagtaggtaacgtaaccactacgtcccgagaccgtaacgtccgggtggacggggacctagttccactacgtcctaaccgaagtaacgtaaactaaaccgttaccgaaacgaaacctacggtcctttaacgtttacctaaacgaaaagttccgaaacgtaccgaccgtagggaacgtacgaccgaagtcgaaccgccggtccttagtactacgtgcggtaacgaagttcggacggttcccgggaacccgtaaagttacccggttaacttaccgggtcttacggtaaccgggtcgtacggggccggggaaacccgaacggggtaaccccg

SEQ ID NO: 380834 - DNA, 794 bp, Homo sapiens
  misc_feature: GZ8MTXP01DLTE3.13.76.G10.1.454.CMB.2.raw
  modified_base (255)..(255): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgcttaattttaaaaggtgcccagtgtgaggtgcagcgtggtggagtcgtggaggaggcttgactccgagccgtgggggtccctgacgactctctgtgcncgcctcgtcggttcaccgtcagtcacacctacatgacgtcgtcgggtcccgccgaggccgtaccggaggggaacgggggcgtgggtaggtcgtcgtttcttttactttttaagtttagttaggttaggttggttaacgtacctactaccgtcccgacgacgtaacccgttccggtcgggacggggtacccgtacgttaccacctactcctacccgaagaacgaacctaaacttacccgaaaagaaccgtacgttcttttagttttaccctaactaaaacgtcgaaaaccgtacggtacccggttaaggggaacggtaaccggaccccggtaaagtcccgggaaacccggtacccgggggttacccgtttaaggttaaaccgtttaccggtgggttaccgggaacgggaaaggttacgggtaacgggttaccccggggggaaaccccctaaacgggttaaacccgtttcttaaccggtcttaaagggtcggggtacccggtcgggttaccgggggaaccccgttaaacggggtaaccccg

SEQ ID NO: 380835 - DNA, 691 bp, Homo sapiens
  misc_feature: GZ8MTXP01BAQQX.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtcgtggaggaggcttgatccgagccgtgggggtccctgagactctcctgtgcagcctcgtggttcaccgtcagtcacacctacatgacgtcgtcgggtcccgcgacggccgtccggagggggaaggggcgtgggagtcgtcgttctttcttttattagtaggtagttcggtagtactagtacctcgaacacgtccgtcggtgggacggggtcctacgttcacgtacttcctaccgaagaacgtaacctaacttacccgaaaggtacctacgtcttacgtttctaacaaattacgaacgtagtcccgtagaacggacgtcccgagttaccggaaccgtacgggtcccgttagttacgttcggtggtcggacggaaggacgggtaacggtcccgggggttaacccccgttaaggttaaacccggtttaacccgtaacggtcccgttaagggtccggggttaacccgggttcgggttaaccggggggaaaccccg

SEQ ID NO: 380836 - DNA, 738 bp, Homo sapiens
  misc_feature: GZ8MTXP01DFOZ0.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatccgaggccgtgggggtccctgacgactctcctgtgcacgtcctcgtcggttccaccgtcacgtcacacctacatgagtcgtcgggtcccgcgaggccgtaccggaggggaaggggcgtgggagtcggtcgtttctttacttttagtttattagttagtggtataccattacgcgcacgaaccgtcgcgggacggggtacccgtattccaccactcctaccgagtacgaactaactacccgaaagtaaccacggttcttagtttacctaacaaaagtcgaaaacgcgtcccgtaaggacggtacgccgtaagtccggacgtaccgggtaccgttagttaaaccgttagtcgggaacggaacgggtaaggacggggtaacggttcccggggggaaaacccctaaccgggtttaaaacggtttaacccgttacggttaaccggtttaaaggtcccggggttaaaccgggggttccggttaacggggggggtaaccccggttaaaaaaccgggggttaacccccg

SEQ ID NO: 380837 - DNA, 645 bp, Homo sapiens
  misc_feature: GZ8MTXP01DIDXV.13.76.G10.1.454.CMB.2.raw
  modified_base (471)..(471): a, c, t, g, unknown or other
  modified_base (490)..(490): a, c, t, g, unknown or other
  modified_base (600)..(600): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagcgtggtggagtcgtggagggaggcttgactccgagccgtgggggtccctgacgactctcctgtgcagtcctcgtgggtcaccgtcacgtcacacctacatgacgtcgtcgggtccgcacggccgtaccggaggggacggggcgtggtagtcgtcgttctttatttatttagtagtagtggtactaccactacgtcgacacgtaactcggtcggacggggacctacgtaccacctactacctaccaagtacgaaactacgttaacaaaggaactacgtcgtttnttactacaaaatcgaaacncgtaccgtaggaacgaacgcgatcggaccgacggtacttagttacttaacgttgcggaagtaacggagtacgggttccgggaaccctaacgttaacggtttacaccggtntaacgtcgggtaaccgtcgggacgggtaaccgaacggtaacccgg

SEQ ID NO: 380838 - DNA, 826 bp, Homo sapiens
  misc_feature: GZ8MTXP01EIQS0.13.76.G10.1.454.CMB.2.raw
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggaggaggtcttgatccgagccgtcgggggtccctgagactctcctgtgcagcctcgtggtcacgtcagtcacactacatgagcgtcggtccgccgacggcgtacccggagggggaacggggcgtagggagttcggtaccgtttcttttactttttaagttttagttaaggttaggttaggttaacgttactaacgttaccgtacccgacgtaaaacgtaccgtccgggtacgggacgggggtacccgtacgttaccgaaccctactaccctaccgaaggtaaacgtaacctaaacgttaacccgaaaagtaaacccgtaacgttccgtttacgttttaacccttaaacgaaaagttacgaaacctacgggggtacccttaaggggaacgtaccggacccggtaacgtacgggtaaccccggtaaccggggttccccggttaagtttaacgttttaaaccggtgggtaacggaacgggttaagggaacgggtttaaccgggacccggggggtaacccccttaaaaccggggttaaaccgttttaacccgaacgggttacccgttaagggtccgggggtaaccggttccggggtaaccggggggaacccgtaaaacccggggg

SEQ ID NO: 380839 - DNA, 614 bp, Homo sapiens
  misc_feature: GZ8MTXP01D7IZF.13.76.G10.1.454.CMB.2.raw
  modified_base (343)..(343): a, c, t, g, unknown or other
  modified_base (460)..(460): a, c, t, g, unknown or other
  modified_base (468)..(468): a, c, t, g, unknown or other
  modified_base (514)..(514): a, c, t, g, unknown or other
  modified_base (574)..(574): a, c, t, g, unknown or other
  modified_base (593)..(593): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagcgtggtggagtcgtggaggaggtcttgactccgaggccgtgggggtccctgacgactctcctgtgcagcctcgtgggtcaccgtcagtcaccacctacatgagcgtcggtcccgccgagcgccgagggaggggcgtggtagtgtcgttctttnttttagtttatagttagtaggtagtacctatacgcgcacgtaactcgtcgggaggtcgtacgtcaccatctcaacgagtaactaactacgtaaacgactaacgttcttagtttcaanaaacggtnaaacgtcgcgtaggacgaccgtaccgagtaccgactccgggtactnttaacgtctgggtcgaagaggcgtaacggttcggtaccaacggttacgttacgttacggnttaaggcgacggttccggngggtaaccgaaacgggtcccg

SEQ ID NO: 380840 - DNA, 609 bp, Homo sapiens
  misc_feature: GZ8MTXP01BA6J8.13.76.G10.1.454.CMB.2.raw
  modified_base (376)..(376): a, c, t, g, unknown or other
  modified_base (475)..(475): a, c, t, g, unknown or other
  modified_base (508)..(508): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccaggccgtgggggtccctgacgtactctcctgtgcagcctctcgggtcaccgtcagtcacactacatgagcgtcgggtccgcgaggcctccggaagggaaggggctggagtcgtcgttctttactttttattagtagtaggtggtagtaccatactccgnacgaactccggtggacggggtcctagttccaccgtatcctaccagaacgaactaattacccgaaagaacacgtctttgtttacctacaaagtcgaaacngccgtagacgacaccgatcgacgacggtccgtnttaacgttacgtggtagcgtaaggacgagttccggggaccaacgttaacgttcgaccgctagtcgggtacgtcggttacggggccttaaacggggaacccg

SEQ ID NO: 380841 - DNA, 644 bp, Homo sapiens
  misc_feature: GZ8MTXP01EZ01X.13.76.G10.1.454.CMB.2.raw
  modified_base (557)..(557): a, c, t, g, unknown or other
  modified_base (599)..(599): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgcttattttaaaaggtgccagtgtgaggtgcagctggtggagtcgtggaggaggcttgacgtcccgccgtggggggtccctgagactctcctgtgcacgcctcgtgggttcacgtcagtcacacctacatgacgcgtcggtccgccaggcctaccgagggggaacggggcgtagggagtcgcgtttcttcttttatttagtagtaggtgtacgtacagtactccgcaagtaccgtcggtggacggggccattccgactatcctaccaagacgaactaacttaacccaaaggaacctacgtactttagtttaccttacgtaaattgaaaacctcgggacccgttaggacgacggacccgagtacgaaccgaccgggtccgttagtacttacgtggtcgngaggagttacggccggggtacccaacgttacgttacgtccgngtaacgtcgggtacgttcggtaacgggggaacccgtaaaccgggg

SEQ ID NO: 380842 - DNA, 600 bp, Homo sapiens
  misc_feature: GZ8MTXP01AQHOT.13.76.G10.1.454.CMB.2.raw
  modified_base (509)..(509): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtgggtccgcaggctccgaggggaaggggctggagtgcgtcttcttttattatagtagtggtagtaccatactccgcacgtaaccgtccggtggacggggccgtattccaccatcctaccagtacgaactaacttaccaaaggaacctacggtctttagtttactacaaatcgaaactgcctaggacgacgacccgatcgaccgacgggtccgtgtaacttcgngtggaacggtagacggtacgttcggggaccctaacgttaacggttcacggtctagcgggacgtcggcggggtaacccgaacggggaacccc

SEQ ID NO: 380843 - DNA, 699 bp, Homo sapiens
  misc_feature: GZ8MTXP01DH8FF.13.76.G10.1.454.CMB.2.raw
  modified_base (496)..(496): a, c, t, g, unknown or other
tcagtcacgtactacacgaccggtgctcgatttagtcactcatacagggggagcctgggcctcaggaagcagcatcggaggtgcctcagccatggcatggatccctctcttcctcggcgtccttgcttactgcacaggatccgtggcctcctatgagctgactcacgcccaccctcagtcgtcccgtcgtaccccgaggacagacacgccagcactccacctgctacgtaagaaataagttggacaagtaattaaatacttaccttcgtaggtatcgagacgtaagaacgtcgacggcctacgtccctgtcgtcgtgtcacttactaatacgaagactccgaccgacggcccgtaccgtacggacgggtacccctcccggtaggacgtacgtacttcctcgtcggtaccctacccgtaacgtcggtaacgggacctacgacgtaccctacgtcctacgacctagacccggacggtacccggaccgaggtacttagnggtacgtcgggacgggtctaggttaacttacggttacgtcggtacggcgggtacggtacgggacctaggaccgtacggtcctaaccggcgttaccccgttagtttacggtccggttaaccggtttaccggggaaacccggttcggggaaaacccgttcggtacccgtaacccggttaccgttaaccggccccgtaaaccccgg

SEQ ID NO: 380844 - DNA, 684 bp, Homo sapiens
  misc_feature: GZ8MTXP01BPLP9.13.76.G10.1.454.CMB.2.raw
  modified_base (236)..(236): a, c, t, g, unknown or other
  modified_base (245)..(245): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgccctcagtcgtcgtcggggccccagggcagaggtcacatctctgcacgtgggancagctcacngtgggacacgattatgatgtacacgtcggtaccagtctagtttcccgaggaacgtcgacgggtaccccaggtacccttcctacaacttacaaaacgttaaccgtaaacaaaccgtaaacgtcccgggaccccgaaccggtaaccgggggtcccctacgggaaccccgtagttccctaccgtcgggtccttacccgacgggttcgtaccgggaccctaccttccgaccgtcccccgttcccgttacgggtaccgtaacttcccgtaacggttccgggaccctttaccggggaacgggtccgtagggacgggtaagtccgggtaagtccgttaaggttactttacgtttccgcggtacccctaaggtcccttagacgttacgaggtcagttccttggtaagtcgtcgttacgggtcgttccgggggcgggttaacctcggg

SEQ ID NO: 380845 - DNA, 595 bp, Homo sapiens
  misc_feature: GZ8MTXP01AJ0AT.13.76.G10.1.454.CMB.2.raw
  modified_base (488)..(488): a, c, t, g, unknown or other
  modified_base (524)..(524): a, c, t, g, unknown or other
  modified_base (531)..(531): a, c, t, g, unknown or other
  modified_base (562)..(562): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggtcaccgtcagtcacacctacatgagcgtgggtcccgccgaggcctccggaggggaagggggctgggagtggtcgttctttctttttagttatagttaggtggtagtaccactactccgcagaaccgtccgtgggacggggtcccgattccacctatcctaccaaggacaacctaaattcccaaagaacctcgtacttgtttactacaaatgaaactgaccgtgaacgngacccgaatcgacgacgggtccttggtaacttgtgngcgaagngaacgcggggaccccagttaacgttcaccgntagcgggactcgggacgggccgaaggggtcccc

SEQ ID NO: 380846 - DNA, 611 bp, Homo sapiens
  misc_feature: GZ8MTXP01BTW3H.13.76.G10.1.454.CMB.2.raw
  modified_base (251)..(251): a, c, t, g, unknown or other
  modified_base (384)..(384): a, c, t, g, unknown or other
  modified_base (453)..(453): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccaggccgtgggggtccctgagactctcctgtgcngcctcgtggtcaccgtcagtcacacctacatgagcgtcgggtcccgccgaggccgtccgaggggaggggcgtggagtgcgttctttcttttattagtagtagtggtagtaccatactccgcacgtacctcggnggacggggcctattccaccatctaccagacgactaatccaaagacacgtcttgtttctacaaatgaacngccgtgacgagaccgatcgaccgtaccggtccgtgttacgttacgtgtggaacgtaggacggtacggttccgggggacccctaacggttaaccgttacgttacgtcgttagtcgggtaccggtcggttacgggggtaacccgaaacggggtaaccccg

SEQ ID NO: 380847 - DNA, 808 bp, Homo sapiens
  misc_feature: GZ8MTXP01DTM34.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatccgagccgtgggggtccctgacgactctcctgtgcagcctcgtgggttcaccgtcacgtcacacctacatgacgtcgtcgggtcccgccgacggccgtaccgggaagggggtaacgggggccgtagggggtacggttcggtccggtttccgtttttaacgtttttttaagttttaagtttaagggtttaaggttacggggttaacgttaaccctaacgttaccgtcccgacgtaacggtaacccgttccgggtcggggacgggggtacccgtaactttacccaaccctacttccgtacccgaaggtaacgaaacctaaacgttaccccgaaaaggtaaaccctaaccggttccttttacggtttttaaccttaaccgaaaaagttcgaaaaccgtcggtaccgtaaggacggacgacccgtagtaccgacgtaccggtaccgttagttaacgttacgtcggtaggaaccggtaaggacggtaacggttacccgggggtaacccctaacggttaaaccgggttaccttacggtaacgttaggtaacggtccgggtacggttaccgggggaacccgttaacggggtaaccccg

SEQ ID NO: 380848 - DNA, 612 bp, Homo sapiens
  misc_feature: GZ8MTXP01BUM1P.13.76.G10.1.454.CMB.2.raw
  modified_base (334)..(334): a, c, t, g, unknown or other
  modified_base (395)..(395): a, c, t, g, unknown or other
  modified_base (450)..(450): a, c, t, g, unknown or other
  modified_base (575)..(575): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggagcttgatcccagccgtgggggtccctgagactctcctgtgcacgcctcgtgggttcaccgtcagtccacacctacatgacgcgtcgggtcccgccgaggcctccggagggggaggggcgtgggnggtcgtcgttctttctttttattagtagttagtcggtatacatacctccgacacgcgtcgngggacgggtcctatcactatcctacagacgtaactaacttacccgaaaagaaccncgtacttcgtttacctaagaaaagtcgaaacgacggtcctaggacggtacgcccgataccggacgtacggtccgttagtacttcgcgtagcgaagcgtacgtcggggacccaggttaccgttaanacggtcttaggcggttaccgtccggttggggaacccg

SEQ ID NO: 380849 - DNA, 768 bp, Homo sapiens
  misc_feature: GZ8MTXP01AKF2W.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtcgtggaggaggcttgatccaggccgtcggggggtccctgacgactctcctgtgcacgtcctcgtcgggttcaccgtcacgtcacacctacatgagtccgtcgggtacccgccgaggcctaccggagggggaacgggggcgtgggacgtcgtccgttctttactttttatttagtagtaggtgtagtaccatacgtcgcagtaaccgtcccggtgggacgggggccctactttaccgaccacttccgaccctaaggaacgtaaacctaaacttaacccgaaaggtaacccaacggttctttacggttttaaccctttaaacaaaacgttacgaaaccgtaggtaccccggttaggaaacgggaccgacccggtagttacggaacccggtaaccgggttcccggtttagttaacctttaaccggtgggtacggtaaccggaaggagggtaacgggttcccgggggaaacccctaaacgggttaacccggtttaaccaccgggtaacttaacgggtcggggtaacccggttccggggacgggggaaccccgaaacgggggttaacccccgg

SEQ ID NO: 380850 - DNA, 785 bp, Homo sapiens
  misc_feature: GZ8MTXP01DIE44.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgcttaattttaaaaggtgcccagtgtgaggtgcagcgtggtggagtcgtgggaggaggtcttgactccgacggccggttcgggggtccctgacgtacctcctcctgtcgcacgtcctcgttcgggttccaccgtcacgtcacacctacatgacgtcgtcgggtcccgcgacggccgtaccggaaggggacgggggcgtagggagtcgtcgtttctttacttttatttagtagttagtgtacgtacactactccgcacgtaacccgtcggtcgggacggggtacccgtacttaccaacctactaccgtaccgaagaacgtaaacctaaacgttacccgaaagtaaacccgtaacggttcctttacgttttacctaaacgaaaacgttcgaaaccgtacggtacccggttaagggaacggtaaccggacccggtaaacgttccgggaaaccggtacccgggttacccggtttaggtttaacctttaaccggtggtacgggtaaccggaaggttacgggtaaaccgggttcccgggggtaaacccctaagggttaaacccgtttcgttaacggtcttaacgggtcgggtaccggtcgggttacgggggaaccccgttaacggggtaaccccg

SEQ ID NO: 380851 - DNA, 706 bp, Homo sapiens
  misc_feature: GZ8MTXP01BVH2M.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtctggaggaggcttgatccagccgtgggggtccctgagactctcctgtgcagcctctgggtcaccgtcagtcacacctacatgagcgtcggtccgccaggctccggaggggaaggggctgggagtgcgttctttcttttattagtagtagtgtagtaccatacgtccgcacgaaccgtccggtgggacggggccgtattccaccgtactctacccgagtaacgaacctaaattcccgaaaagtaacctaaccggttctttacgttttaccttaaccgaaaagtcggtaaaaccacggtaccgttaagggaaccggtaaccgaccggtaaacgtcggaacccggtaccggttacccggttagttaaacctttacggtggtccggaacgtaagggacggtaacgggttcccggggaaacccctaacgggttaaacccgtttccgacggtcgttaagggtcgggtaaccggtcggggttaccggggaaccgttaaaccggggtaaccccg

SEQ ID NO: 380852 - DNA, 695 bp, Homo sapiens
  misc_feature: GZ8MTXP01DAIPQ.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctattttaaaaggtgcccagtgtgaggtgcagcgtggtggagtcgtggaggaggcttgatccgagccggtgggggtccctgacgactctcctgtcgcagcctcgtcgggttcaccgtcagtcacacctacatgagcgtcgggtcccgcaggcctccggaggggaggggctgggagtcgtcgtttctttattttattatagtagtggtactaccatacgtcgcagaacctcgggtggacggggtcctattccacctatcctacaagacaactaatccgaaagtaccacgttctttagtttactaacaagtacgaacacggtccgtaggacggacgacccgtaagtccgacccgaccgggttcctttagtaacctttagcgggttaggaacggtaaggacgggtaacgggttcccgggggtaaacccctaacggtttaaaacccggtttccgttaccgggttaacctttaaggggtccggggtaccccggttacgggggttaccgggggaaaccccggaaaccgggggttaacccccgg

SEQ ID NO: 380853 - DNA, 636 bp, Homo sapiens
  misc_feature: GZ8MTXP01D1M3C.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggtcaccgtcagtcacacctacatgagcgtgggtccgcgaggcctccgaggggaaggggctggagtgcgttctttcttttatttatagtagtgtagtaccatactccgcagaacctccggtggacggggcccgtattccacctatctaccagacgactaacttaccaaagaacctacgtctttagtttactacaaaagtcgaaactcgccgtaggaacgacgcccgaatcggaccgtacgggacccgtttgttaacgttaccgtggtagaacggaagacggtacggttcgggggacccctaacggttaaaccggttttcaacggtccttaagtcgggtaacccggttcggacgggggtaacccaaacgggggtaacccc

SEQ ID NO: 380854 - DNA, 683 bp, Homo sapiens
  misc_feature: GZ8MTXP01EKGMT.13.76.G10.1.454.CMB.2.raw
  modified_base (169)..(169): a, c, t, g, unknown or other
  modified_base (251)..(251): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtgcctcctatgagctgactcagccaccctnagtcgtccgtcgtccccaggacagacagccagcatcacctgctactagaaataatggacaagataaatactacttctgtatnagacagaagtcaggccacgtcccctgtcgctggtcatcctatacaagatcgaccaacggccgccctcgacggtactcccccgtagacgtcgtacttccgtcgtcggtccctaccgaaaccgttcgtacgggtaacctcgaacgtccctaacctcctacggaaccctacgtaccgaacgggacccggggaaccccgtaggtaccgtttaacggtacgggaagtagggtacggtacggttaacggttaactttaacgttaccggtttacgtaccgggtaacgggcgggttacggggaacgtacggtaccgaacgggcctaaaccggttccgacccggttacttaacggtccggttaccgttaccgggaacgttaccggggaacctaacggtaacccgtaaccgttacccgagtaaccccgaacggaacccccgg

SEQ ID NO: 380855 - DNA, 604 bp, Homo sapiens
  misc_feature: GZ8MTXP01B9LMC.13.76.G10.1.454.CMB.2.raw
  modified_base (280)..(280): a, c, t, g, unknown or other
  modified_base (294)..(294): a, c, t, g, unknown or other
  modified_base (461)..(461): a, c, t, g, unknown or other
  modified_base (501)..(501): a, c, t, g, unknown or other
  modified_base (527)..(527): a, c, t, g, unknown or other
  modified_base (529)..(529): a, c, t, g, unknown or other
  modified_base (565)..(565): a, c, t, g, unknown or other
  modified_base (569)..(569): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtggggggtccctgagactctcctgtgcagcctctgggttcaccgtcagtcacactanatgagctgggtccncaggctcgagggagggctggagtgcgtcttcttttattatagtagtggtataccatactcgcagaacctccggtggacggggcccgtattccaaccgtatccgtaccgaagaacgaacctaaatttaccccaaagtaaaccctacggtcttagttttacccttaaanaaaactcgaaactcggtaccgtaggaacgacgaccgtaanccggacgacggtccttagtaattcgngngaacgagagcggccggaaccctaagttaccgttacncgtntacgcggacggtcggacgggtaaccgaacgggtcc

SEQ ID NO: 380856 - DNA, 615 bp, Homo sapiens
  misc_feature: GZ8MTXP01AW57X.13.76.G10.1.454.CMB.2.raw
  modified_base (462)..(462): a, c, t, g, unknown or other
  modified_base (472)..(472): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttaattttaaaaggtgcccagtgtgaggtgcagctggtggagtcgtggaggaggcttgactccgagccgtgggggtccctgacgactctcctgtgcagcctcgtggttcaccgtcagtcacacctacatgagcgtcggtccgcaggctccggaggggagggctggagtgtcgtcttcttttattagttagtagttggtaatacctatacgtccgcacggtaaccttccggtggacggggtcccgtaattccaactactctacccagaacaactaacgtcaaagactacgtcttgttacctaaanaatacgaacncgacgagagacgacgagaccgacgtacggttactagttactacgtgcgaacggaggttacggacggttcccgggaaccctaacggttaacgttcgacgtaacgtagtcgggacggtcgggaccgggaacccaacggggaaccc

SEQ ID NO: 380857 - DNA, 705 bp, Homo sapiens
  misc_feature: GZ8MTXP01A4ARB.13.76.G10.1.454.CMB.2.raw
  modified_base (515)..(515): a, c, t, g, unknown or other
  modified_base (543)..(543): a, c, t, g, unknown or other
  modified_base (603)..(603): a, c, t, g, unknown or other
tcagtcacgtactacacgaccggtgctcgatttagtcactcatacaggggtgggagaggagcccagcactgggattccgaggtgtttccattcggtgatcagcactgaacacagaggactcaccatggagttttggctgagcttgggttttccttgttgcttaattttaaaaggtgcccagtgtgaggtgcagctggtggagtcgtggaggaggcttgactccgaggccggtggggggtccctgacgtacctcctcctgtgcacgcctcgtggttccaccgtcacgtccacactacatgacgtcgtcggtcccgcgacggccgtaccggaagggggaacgggcgtagggacgtcgtcgtttcctttagttttttaagttaagttaggttaaggttagttaacggtaacctacttacccgtcccgactaaacgggtaccgtccgggtgggacggggaccctataccacccattccaccgaagaaccaaactaacgtaacccaaagaacctacggtntttacgtttacctaacgaatacgaaacnggggtcctaagggaccacggtaccaagtcgaccggtacggtccgttagtacgtttacggnggtcgaacggttaggacggttacggacccgggtaacccttaacggttaaccttacgcgtacgtaagggccgtacggttcgggaaccgggttaacccgaacgg

SEQ ID NO: 380858 - DNA, 718 bp, Homo sapiens
  misc_feature: GZ8MTXP01ANK7I.13.76.G10.1.454.CMB.2.raw
  modified_base (575)..(575): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgaccttgggttttccttgttgctattttaaaaggtgcccagtgtgaggtgcagctggtggagtctggaggaggcttgatccgagccgtcgggggtccctgacgactctcctgtgcacgcctcgtcgggttcaccgtcagtcaccacctacatgacgcgtcgggtccgccgacggccgtaccggaagggggaacgggggccgtagggacgtcggtccgtttctttactttttagtttagttaggtaggttggtaacgtactacgtaccgtccgactaacgtaccgtccggtagggacggggtccgtattacccgactactcctaccgagaacgtaacaacttaccgaaagtaaccgacttcttacgtttactaaccaaagtacgaaacgacggtcctaggaacgacgtcccgaagtaccgaccgacggtaccggttnttaacgttccgtggtcggaacggaagggtacggaccgggtaaccggggaaccccttaaacggttaacccggttaacgtaacccggtcgttaacgggtacgggtaccgggttacgggtaaccggggaacccgggtaaaccgggg

SEQ ID NO: 380859 - DNA, 724 bp, Homo sapiens
  misc_feature: GZ8MTXP01AM765.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttaattttaaaaggtgcccagtgtgaggtgcagcgtggtggagtcgtggaggaggtcttgactccgacggtccggtcgggggtccctgacgtactctcctgtgcacgtcctcgtcgggtccaccgtcagtcaccactacatcggacgcgtcgggtcccgccgacggccgtaccgggaagggggaacgggggtcgtagggacggttcggtccgtttcgttttacttttttaagtttagttaaggttaggtacgggttaagtacctacgtaaccgtccgacgaacgtaaccgtcccgggtgggacggggtccctaattcccgacctactctaccgaaggaactaaacctaacgttaaccgaaaaggtaacccgtaccggttacttttacgtttaaccaaacgtaaaagttacggaaactaccggcgttaggaaacggtacgaccgtaagtccgaaacgtcccggtaccgttaagtactttaccgtgtcggaagtaacggagcgggacgggaaccctaacggttacgttacacgtctaggtcggacgtggcgggaaccgaacggcccg

SEQ ID NO: 380860 - DNA, 790 bp, Homo sapiens
  misc_feature: GZ8MTXP01EZNG4.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttaattttaaaaggtgcccagtgtgaggtgcagcgtggtggagtcgtggaggaggcttgatccgagccgtgggggtccctgagtactctcctgtgcagtcctcgtgggtccaccgtcagtccaacacctacagtgacgtcgtcgggtccccgccgacggccgtacccggaaggggggaacgggggtccgtagggggaacggttcggtcccgttttaccgtttttaccttttttttaaggttttaagtttaagggtttaaggttacgggtttaaacggttaacccctaaacgtttacccgtacccggtaccgtaaacggtaaccccgttccccggggtaaggggtaaccggggggtacccctaaacgtttaccccaaccctaacgttcccttaacccggaaagtaacgtaaacctaaacgttaacccgaaaagtacccgtaacggtcttttacgtttaccttaaaccgaaaattcgaaaaccgcgtcccgtaggaacggacgacccgaataccggaccgtaccggtacgttgtaacttacgtgtcggaagaagacggtacggttccggggacccctaaggttaacgttcgacgtctagcggtacgtcggacggggtaacccaacggggtccc

SEQ ID NO: 380861 - DNA, 539 bp, Homo sapiens
  misc_feature: GZ8MTXP01DM7OQ.13.76.G10.1.454.CMB.2.raw
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctgggggtccctgagactctcctgtgcagcctctgggttcaccgtcagtcacacctacatgagctgggtccaccaggctccgaggggaaggggctggagtgcgtctcttttatttatagtagtggtagtacatactccgcaagactccgtgaggggccattcaccatctccagagacaattccaagaacacgctgttcttacaaatgaacaggcctgagagcccgatgacacggccgtgtattactgtggcgagagagtcggggcccacggaaccgttactaacgctaagtgggacgttcgtcggggccgaaacgggg

SEQ ID NO: 380862 - DNA, 752 bp, Homo sapiens
  misc_feature: GZ8MTXP01D0KJ7.13.76.G10.1.454.CMB.2.raw
  modified_base (663)..(663): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtcgtggaggaggcttgatccgagccgtgggggtccctgagactctcctgtgcacgtcctcgtggttcaccgtcagtcacacctacatgacgtcgtcgggtcccgccgaggcctaccggagggggaaaggggcgtagggggacgttcgtccggttctttacgttttttaatttaagttagggtaggtttacgggtaacggttaactaacgttaccctcccggtaacgaacgttaacccggtcccgggttagggacccggggggtcctaaactttccccgaaacccgttactacccgtacccgaaagggtaacgaaaccttaaacgtttaacccgaaaagtaaacccgtacggttacttttacgtttacttaactaaaacgttcgaaaaccgtacgtacccgtaaggaacggacgacccgagtaccggaaccgacccgggttcgttagttacgttaacgtggngttacggagaaggtacggtacggggacccttaacggaaccgtttaacgaacgtcgttgtaccgggttccgttcgaacgggggaacccgg

SEQ ID NO: 380863 - DNA, 577 bp, Homo sapiens
  misc_feature: GZ8MTXP01ET8IR.13.76.G10.1.454.CMB.2.raw
  modified_base (174)..(174): a, c, t, g, unknown or other
  modified_base (255)..(255): a, c, t, g, unknown or other
  modified_base (293)..(293): a, c, t, g, unknown or other
  modified_base (328)..(328): a, c, t, g, unknown or other
  modified_base (356)..(356): a, c, t, g, unknown or other
  modified_base (371)..(371): a, c, t, g, unknown or other
  modified_base (400)..(400): a, c, t, g, unknown or other
  modified_base (418)..(418): a, c, t, g, unknown or other
  modified_base (436)..(436): a, c, t, g, unknown or other
tcagtcacgtactacacgaccggtgctcgatttagtcactcatacagggggtgggagaggagcccagcactgggattccgaggtgtttccattcggtgatcagcactgaacacagaggactcaccatggagttttggctgagctgggttttccttgttgctattttaaaaggtnccagtgtgaggtgcagctggtggagtctggaggaggcttgatccagccgtgggggtccctgagactctcctgtgcagcctntgggttcacgtcagtcaccactacatgagcgtcggccnccaggctccgaggggagggctggagtgcgttcttnttttattatagtagtcggtatcgatacnccgacaagactccgnggacggggcccattcacctatctacaganacaacttcaaagtaaacntcttgtttacacgtaaanacacacgacgtagagacgacgagacgacgacgtcgtagtagttacgtgtcgcgaggacggacggtacggtaccgttaacgttaacgttaccgtaacgtacgtaacgtacggtacggttacgggtaacgggaaccggaacgg

SEQ ID NO: 380864 - DNA, 707 bp, Homo sapiens
  misc_feature: GZ8MTXP01BRTIY.13.76.G10.1.454.CMB.2.raw
  modified_base (253)..(253): a, c, t, g, unknown or other
  modified_base (271)..(271): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtctggaggaggcttgatccgaggccgtggggggtccctgagactctcctgtgcngcctcgtggttcaccgtnacgtcacacctacatgagcgtcgggtcccgccgaggcctccggaagggggaagggggctgggagtcggtcgttctttctttttagttatagttaggtaggtataccatactccgcagaaccgtccggtgggacggggcctattccacctatcctacccgaagacgaacctaaacgttacccgaaaaggtaacctaaccggtccttttacggttttaccttaaccgaaaaagttcggaaaactaccggaccgttaagggaaccggacggacccgtagtaccggaaccgtaccgggtaccgttgttaaacgttacgtgggtcggaacggtaaggaacggtacggttaccgggggacccctaaacgggttaacgtttccgttaacggtctaggtcggggtaccgtcgggttaccgggggaaccgaacgggggtaacccc

SEQ ID NO: 380865 - DNA, 620 bp, Homo sapiens
  misc_feature: GZ8MTXP01A75Q6.13.76.G10.1.454.CMB.2.raw
  modified_base (372)..(372): a, c, t, g, unknown or other
  modified_base (469)..(469): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtcctgagactctcctgtgcagcctcgtgggttcaccgtcagtcacacctacatgagcgtcgggtcccgccgaggcctccgaggggaggggcgtgggagtgtcgtctttactttttatttagtagtagtggtagtaccattacnccgcagaacctcggtggacggggccattcactactctaccagacgactaaacttcccaaagaactacgtctttacgtttactacaaaatcgaaaccncgcgtagacgacgacgatcgacgtacggtcgtagtagtcgtggtagaacggaacggacgggtacgttcccggggaaaccctaacggttaaccgttcgacgtaagtacggtaacgggaccggtcggttaccggggaacccgaacgggtcccg

SEQ ID NO: 380866 - DNA, 738 bp, Homo sapiens
  misc_feature: GZ8MTXP01B57XC.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctattttaaaaggtgcccagtgtgaggtgcagcgtggtggagtcgtggagggaggcttgactccgaggccgtgggggtccctgagtacctctcctgtgcacgtcctcgtgggttcaccgtcagtcacacctacatgagcgtcgggtccgccgaggccgtaccggacggggaaggggctggagtgtcgttctttcttttattatagtagtggtagtaccatactccgacacgtaaccgtccgtgggacgggcccgtaattccaccgactctacccgaagtaacgaactaaacgttcccaaaagaacccgtaaccggttctttacggttttaaccctaaacggtaaaaacttcggaaaacctaccgggtcccgttaagggaaggggaaccgacccggtaaagttcggaaacccgtacccgggttacccgttggttaaaacttccgtggttacggaaccgggtaaggttaacggtccggttccgggggaaacccctaacggttaaaccgttcgttaaaccggtcgttaaacgtggggtcccggttcggggttaccggggtaaccgaaaacccgggggttcccc

SEQ ID NO: 380867 - DNA, 699 bp, Homo sapiens
  misc_feature: GZ8MTXP01C2PD7.13.76.G10.1.454.CMB.2.raw
tcagtcacgtactacacgaccggtgctcgatttagtcactcatacaggggctgggagaggagccccagccctgagattcccaggtgtttccattcagtgatcagcactgaacacagaggactcaccatggagttgggactgagctggtattttccttttggcttattttaaaaggtgtccagtgtgaagtgcagctggtggagtcgtgggggaggcttggtacagcctggcaggtccctgagactctcctgtgcagcctctggattcacttgatgattatgccatgcacgtggggtccgcaacgccgtacgaggggacggccgttgggagtgggtctacgtaggttatttaggtaggaataggtggtaagactaagtaacgggcttaagtcgggacggtaaccttcgttagggtacgggaaacggggtccgtaatttaccgaacctaacttcccgtaacccgaagaacgaaaccgaaaccgaccaaacggtaaacccttccctaggggttaactcgtacgaaccaaaagtcggaaactacggtacctaggtaaggacgaccgttagggaaacgggaacccgttacgggttccctttggttaaactttgtttacggttacggaaacctaaaaacgtaacccttaaccccgttaaaccccgtttaggtttaagttttttaacggggaaggttttaacgggg

SEQ ID NO: 380868 - DNA, 732 bp, Homo sapiens
  misc_feature: GZ8MTXP01AZ484.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaggtgccagtgtgaggtgcagcgtggtggagtcgtggaggaggcttgatccgagccgtgggggtccctgagctctcctgtgcacgcctcgtgggttccaccgtcacgtcacacctacatggacgcgtcgggtcccgccgacgggccgtaccgggagggggaacgggggctggggacgtcgtcgtttacgtttcttttttaagtttagtaggttacggttggttacgtactacgttaacccgtccgacaacggtccgtccgggtagggaccgggaccgtacttccaacctactcctaccgaagtaacgactaacttaaccgaaacgtaacctacgttcgtttagtttacctaaacgtaaagttccgaaaacgtcggtccgttaagggaacgtacggcccgaaagttaccgaaacccggtcggtaccgtttagttaacctagttgggtcgacggggaagacgggtaccggtccgggggaaccccttaaacggttaaccggtttaaccaaacggttccgtaaaggtcccggggttaccgggttcggggcccgggggaaaaccccgg

SEQ ID NO: 380869 - DNA, 655 bp, Homo sapiens
  misc_feature: GZ8MTXP01DUJAU.13.76.G10.1.454.CMB.2.raw
  modified_base (219)..(219): a, c, t, g, unknown or other
  modified_base (232)..(232): a, c, t, g, unknown or other
  modified_base (241)..(241): a, c, t, g, unknown or other
  modified_base (253)..(253): a, c, t, g, unknown or other
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagcccaccctcagtcgtcccgtgtccccaggaccagacagccagcatcacctgctntagaaataatganagataaatntctctgatcagnagagtcaggccacgtccctgtcgcgtggtacatactatacgaagtacttcggacccaaggccccggtacccgtacggtaacggggtacccctcccccggtaggacgtaccggtactttaccccgtgtcgggtacccttacccgtaaacccgttcggacgggtaacctcgaacgtccctagtacctcgacctactaccgacggaccggaccgagggtctaggtgaagttcggagggttcctagttaaccttagttaacgtcgtcggtacggtacggtcggggaaaccacgccgacgtcccgtacgttccggtacccgttagttacgttccggttaccgttaacgggacgtccgggaccctaacggtaacggtcccgttaccggttaaccgttaacgtaacccg

SEQ ID NO: 380870 - DNA, 542 bp, Homo sapiens
  misc_feature: GZ8MTXP01C2SDG.13.76.G10.1.454.CMB.2.raw
  modified_base (385)..(385): a, c, t, g, unknown or other
  modified_base (388)..(388): a, c, t, g, unknown or other
  modified_base (393)..(393): a, c, t, g, unknown or other
  modified_base (426)..(426): a, c, t, g, unknown or other
  modified_base (473)..(473): a, c, t, g, unknown or other
  modified_base (488)..(488): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtgggtcccgcaggctccgagggaaggggctggagtgcgtcttcttttatttatagtagtggtagtaccatactcgcagaactcgtgagggccatcacntcncaganacatcaagacagtctgtttctacaaatcgaacngccgtgacgtagccgatcgacgacggtcgtagtatactggtgcgagngtagcggggaacccngttaaccgttcttacgctagtcgggactcggttaggggccgaacggggaacccg

SEQ ID NO: 380871 - DNA, 645 bp, Homo sapiens
  misc_feature: GZ8MTXP01D8R4M.13.76.G10.1.454.CMB.2.raw
  modified_base (290)..(290): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcgtggttttcctgttgctatttaaaggtgccagtgtgaggtgcagcgtggtggagtcgtggaggaggcttgatccaggccgtgggggtccctgacgtactctctgtgcacgtcctcgttcgggttcaccggtcacgtaccaccacctacngtgagcgtcgggccgctaggcctaccggaagggggaggggtcgtaggtacggtcgtcgtttctttactttttagtttagtagttaggtggtaactcctaactcgtaccgcacgtaacccgtcggtcggacgggggtacctattaccaactctacgtacagacactaactacaaagactacgtctttattctaacaaatcgaaactcgaccggtagacgacgaccgtagacgacgtaaccggtccgtagttaactcgtagtcgaagagacggtaacggttccgggaccgaacgttaacgttccgagtaaccgtgtaaccggcggtccgttaggggaacccgttaacgggtaacccg

SEQ ID NO: 380872 - DNA, 688 bp, Homo sapiens
  misc_feature: GZ8MTXP01CEZIV.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgcttattttaaaaggtgcccagtgtgaggtgcagcgtggtggagtcgtggaggaggcttgatccgagccgtgggggtccctgacgactctcctgtgcagcctcgtcggtcaccgtcagtcacacctacatgacgcgtcggtcccgccgaggccgtaccggaggggaggggcgtggagtcgtcgttctttacttttatttagtagtagtgtagtacctatactcgacacgaacgtccggtgggacgggacctacgttccacctactcctaccgagacgaactaactacccaaaagactacgtctttacgtttacaacaaatcgaaactcgaccgtaggaacgacgccgtaagtccgaacgtaccgggtaccgttgttaaacttcgtggtggaaccggaaggttaaggtaaaccgggttccgggggaaaaccccctaacgggttaaaaccgtttccggttaacccggttgtaacgggttccggggtacccggttcggggaacggggggaaccccgttaaaacgggggtcccccg

SEQ ID NO: 380873 - DNA, 601 bp, Homo sapiens
  misc_feature: GZ8MTXP01AXLOP.13.76.G10.1.454.CMB.2.raw
  modified_base (266)..(266): a, c, t, g, unknown or other
  modified_base (368)..(368): a, c, t, g, unknown or other
  modified_base (379)..(379): a, c, t, g, unknown or other
  modified_base (448)..(448): a, c, t, g, unknown or other
  modified_base (505)..(505): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggtcaccgtnagtcacactacatgagcgtcggtccgcgaggctccggagggaaggggctggagtcgtcgttctttctttttatttagtagtagttggtagtaccatactcgnacgacttcggngacggggcctattccgacatctaccagaacgactaattaccaaagtacaccgtacttgtttacctaaanaaacgtacaacagacggtaggagacgacgagacgaccgacggtcgtcttagtcgtgngaacgtagacggtacggttcgggaccctaacgttaaccgttcgttacgtcgtacggtcggtacggtcgggaccgggaacgttaaccgggtaacccg

SEQ ID NO: 380874 - DNA, 873 bp, Homo sapiens
  misc_feature: GZ8MTXP01AM0SV.13.76.G10.1.454.CMB.2.raw
  modified_base (289)..(289): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgcttattttaaaaggtgccagtgtgaggtgcagctgggtggagtcgtggagggaggcttgatccgagccgtgggggtccctgagactctcctgtgctacgcctcgtgggttcaccggtcagcacacctanatgagcgtcggtcccgccgacgggcctacccggaaggggaacgggggtcctagggggagtcggttaccgttcgttttactttttaagttttacgttaggttaggtttacgggttaacggttacaacgttacccgtacccggtaaccgtaacggtcccggttccgggtacggggtaaccgggggtccctaacgtttacccgaaacccgttactttacccgtaaccgaacgggtaacgaaaaccctaaacgtttaaccccgaaaaacgggtaacctaaccgggttacgttttaccgtttacccgttaaaataaaacgtttaccggaaaaccggtacgtccccggttaaagggaaaccggtaaccggacccgggttaaacgtacccggggtaaaccccggtacccggggtttaccggtttaagtttaaccgttacgggtaacgggtacggacggggtaagggttaaccgggttaccgggggtaccccgggttaaccccgttaaacgggtttaacccgtttaacccggtacggtaacggttaacgggtcggggttaacccggttccggggttaacccgggggaacccg

SEQ ID NO: 380875 - DNA, 702 bp, Homo sapiens
  misc_feature: GZ8MTXP01ASEX7.13.76.G10.1.454.CMB.2.raw
  modified_base (246)..(246): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacacgggtcctgggcccagtctgtactgacgcacgcccgcctcagtcgtcgtcggggccccaggggcaggacggtccaccgatcctctgctacgtgggancacgctaccaacgtagttcgggcactattatgtatgtacacgtcgtacagtcgtagttaccaggacgacgtacggtacccagtacctcctactactacaataaccgtaaacaactaacgccgacccgaaccgtacgggtccctacgtaccgtacttccgtgtccggtactacccgtacgtccgcggcctaccgttccgaccgtccccgttcccgttacggtacctacgtaccgtaccggttaccggcccgttccgggggaccggtcggtaacgggtaacgggtacgtacgggtaaaccggttcgtttacgtttaagttttaccgttaccgttacgtccccgttaaggttacccttaaggtacgaacgtaccggtacgttacgttccggttacgtaaggtcgttccgggttacgggtacggggttccgggggtaacccggggttaacgtaaccgggg

SEQ ID NO: 380876 - DNA, 733 bp, Homo sapiens
  misc_feature: GZ8MTXP01EHTOH.13.76.G10.1.454.CMB.2.raw
  modified_base (287)..(287): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgcttaattttaaaaggtgcccagtgtgaggtgcagcgtggtggagtcgtggaggaggcttgatccgaggccgtgggggtccctgagtctctcctgtgcagcctcgtcgggtcaccgtcacgtcacacctanagtgacgcgtcgggtcccgcgaggccgtaccggaaggggaggggtcgtggagtcgtcgttctttactttttaattagtagttaggtaggttacgtaacctacttacgtccgacgtacgtaacccgttccgggtgggacggggtccctacttaccaacctacgtcctaaccgagtaacgtaacctaacttaccgaaagaacccgtactcgttttactttaacctacgaaaatcggaaacctcggtaccgttaggaacgtacggtaccgaaagttccggaaacccgtcgggttaccgttagttaaacgttccgtggacggaacgggtaaagacgggtaacgggttcccgggggaaacccctaaaggttaaaccgtttcgaaccggtaacgtacgggtcgggtaaccggttcgggaaccgggggaacccgttaaaccggggtaaccccg

SEQ ID NO: 380877 - DNA, 616 bp, Homo sapiens
  misc_feature: GZ8MTXP01C3A9I.13.76.G10.1.454.CMB.2.raw
  modified_base (271)..(271): a, c, t, g, unknown or other
  modified_base (388)..(388): a, c, t, g, unknown or other
  modified_base (468)..(468): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctatttaaaggtgccagtgtgaggtgcagctggtggagtcgtggaggaggcttgatccgagccgtgggggtccctgagacctctcctgtgcacgcctcgtgggttcaccgtnagtcacacctacatgacgcgtggtcccgcaggcctccggagggggaacggggctgggagtgtcgtcttattttattagtagtagtggtagtacagtacctccgacacgcgttccggngggacggggcctattaccactactcctaccgaagacgacaacgttaccaaacgaactacgtacttcgtttctaactaaanacggtaaacacgtacctaggacgaacgcccgaagtacggaaccacgggtccgttagtaacttacgtcggtgacggagagacggtcgggggacccttacggttaactaaccgtacgtgtacgtagggaccgttcgggcggggaacccgg

SEQ ID NO: 380878 - DNA, 671 bp, Homo sapiens
  misc_feature: GZ8MTXP01CTXN6.13.76.G10.1.454.CMB.2.raw
  modified_base (298)..(298): a, c, t, g, unknown or other
  modified_base (459)..(459): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttattttaaaaggtgcccagtgtgaggtgcagctggtggagtctggaggaggcttgatccgaggccgtgggggtccctgacgactctcctgtgcagtcctcgtggttcaccgtcagtcacactacatgagctgggcccncgaggcctccgaggggaaggggctggagtgcgttctttcttttattagtagtaggttggtaacgtaccatacgtccgcacgtaaaccgttccggtgggacggggtaccctagttaccacctactcccgtacccaggaacgtaactaaacgtttccgaaaanaaccgaacggttcctttaggttttaaccctaacgaaaagttcggaaacctacggtcccgttagggaacgtcgaccgtacgtacgacccgtaacggtcccgttagttattaccgtgtcgaacggagaggtacggttccggggacccctaaggttaccgttacgttacgtctagtcgggacgttacggcggggtaaccgaacggggtaaccccg

SEQ ID NO: 380879 - DNA, 727 bp, Homo sapiens
  misc_feature: GZ8MTXP01BTU2R.13.76.G10.1.454.CMB.2.raw
  modified_base (170)..(170): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtcgtccgtcgtccccaggacagacagccagcatcactgctacgtaggaaataagttggacaagtaattaaattatacttcctaggtatcagacaagaagtcaacggccacgtcccctgtcgcgtggtcatctatacaagtactacgaccgaaggcccggtaccctacggaacggggtacctccccccgtaggacgtcgttaacttcccgtcgttacggccctacccgtaaacgttccgtaacgggtaacctcgaacgccctacgtctacgaccacgtaccgacggacccgggaccctaggtaccgtaggtaggacgtaggtacgggtacgttacgtaaccgtttaacgttaccgtacggtacggaacgggtcggtaacgggaccgtacggaccgtaacggcccgtaaccggtccggttaccccggtacttaacggttccggtttacccggttaaccggggttaaccggttaccgggggtaaacccgtaaccgggttaaccccgtaaaccccgggttaccgttaaacggtaaccccgaaccccggtaaacccccgg

SEQ ID NO: 380880 - DNA, 745 bp, Homo sapiens
  misc_feature: GZ8MTXP01CILMT.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtgggttccaccgtcagtcacacctacatggagcgtgggtcccgccgaggcctccggagggggaacggggctgggagtgtcgtctttcttttatttagtagttaggtcggtagtacatacctccgacagtcctccggtggacggggtcctagttccaccatcctaccgaagacgtaactaacttacccgaaaagaacctacgtcctttagtttacctaaacaaacgttcggaaacctacggtacccttagggaaacggtaccgacccgtaaagttcgggaaaccccgtacggggttaccccgtttagttaaaccgttttaaccgtcgggttagggaaccgggaaagggttaaacgggtaccgggtttccggggggaaaccccccgttaaaggggttaaaaccccggttttaaccgaaccggttaacgtttaacggggtacgggggttaaccccggttcggggttaacccgggggggtaaaacccccgg

SEQ ID NO: 380881 - DNA, 771 bp, Homo sapiens
  misc_feature: GZ8MTXP01DA1D5.13.76.G10.1.454.CMB.2.raw
  modified_base (553)..(553): a, c, t, g, unknown or other
  modified_base (641)..(641): a, c, t, g, unknown or other
  modified_base (653)..(653): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctattttaaaaggtgcccagtgtgaggtgcagcgtggtggagtcgtggaggaggcttgatccgaggccggtgggggtccctgacgacttctcctgtgcacgtcctcgtcggttccaccgtcacgtcaacacctacagtgacgtccgtcgggtcccgccgacggccgtaccggaggggaacggggctgggacgtcggtcgtttccttttacgtttttagttttaagttaggttaggttggtaacgtacctacttaccgtccgtacaacgtaacccgttccgggtgggacggggtacccgtaacgttcccgaaccctacttacccgacccgaaagtaacgtaaaccttaacttaacccgaaagtaaaccctacgttcgttttaacgttttcctaaanaaaaagttgaaaccgtacgtccggtaaggacggaaccgtcccgtaagtcccggaccgtaccgggtcgtttaagttactttaaccgggnggtacggaacgngggaaacggtaccggggttccgggtaaaccccgtaaacggttaaccgttacgttaccggttaagtacgggttaacgggcccgggtacggggaccgggaacccgggttaacgggtcccc

SEQ ID NO: 380882 - DNA, 714 bp, Homo sapiens
  misc_feature: GZ8MTXP01AO0YD.13.76.G10.1.454.CMB.2.raw
  modified_base (248)..(248): a, c, t, g, unknown or other
  modified_base (293)..(293): a, c, t, g, unknown or other
  modified_base (501)..(501): a, c, t, g, unknown or other
tcagtcacgtactacacgaccggtgctcgatttagtcactcatacagggggggagaggagcccagcactgggattccgaggtgtttccattcggtgatcagcactgaacacagaggactaaccatggagttttggctgagctgggttttccttgttgctattttaaaggtgcccagtgtgaggtgcagctggtggagtcgtggaggaggcttgactccagccgtgggggtccctgagactctcctgtncagcctctggtcaccgtcagtcacacctacatgagctgggtcccnccgaggcctaccggagggggaacgggcgtgggagtgtcgttctttacttttaagtttataggtacgtggtaagtacactaccgtccgacgacgaccgtaccggttggaacgggggcccgtaattccaccacttccaccaaagacgaacctaaagttcccaaaggtaaccacggtcctttgttttaccttacgaaaacttcgaaaaccncgtccgaggggacgaacggtaccgaacggtacggaacccggtaccgggtaccgtttagttaaaccgttcggtacggtacggacggtaaggtaacggttaccggggtacccgggaaaccccgtaaacgggttaaaccgttaccgttaccgttacgtaaggtcgggtaacccggtcgggaaccgggggacccgtaacggggttaaccccgtccgg

SEQ ID NO: 380883 - DNA, 685 bp, Homo sapiens
  misc_feature: GZ8MTXP01COT6F.13.76.G10.1.454.CMB.2.raw
  modified_base (251)..(251): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtcgtggaggaggcttgatccagccgtgggggtccctgagactctcctgtgcngcctcgtgggtcaccgtcagtcacacctacatgacgcgtcgggtcccgcgaggcctccggaggggaggggcgtggagtgtcgttcgtttacttttagtttagtagttaggtggtataccactactcgcacgaacgtccgtggacggggtcctacgttccacctactcctaccgaagaacaacgtaacttacccaaagaaccctacggtcctttagtttaccttaacgaaacgttacgaaacgtacggccgttaggaacgacggaccccgtagtaccgaaccggtaccggtaccgttagttacttacggtggtcggaacggaagggacggtacggccgggggtaacccctaacgggttaaacccgttacgccggtaacgtaacggttcgggaccgggttcgggacccggggtaacccgaacgggggtaacccccg

SEQ ID NO: 380884 - DNA, 719 bp, Homo sapiens
  misc_feature: GZ8MTXP01EZKYE.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtcgggtcccgccgacggctaccgaggggaagggggcgtggagtgtcgttctttctttttatttagttagtagtggttagtaccatactccgcacgtaacctccggtggacggggtcccgattccaacctactcctacccgaaggaacgtaacaaacttacccaaagaaacctaccggtcttttacgttttaccttaaccaaaagttcgaaacctacggaccccgttaggaacggacgtaccccgtaagtacggaaacccgaccggggttacccgttagttaaacgtttaccgtgggtggtaaccgggaaaggttacgggtacgggttcccgggggaacccctaaacgggttaaaccgtttacgttaccggtcgttaaaggtcggggtacccggttcgggacgggggaacccgttaaacgggggtaacccccg

SEQ ID NO: 380885 - DNA, 677 bp, Homo sapiens
  misc_feature: GZ8MTXP01DP04T.13.76.G10.1.454.CMB.2.raw
  modified_base (383)..(383): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccgagccgtgggggtccctgagactctcctgtgcagcctcgtgggttcaccgtcagtcacacctacatgagcgtcgggtcccgcgacggccgtccggaaggggaacgggggcgtagggagtggtcgtttcttttacttttatttagttagtagtgtagtaccattacnccgcacgtaaccgtccggtgggacggggtcctattaccaccactcctaccgaagaacgaacctaaacttaccgaaagtaactaccgttctttagtttacctaacaaaatcgaaactacgccgtagacgacgaccgatacggaccacgggtccgttagttaacttacgtggttgaacggaaggaggtacggttccgggggaaccccttaacggttaaaccgtttacaacccggtgtaacggttaacggggtaccgtacggggttaccgggaacccggttaaacggggtaaccccg

SEQ ID NO: 380886 - DNA, 675 bp, Homo sapiens
  misc_feature: GZ8MTXP01BK4Y4.13.76.G10.1.454.CMB.2.raw
  modified_base (493)..(493): a, c, t, g, unknown or other
tcagtcacgtactacacgaccggtgctcgatttagtcactcatacagggggggagaggagcccaacactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatccagccgtgggggtccctgagactctcctgtgcagcctcgtcgggttcaccgtcagtcacaccacatgagcgtcgggtccgccgaggcctccgagggggaacggggtcgtgggtagtggcgtttctttacgttttttatttagtagttaggtggtagtacactacctcgctacgcctccggtggcggggcctacgttacacccattcctaccaagacgaactaaacttaccgaaacgacctacggtctttagttttacctaacaaagttgaaacgngtacccgtaggggaacgtaggacccgtagtacgaccgaaccgggtccttaatcgttaacgtgtacggacgaaggaacggttggtaccgggggttaccccaaacggtaaccgttaccgttacggaccttaagtcgggtaaccgttcggggacggggacccgaacggggaacccgtaacccggg

SEQ ID NO: 380887 - DNA, 534 bp, Homo sapiens
  misc_feature: GZ8MTXP01B6GLU.13.76.G10.1.454.CMB.2.raw
  modified_base (274)..(274): a, c, t, g, unknown or other
  modified_base (387)..(387): a, c, t, g, unknown or other
  modified_base (397)..(397): a, c, t, g, unknown or other
  modified_base (401)..(401): a, c, t, g, unknown or other
  modified_base (408)..(408): a, c, t, g, unknown or other
  modified_base (413)..(413): a, c, t, g, unknown or other
  modified_base (416)..(416): a, c, t, g, unknown or other
  modified_base (419)..(419): a, c, t, g, unknown or other
  modified_base (430)..(430): a, c, t, g, unknown or other
  modified_base (434)..(434): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggggaggcttggtacagcctggcaggtccctgagactctcctgtgcagcctctggattcactttgatgattangcatgcactgggtccgcaagctccagggaaggctggatgggtctcaggtattagatggaatagtgtagcataaggctaatgcggactctgtgaaagggccgattcaccatccncagagacacncaanactcctntatcnganaanagaacacgcgngagngtgagacggacgaacgtcgttgttattagttagtagaacgaaacgaactaaccctaacccctaaccgttacgtttaggttaggttaaggttaacgtaacg

SEQ ID NO: 380888 - DNA, 581 bp, Homo sapiens
  misc_feature: GZ8MTXP01CAXRG.13.76.G10.1.454.CMB.2.raw
  modified_base (396)..(396): a, c, t, g, unknown or other
  modified_base (401)..(401): a, c, t, g, unknown or other
  modified_base (419)..(419): a, c, t, g, unknown or other
  modified_base (491)..(491): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtggtcaccgtcagtcacacctacatgagcgtcgggtccgccaggctccgagggaggggctggagtgcgtctttcttttatttatagttagtggtacgtaccatactccgcacgaactccgtggacggggcctatcacatcncaganaacataccaagacacgtnttcgtttactacaaatcgaactcggacctggacgaacgcccgaagtcgacgaccggtccgttgtaaagttcnggtgcgaggacgacggttcggggacccaacgttaaccggtttcaaccgtctaagtcggacgtcggcggggtaacccgaagggaaccccgg

SEQ ID NO: 380889 - DNA, 744 bp, Homo sapiens
  misc_feature: GZ8MTXP01CJNEI.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggtagttttggctgagctgggttttccttgttgctattttaaaggtgcccagtgtgaggtgcagcgtgggtggagtcgtggaggaggtcttgatccgaggccggtcggggggttccctggacgtacctctcctggtgccgacgtccttcgttcgggttccacccggtcacgtcaccacctacagtggacgcgtcgggtcccgcgacggccgtccgggaagggggaacgggggtcgtagggacgttcggtaccggtttcttttacgtttttaatttagttaggttaacggttagggttaactaccgtactaccgtccgtacgacggtaacccgttccgggtcggaccggggggtccctactttaccaacccgtacttccacccgaaagaacgtaacctaaactacccgaaaagaaccgtacgtactttagtttaccttaacgaaactagaaccacggccgtagagtacgaccgatcgacgacggtccgtattactcgtggtcgaacggagttagggtaacgttccgggggaacccctaacggttaacccgttacgttaccgtaaccgtgtaacggggtacccgtacggggttccggggtaacccgaaacggggtcccccg

SEQ ID NO: 380890 - DNA, 662 bp, Homo sapiens
  misc_feature: GZ8MTXP01CWT1K.13.76.G10.1.454.CMB.2.raw
  modified_base (242)..(242): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcatcactctcctcgctcactgcacagggtcctgggcccagtctgtactgacgcacgccgccctcgagtcgtcgtcggggccccagggcagacggtcacctatctcctgcacgtgggancagcctacgaactagtcgggcactattatgtatacgtacacgtacggtaccagtctacgtttccgaggacgacgacgtcccagtcctcctacactactaaacgtacgtaaacaacgaacgtcccggaaccccggacggtaaccggggtccctacggacctacttccgtcgtcggtccctacgtcgtccgtcggcctacccgtacgaccgtccctaccgtcggctacgtccgtacgtccgggtccgtcggaacggtccgtagggacggtcgtacggacgttacgttacgtttaacgtttccgtttccgtaccgggtaacccttaaacgttccgttaaacggttcgaaaccgttacgcgttacgttcgtaaggtacgtcgttacgggttcggttaccgggttccggggaaccgggtaacccg

SEQ ID NO: 380891 - DNA, 509 bp, Homo sapiens
  misc_feature: GZ8MTXP01E4DP9.13.76.G10.1.454.CMB.2.raw
  modified_base (235)..(235): a, c, t, g, unknown or other
  modified_base (320)..(320): a, c, t, g, unknown or other
  modified_base (353)..(353): a, c, t, g, unknown or other
  modified_base (366)..(366): a, c, t, g, unknown or other
  modified_base (405)..(405): a, c, t, g, unknown or other
  modified_base (418)..(418): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggancagctcaacattggggcacatatgatgtacactggtaccagcagtttccaggagcaggtcccagactctcatcaatagtaacaanaaatcggcccgcagggggtccctgaccgattcnctggctccagtcnggcactcagcctccctggtcatcactggcgtccgagcgngaggagtgagggngtagtattattctcgcgtaacgtcttatacgacgagcacgcgttcgtgtgtcgttcggttacggttccggggtccgggggaaccggtaacg

SEQ ID NO: 380892 - DNA, 580 bp, Homo sapiens
  misc_feature: GZ8MTXP01BR2D7.13.76.G10.1.454.CMB.2.raw
  modified_base (306)..(306): a, c, t, g, unknown or other
  modified_base (468)..(468): a, c, t, g, unknown or other
  modified_base (492)..(492): a, c, t, g, unknown or other
  modified_base (520)..(520): a, c, t, g, unknown or other
  modified_base (529)..(529): a, c, t, g, unknown or other
  modified_base (555)..(555): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccgagccgtgggggtccctgagactctcctgtgcacgcctcgtgggttccaccgtcagcacacctacatgagcgtcgggtccgccgnggcctcggagggggaagggcgtgggagtcgtcgttcttcttttattatagtagtaggtagtacactacgtccgaacacgcgtcgtagggacgggtccgattccgactactccgtaccaaggacaactaacttaccgaaagaactctcgttcgtttacttaanaaactggaacacggtctagacganccgatcgaacgccgggtctagttatcgngtcgagagngtacggcggacccgacgacgttaacngcgtagcggacgtcgcggggaaccg

SEQ ID NO: 380893 - DNA, 729 bp, Homo sapiens
  misc_feature: GZ8MTXP01C9QZG.13.76.G10.1.454.CMB.2.raw
  modified_base (248)..(248): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacgagggtcctgggcccagtctgtactgacgcacgcccgccctcagtcgtcgtcggggccccaggggcaggacgggtcaccatcctcctgcacgtggggacncacgcctaccaaagtgttcggggacaactattatgatacgtacacgtacgtaccagtcctaaggtttcccgaaggtacgcgaacggttacccaacggtacctaccttacaactaactaaacgttaaaccgtaaaaccaaacgtaaacgtcccggggaccccgtaacgggtaaccgggggttcccctacgggtaacccgttactttcccgtaccgtacggggtcccttacccggtacggttaccgttcgggacccctaaccgttccgacccggtcccctttcccggtacggttacccaaacgttcccgaaccggttcgggtacccctaccggggtaacggggtccgttaacgggacggtaagtcggtaacggtcgtttacgtaattttacgtcgtaccgtcctaagttcccaggtcacgacgtcacgttccgttagtcgtggtccgtttcgggtcgggttaccggggtccgggcgtaaccgg

SEQ ID NO: 380894 - DNA, 573 bp, Homo sapiens
  misc_feature: GZ8MTXP01A6J86.13.76.G10.1.454.CMB.2.raw
  modified_base (275)..(275): a, c, t, g, unknown or other
  modified_base (304)..(304): a, c, t, g, unknown or other
  modified_base (372)..(372): a, c, t, g, unknown or other
  modified_base (389)..(389): a, c, t, g, unknown or other
  modified_base (403)..(403): a, c, t, g, unknown or other
  modified_base (422)..(422): a, c, t, g, unknown or other
  modified_base (440)..(440): a, c, t, g, unknown or other
  modified_base (451)..(451): a, c, t, g, unknown or other
  modified_base (494)..(494): a, c, t, g, unknown or other
  modified_base (496)..(496): a, c, t, g, unknown or other
  modified_base (537)..(537): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtcgtggagggaggcttgatccgaggccggttggggggtccctgacgtacctctcctgtgcagcctcgtggtcaccgtnagtcacacctacatgagcgtcgggtcccncaggcctaccggaggggaaggggctggagtgcgttcttcttttattagtagtagtggtataccatacncgcagacctccggtggngggcctattccacntctcagagacactacgaanacacgtctttgttctaanaaactgaaacncggcctaggagacgacgatcgaacgccggtctgtacttacggngngaacgagacgacggccggacctaacgttacgttccgacgtntaggtcggacgtcgggacgggaaccgaacgggtccg

SEQ ID NO: 380895 - DNA, 704 bp, Homo sapiens
  misc_feature: GZ8MTXP01ASU3U.13.76.G10.1.454.CMB.2.raw
  modified_base (423)..(423): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgccaggctccgagggaaggggctggagtgcgtcttcttttattatagtagtggtagtaccatactccgcagaactccgtggaggggcccagttccaccgtatctacccagacgactaaacgttccgaaanaaaccacggtcttacggtttaccttaccgaaaattcgaaaactacggcccgtaggaacggacgcccgaaattcggaaccgaaccgggggtcccgttagggttaactttaaccgtggttacggaaccggaaagggttaggtaaaccggggtttcggggggaaacccccctaaccgggttaaaaccggtttaccgttaaccgggtccgttaaacgttcgggggaaacccggtttccgggttaccggggggggtaacccttaaaaccggggggggtaacccccg

SEQ ID NO: 380896 - DNA, 694 bp, Homo sapiens
  misc_feature: GZ8MTXP01AXSOF.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccggtcagtcacacctacatgagcgtgggtcccgccgaggctaccgaggggaaggggcgtggagtgcgtcttcttttattatagtagtggtagtacatactccgcacgaactccgtggacggggtccagttccacctatcctccagaacgtaactaacgttaccaaacgaactaccgtcgtttacgttttaccttaacaaaacttcggaaacctacggtacccgttagggaacggtaaccgaccccggtaaagtaccggaaccggtacccggggtacccggtttagtttaaactttaccggttgggttacggaaccgggtaaggacgggtaacggttccgggggaacccctaacgggttaaacccgtttcgttaccggtaaccgtaggtccgggacggttccggacgggggtcccgaaacgggggtaaccccg

SEQ ID NO: 380897 - DNA, 818 bp, Homo sapiens
  misc_feature: GZ8MTXP01C3W70.13.76.G10.1.454.CMB.2.raw
  modified_base (255)..(255): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctggttttccttgttgctattttaaaaggtgccagtgtgaggtgcagcgtggtggagtcgtgggaggaggtcttgatccgagccgtgggggtccctgacgctctcctgtgcncgcctcgtcggttccaccgtcacgtcaactacctacagtgacgtccggtcgggtccccgaccgacgggtccgtaccgggaacggggggtaaacggggggccgtagggggtacggttcgggttaccgtttccgtttttacgttttttaaagttttaagttaacggtttaggtttaaggttaacgttaacgtacttaacccgtacccgtaacgtaacggtaacccgttccgggtacggggtaaccgggggtacctacttcccaaaccgtacttacctacccgaaagtaacgaactaaacttaacccgaaagtaaccgtacgttccgtttacgttttaacccttaagtaaaacgtcggaaacgtaacggacccgttaaggaacggacgacccgagttaccggaaccgtaaccggtccgttagttaacgtttccgtaaggtcgggacggtaaaggacggttaacgggccggggttaaccccgttaaacggttaaacccgtttaaccggtaaccgtcgttaaacgggtcgggttaccgggttccgggttaaccgggggaaaccccggg

SEQ ID NO: 380898 - DNA, 687 bp, Homo sapiens
  misc_feature: GZ8MTXP01D3ED1.13.76.G10.1.454.CMB.2.raw
  modified_base (403)..(403): a, c, t, g, unknown or other
  modified_base (439)..(439): a, c, t, g, unknown or other
  modified_base (465)..(465): a, c, t, g, unknown or other
  modified_base (566)..(566): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagcgtggtggagtcgtgggaggaggcttgatccgagccgtgggggtccctgacgtactctcctgtcgcagcctcgtcgggtcaccgtcacgtcacacctacagtgacgtcgtcgggtcccgcgacggccgtcggaaggggaaggggcgtgggtagtgtcgttctttatttatttagtaggttagtgtacgtaccatacgtcgacacgaccgtcgnggacgggtccgtacttcacctactcgtaccaagganaactaacttaccaaagacctacgttnttcgtttacctaacaaagtacgaactacggtccgtaagggacgaacggtaccccagtacccgtacggaacccgggttccgtttaagttaacttttaccggnggtacgggaacggtaaggaacgggtaccggttacccgggaaaccctaaacgggttaaccgttcggacgtcttacgggtcgggtaccggtcggggttaccggggaacgttaaccgggtcccg

SEQ ID NO: 380899 - DNA, 693 bp, Homo sapiens
  misc_feature: GZ8MTXP01DWBMW.13.76.G10.1.454.CMB.2.raw
  modified_base (282)..(282): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagcgtggtggagtctggaggaggcttgatccgagccgtgggggtccctgacgactctcctgtgcagcctcgtgggtcaccgtcagtcacacctacngtgagcgtcggtcccgcgaggcctaccggaggggaggggcgtggagtcgtcgtttctttactttttaagtttagttaggtagttggtaacgtaaccctacttaacgtcccgacaacggtaacccgttccgggtggggacggggacccgtaacgttccaacccgtactcctacccgagaaacgaactaaaccttaccaaaagaacctaccggttctttgtttaaccctaaagaaacgtcgaaactcgacggtaggacgtaccgaccgagtccggaccgtacggttccgttaagttacgttacgtggcggaacgtaacggacgggtaccggttacccgggaaaccctaacggttaacgttccgacgtaacgtaggtaaccggacggtcgggacgggaacccgaacgggtcccg

SEQ ID NO: 380900 - DNA, 675 bp, Homo sapiens
  misc_feature: GZ8MTXP01DNKCR.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtctggaggaggcttgatccgagccgtgggggtccctgagactctcctgtgcacgcctcgtgggtcaccgtcagtcacacctacatgagcgtcgggtcccgcgaggcctaccggaggggaacggggcgtgggagtcgtcgtttctttacttttaatttagtagtaggtgtagtacctatactcgcacgtaacctcggtggacgggccgtattccacctactcctaccgaagacgaactaacttaccgaaagaacctacgttctttagtttaccttaacaaaacgtcgaaacgacgtccgtaggaacggtacgcccgtaagtacggaccgtaccgggtccgttagttaacttacgtcggtggaaccggtaaaggacgggtaccggttaccgggggaacccctaacgggttaaaccgttaccgttacgtcgttagtcgggaccgtcgggttacgggggaaccgttaacgggggaaccccg

SEQ ID NO: 380901 - DNA, 679 bp, Homo sapiens
  misc_feature: GZ8MTXP01AUFIX.13.76.G10.1.454.CMB.2.raw
  modified_base (371)..(371): a, c, t, g, unknown or other
  modified_base (457)..(457): a, c, t, g, unknown or other
  modified_base (544)..(544): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctatttaaagtgccagtgtgaggtgcagctggtggagtctggaggaggcttgactccgaggccgtggggggtccctgagactctcctgtgcagcctcgtcgggtcaccgtcagtcacacctacatgagcgtgggtcccgcgaggcctacggaggggaacggggcgtgggagtcggtcgttctttacttttattagtagtagtggtagtacatcncgcacgaactcgtggacgggtaccgattcaccgactctacccaggacactaacttaccgaagaactacggtcttacgtttcctaanaaacgttcaaacgtaccgaccggttggaacgaccggacccgtaagtccggaacgaccggggttccgtttaggttaaccttttacggngggttaacgggtaaccggaacgggaggtacgggttcgggggaaccccgtaaccgggttaacgtttaccgttaccggtcgtttacgccggggtacgttacgggggttaccggtaaccgggaacggggtaaccccgg

SEQ ID NO: 380902 - DNA, 640 bp, Homo sapiens
  misc_feature: GZ8MTXP01CLB1H.13.76.G10.1.454.CMB.2.raw
  modified_base (468)..(468): a, c, t, g, unknown or other
  modified_base (478)..(478): a, c, t, g, unknown or other
  modified_base (493)..(493): a, c, t, g, unknown or other
  modified_base (530)..(530): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtcgtggaggaggcttgatccagccgtgggggtccctgagactctcctgtgcagcctcgtgggttcaccgtcacgtcacacctacatgagcgtcgggtccgccgaggctccggaggggacgggggctgggagtcgtcgttctttactttatttatagtagtggtagtaccatactccgcacgaccgttccggtggacggggaccgtattaccacctatcctaccaagtacgaactaacttaccaaaggaaccacgtctttgtttacctanaaatgtaacncgtccgtggaaacgngcccggatccgacgtaccgggtccttagtactttacngggtcgcggtaaggcggtacggttccgggggaacccctacggttaacccgtttcgacgtcttacggtcgggacccgttcggacgggggtaacccgaacggggtaaccccg

SEQ ID NO: 380903 - DNA, 606 bp, Homo sapiens
  misc_feature: GZ8MTXP01E49FB.13.76.G10.1.454.CMB.2.raw
  modified_base (278)..(278): a, c, t, g, unknown or other
  modified_base (280)..(280): a, c, t, g, unknown or other
  modified_base (294)..(294): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtcgtggaggaggcttgatccagccgtgggggtcctgagactctctgtgcagcctcgtggtcaccgtcagcacacctanangagcgtgggtcccncgacggcctaccggaggggaagggggctagggacgtcgcgttctttcttttaatttagtagtagtgggtatacatacctcgacacgcgtcgtaggacggggcctagtacaccatctaccagaacgactaaacgtccaaagaccacgtcttcgttactaacaatcgaacagccgtagaacgacgccgagtacgaacgtaccgtccgttagtacttacgtggcgcggaagagtacggtcgggggaccccttaacggttaaccgtttaacgaccgtaacgtagggcggttaccggttcgaacgggggaaccccgg

SEQ ID NO: 380904 - DNA, 694 bp, Homo sapiens
  misc_feature: GZ8MTXP01CE25Y.13.76.G10.1.454.CMB.2.raw
  modified_base (610)..(610): a, c, t, g, unknown or other
  modified_base (620)..(620): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagcttgggttttccttgttgcttattttaaaaggtgcccagtgtgaggtgcagctggtggagtcgtggaggaggcttgatccgagccggtcgggggtcctgacgactctctgtgcacgtcctcgtcggtcaccgtcacgacacacctacatagacgtccggtcgggtcccgcccgacggtccgtacggagggggaacggggtcgtagggtaggtcggtcgttactttacgttttaagtttaagttaggtaggttacggttagtactactaccgtaccgacgaacggtcccgtaccgggtagggtacgggggtacctacgttaccacgtactccctacgaggaacgtaactaacttaccgaaacgaacgtacgtctttacgttacctaaataacgtacgaacgcgtacccgtagaacgacgaccgttacacgggtacctaccgggtacttacggtacttcgtggtacggnggtaaacggnggtacggccgggaaccgttaacggttacgtaaccgacgtcgtaggtcggttacgtcggggaacggaacccgggg

SEQ ID NO: 380905 - DNA, 700 bp, Homo sapiens
  misc_feature: GZ8MTXP01EL0JE.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtcgggtccgccgaggctccgaggggaggggctggagtgtcgttctttcttttattagtagttagtggtagtaccatacgtccgcacgaacctccggtggacggggccctagttcactactcctcagacgaactaacttccaaaggaacctacggtctttgttttacctaacaaagtcgtaaaaccgcgtacggtaaggaacggtaccggtaccggtaagtccggaaccgtaccgggttaccgtttagttaacgttacgtcgggtacgggaacggtaaacgggacgggtaccgggttacccggggtaaccctaaaccgggttaacccggtttaccgttaccggtcgttaacgggtaaccggggtaacccgggtccgggttaccgggggtaaccccggttaaaccgggggtccccg

SEQ ID NO: 380906 - DNA, 697 bp, Homo sapiens
  misc_feature: GZ8MTXP01ANKBC.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagtcttgggttttccttgttgcttaattttaaaaggtgcccagtgtgaggtgcagctggtggagtcgtggaggaggcttgatccgaggccgtgggggtcctgagactctctgtgcagcctcgtggtcacgtcagcacactacatgacgcgtggtcccgccgaggcctccggaggggacgggcgtggagtgtcgttcttcttttaagttatagtagtacggttagtacacgtactaccgcgtaacggtcgtccgggtagggacggggtcctacgttccaaccgtactacctaccgaagaacgtaactaaactaccgaaacgaccgacgtcttacgttactaaacgaaatcggaaacctcgtaccgtaagaacggcgtacccgagttacggaccgtacggggtcctttacggtaacttaccgggttgacggttacgggaaagttacgggtaaccgggtacggggttaaccccgaaacgggttaaacgttaaccgtaacggttaaccgtaacggggtccggggttaaccggtcgggggttaaccgggggaaaccccggg

SEQ ID NO: 380907 - DNA, 717 bp, Homo sapiens
  misc_feature: GZ8MTXP01AVDLH.13.76.G10.1.454.CMB.2.raw
  modified_base (665)..(665): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtcgtggaggaggcttgatccaggccgtgggggtccctgagactctctgtgcacgtcctcgtcggtcaccgtcacgtcacactacagtgacgcgtcggtcccgcgacggcgtaccggaggggacggggcgtggagtcgtcgttctttcttttatttagtagttagtggtacgtacctactacgtccgacgacgtaaccgttccggtgggacggggtcccgtacgttcccaaccgtacgtaccctaccgaaggtaacgtaaacctaaacgttacccgaaaacggaaccttaccgtcttttacgtttacctaacgtaaaactacggaaccgaccggaccccgggaaggtacccggacccgagttaccgaaccccgtacgggtccctttaggtaccttacggtggtacggacggaacgtaaacgggcggttaccggggacccctaaacgggtaccgttacgcggttaccggtnttacggcgggtaccgggttcggaccgggggaacccttaacggggtaaccccg

SEQ ID NO: 380908 - DNA, 793 bp, Homo sapiens
  misc_feature: GZ8MTXP01D728W.13.76.G10.1.454.CMB.2.raw
  modified_base (284)..(284): a, c, t, g, unknown or other
tcagtcacgtactacacgaccggtgctcgatttagtcactcatacagggggggagaggagcccagcactgggattccgaggtgtttccattcggtgatcagcactgaacacagaggactaaccatggagttttggctgagtctgggttttccttgttgcttaattttaaaggtgcccagtgtgaggtgcagcgtgggtggagtcgtgggaggaggtcttgactccgaggtccggtcggggggtccctgacgtactctccgtgtgcacgtcctcgtcgggttccnccgtcacgtcacaccacagtgagtcgtacgggtcccgccgacggcctaccgggagggggaacgggtgtcgggagttcgtcgtttctttactttttaagttagtaggttagttaggtacgtactacctaccgtcgacgtacgtacccgtaccgggtagggccggggtactacgttccacctactaccgtaccgaagtaacgaacctaaacttaacccgaaacgtaaacctacggtttactttacgttttactaaactaaacgttacgaactaacgtcccgtaaggggaacgaccggtaccgtaacgacggtaaccccgcgggttccgtttaaggttacttaccgggttggtacgggaccgggaaggtacgggttacgggtaccccgggggaaacccttaaaccgggttaaccggtttaaccgttacggttaccgtttaagggccgggttaaacgggtccgggggtaccggggaaccgggtaaacccggggttaacccgttaacccccggg

SEQ ID NO: 380909 - DNA, 636 bp, Homo sapiens
  misc_feature: GZ8MTXP01B31ZT.13.76.G10.1.454.CMB.2.raw
  modified_base (265)..(265): a, c, t, g, unknown or other
  modified_base (287)..(287): a, c, t, g, unknown or other
  modified_base (519)..(519): a, c, t, g, unknown or other
  modified_base (585)..(585): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtgagtcgtggaggaggcttgatccagccgtgggggtccctgagactctcctgtgcagcctctgggtcaccgtnagtcacacacatgagctggccncagctcgagggaggctggagtgcgtctttcttttattagtagtagtggtacgtaccagtactcgcagaacgtcccggtggacggggtcacttccgacctactctacccgaaggacaactaacttaccgaaagaacctacgtccttaggtttactacaaaactcgaaacgtagaccggttagacgacgacccgagtaccggaaccgtacgggtaccgttgtaacctttaccgnggtcggcgaaagggttacgacggttcccgggggaaaccccctaaggttaaaccggtttcaccggtnttaacggcggtacggtcggttacgggggaacccgttaacggggtaaccccg

SEQ ID NO: 380910 - DNA, 713 bp, Homo sapiens
  misc_feature: GZ8MTXP01ATMDG.13.76.G10.1.454.CMB.2.raw
  modified_base (403)..(403): a, c, t, g, unknown or other
  modified_base (421)..(421): a, c, t, g, unknown or other
  modified_base (515)..(515): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgactccgaggtcccggtcgggggggtccctgacgtacctccttccgtgtgcacgtcctcgttcgggtcacccggtcacgtccacaccctacagtgacgtcgtcggtccgccgaggccgtaccggagggggacggggctggagtgtccgttctttacttttagttagtagttagtggtactaccactacnccgtacagaacttccggnggacgggccgtactccacctatcgtaccagacgtaacaacgttaccaaacggtaactcgttctttacgtttacctaaacgtaaatcggaaaccncgtaccggtaaggaacggaccgaccgtaagccggaccggtaccggttaccgttagtaaccgttcgtgggtcgaacggtaaggacggtccgggttacccgggtaacccctaaacggttaaaccgttccgacggtaacgttacggtaaccggggtacgggtaccggggaaccggggaacccggttaacggggtaaccccg

SEQ ID NO: 380911 - DNA, 710 bp, Homo sapiens
  misc_feature: GZ8MTXP01EJCOO.13.76.G10.1.454.CMB.2.raw
  modified_base (263)..(263): a, c, t, g, unknown or other
  modified_base (265)..(265): a, c, t, g, unknown or other
  modified_base (293)..(293): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagtcttgggtttttcctttgttgtcttaattttaaaaggtgcccagtgtgaggtgcagctggtggagtcgtgggaggaggcttgactccgacgccggtgggggtccctgacgactctctgtncncgcctcgtggtcacgtcagcacacctanatgagcgtcggtccgccgacggcctaccggaaggggacgggtcgtggtagtcggtcgtttcgtttactttttaagtttaagttagttaggttacggttaagtactactacctccgaacctaacggtccgttccgggtacgggaccggggtccgtacttaccacctacttccctaaccgaagaaaccgtaaccttaaaccgttaacccgaaaacgaaaccgttccgttccttttaagttaccctttaaagaaaacttcgaaaacggtcgtccgtagaacgacgtacccgtagtccgaaccgtaccggtcttagtttactaccggtgtcgacggagacggtacgggtacccgggacccttaaggttaacccgtttgacgtcgttacggcgggttactccgggttaacgggggaacccgg

SEQ ID NO: 380912 - DNA, 671 bp, Homo sapiens
  misc_feature: GZ8MTXP01BV70O.13.76.G10.1.454.CMB.2.raw
  modified_base (496)..(496): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctattttaaaaggtgcccagtgtgaggtgcagctggtggagtcgtggaggaggcttgatccaggccgtgggggtccctgagactctcctgtgcagcctcgtgggtcaccgtcacgtcacacctacatgagcgtcgggtcccgccgaggcctccggagggggagggggtctagggagtgtcgttctttactttttagttagtagttacggtggtagtaccacgtactcgcacgtaccgtccggtgggacggggtccgtacttccgaacctacgtacctaccgaaagtacgtaacctaaagttaccccgaaaggaaccctacggtctttagtttaccaanaaacgtgaaactcggcgtaaggagaaccgtccgaaattcggaccgtaccggtccttgtaacttccgtaggtcgaacggttaggacggcggttccggggaacccctagggttaaaccttccgacgcgttaacgtcggggaccgttcgggacgggtaacccgaacggggttaacccc

SEQ ID NO: 380913 - DNA, 721 bp, Homo sapiens
  misc_feature: GZ8MTXP01CX93D.13.76.G10.1.454.CMB.2.raw
  modified_base (329)..(329): a, c, t, g, unknown or other
  modified_base (496)..(496): a, c, t, g, unknown or other
  modified_base (593)..(593): a, c, t, g, unknown or other
tcagtcacgtactacacgaccggtgctcgatttagtcactcatacagggggggagaggagcccagcactgggattccgaggtgtttccattcggtgatcagcactgaacacagaggactaaccatggagttttggctgagcttgggttttccttgttgcttaattttaaaaggtgcccagtgtgaggtgcagcgtggtggagtcgtgggaggaggtcttgactccgaggtccggtcggggggtccctggacgtacctcctccgtgtcgcacgtcctcgtcgggttacaccggtcacgtcaacctacctacatgacgtcgtcgggtcccnccgagccgtaccggagggggaagggccgtaggagtcgtcggttctttactttttattagtagttaggtagtatacactaccgtcgctacgccgtaccggtgggcggggtacctacttaccgacctactccgtaccaggactaacaacttaccgaaagtacctacgtnttttcgttactaacaaatacgaacgacgtccgtagggaacgtaacggacctaaggtacgaacccgtccggggtctttaagttacgtttaacccgggnggtacggaacggtaaaggtacggttaccggggtaccccgggaaaccgttaaacggttaaccgttacgcgttacgtaacgggtacggtaaccggtcggggaccgggaaccgtaacccgggttcccgtcg

SEQ ID NO: 380914 - DNA, 711 bp, Homo sapiens
  misc_feature: GZ8MTXP01BVDO8.13.76.G10.1.454.CMB.2.raw
  modified_base (308)..(308): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagcttgggttttccttgttgctattttaaaaggtgcccagtgtgaggtgcagcgtggtggagtcgtggaggaggcttgatccagccgtgggggtcctgagactctcctgtgcacgtcctcgtcgggttcaccgtcagtccactacctacatgagtcgtcgggtcccnccgaggcctaccggagggggaacggggcgtgggagtcgccgttcctttatttttagttaagtaggttaggttagggttaactacaacgttaacccgtcccgaacaacggtccgttaccgggtacgggaacgggggtccctaactttccgaacctacttccgtaccaaggtaacactaaacttaccaaaaggacctaacgttccttagttaccttaacaaagttcggaaaccgcgtacgagacgtaccgacgtagtaccggacgtccggttacgttagtacgttggaacggtacggacgggtaagacgggtaccgggtacccgggaacccgttaacggttaaccggtttaacgacggtaacggttacgggtcgggttaccgggttccgggaaccgggggaaccg

SEQ ID NO: 380915 - DNA, 619 bp, Homo sapiens
  misc_feature: GZ8MTXP01AELIU.13.76.G10.1.454.CMB.2.raw
  modified_base (492)..(492): a, c, t, g, unknown or other
  modified_base (530)..(530): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggtcaccgtcagtcacacctacatgagcgtcgggtccgcgacggctaccgaggggaaggggctggagtgtcgtctttacttttattagttagtagtggtagtaccatactccgcagaacctccggtggacggggccctattcccgacatcctaccgaagacgaacaacttaccgaaagaaccacggtcttacgtttactacaaagtcgaacacgtccgtagacgtagacccgtancgaccgtacggccgtgttaactagtcgtggaacgtagnggacgttccgggggaccctaacggttaacgttccgttaacgcgttagtcgggacggtcggttacggggaaccgaacggggtaaccccgg

SEQ ID NO: 380916 - DNA, 651 bp, Homo sapiens
  misc_feature: GZ8MTXP01A6XK7.13.76.G10.1.454.CMB.2.raw
  modified_base (431)..(431): a, c, t, g, unknown or other
  modified_base (495)..(495): a, c, t, g, unknown or other
  modified_base (552)..(552): a, c, t, g, unknown or other
  modified_base (604)..(604): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtggttcaccgtcagtcacacctacatgagcgtcgggtccgccgaggctccggaggggaaggggctggagtgtcgttctttctttttattattagtagtggtacgtacctatactccgcacgtaaccgtccgggtggacggggtccgtacttccaccgtaatcctacccgaaggtanaaacctaaacgttcccaaaaggaacctaccggtctttacgttttacctaacaaaattcgaaacncggtccgtaggaacgaacgtccgaagtcgaccgtaccggtccggttattacttacgnggtcgaacgaggagcgggttacggggaccccaacggttaacgttcaaccgtntaacggtcggacccgtgggttaccggggaaccgttaacggggaaccc

SEQ ID NO: 380917 - DNA, 627 bp, Homo sapiens
  misc_feature: GZ8MTXP01ANK9W.13.76.G10.1.454.CMB.2.raw
  modified_base (369)..(369): a, c, t, g, unknown or other
  modified_base (395)..(395): a, c, t, g, unknown or other
  modified_base (405)..(405): a, c, t, g, unknown or other
  modified_base (419)..(419): a, c, t, g, unknown or other
  modified_base (425)..(425): a, c, t, g, unknown or other
  modified_base (443)..(443): a, c, t, g, unknown or other
  modified_base (564)..(564): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggtagttttggctgagctgggttttccttgttgctattttaaaagtgccagtgtgaggtgcagctggtggagtcgtggaggaggcttgatccagccgtgggggtcctgagactctcctgtgcagtctcgtggtcaccgtcagtcacacctacatgagcgtcggtccgccgaggctccggaggggaggggcgtggagtgtcgttctttcttttaattatagtagttagggtataccatactccgnagaactcggtggacgggcgtatcacnctctacaganaacacgttcaaagnacgttntctttacacgaatagacncgctgacgacgacggataggaaccgtccggtacgttagtaacgttacgtggagaaccgggtaagacgggcggttaccgggggaaaccccctaaggttaaaacccggtttcttacccggttntaacggttcgggggaacccgttcgggggacccggggtaaccggaaacgggggttaacccccgg

SEQ ID NO: 380918 - DNA, 659 bp, Homo sapiens
  misc_feature: GZ8MTXP01EXWR3.13.76.G10.1.454.CMB.2.raw
  modified_base (342)..(342): a, c, t, g, unknown or other
  modified_base (428)..(428): a, c, t, g, unknown or other
  modified_base (463)..(463): a, c, t, g, unknown or other
  modified_base (476)..(476): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggaggaggcttgatccaggccgtggggggtccctgagactctcctgtgcagcctcgtggtcaccgtcagtcacacctacatgagcgtcgggtcccgccaggccgtccggaggggaacgggggctgggagtgcgtctttnttttattatagtagtggtagtaccatacgtccgcacgtaaccgtcggtgggacggggcccgtattaccacctatcctaccaggaanactaaattcccaaagacacgtctttgtttactaanaaagtcgaaaccncgcggtagaacggacgacgagtccgacgtaccggtacgttagttacgtacgtgggtggaacggaggttacgggaccgggttccggggaaaccccgtaaacggttaaaccgttacgttaccgtaacgttaggtccgggtacggtaccggggttaccgggggtaacccgaaaccggggtaacccg

SEQ ID NO: 380919 - DNA, 707 bp, Homo sapiens
  misc_feature: GZ8MTXP01CHI8V.13.76.G10.1.454.CMB.2.raw
  modified_base (322)..(322): a, c, t, g, unknown or other
  modified_base (615)..(615): a, c, t, g, unknown or other
  modified_base (622)..(622): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagtcttgggtttttccttgttgcttaattttaaaaggtgcccagtgtgaggtgcagcgtggtggagtcgtggaggaggtcttgactccgaggtccggtgggggtccctgacgtaccttcctcctggtcgcacgtcctcgttcgggtccaccgtcacgtcacactacagtgacgtcgtcggtcccncgacggcctacggaggggaggggcgtagggagtcgtcgtttctttactttagtttagtagtaggtaggtactacactcgtcgcgacgtaccgtcgggtgggacgggtacccgtattccgacctactcctacccgaaagtaacgtaaaccctaacgttaaccgaaaacgtaaacccgttaccggtctttttacggttttaacctaaacgtaaaaacgttcgaaaccgtacggtccgtaaaggaacggtaccgacccgtaagtaccgaaccgtcggtaccgttagttacttacgnggtacgngaagaggtcgttaccggggaccaacgttaacgttcgaccgtgtacggtcggacggtcggttaccgggtaaccgaacggtaacccg

SEQ ID NO: 380920 - DNA, 738 bp, Homo sapiens
  misc_feature: GZ8MTXP01D2J80.13.76.G10.1.454.CMB.2.raw
  modified_base (641)..(641): a, c, t, g, unknown or other
  modified_base (656)..(656): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgtcttaattttaaaaggtgcccagtgtgaggtgcagcgtggtggagtcgtgggaggaggtcttgactccgacggtccggtcgggggtccctgacgtactctcctgtgcagtcctcgtgggtcaccgtcacgtcacacctacagtgacgtcgtcggtcccgcgtacggaccgtccggaagggggaacgggggtccgtagggtagttcggttccggtttaccttttaacgttttttaagtttagttaggttaaggttaggttaacgttaacctaacttaccgtccgacgtaacggtaacccgttccgggtcggggacggggtacccgtaactttaccacctactccgtacccaaggtaactaaacctaacttaaccgaaaaggtaacccttaccgggttctttacgtttttaccaaacgaaaagttcgaaaacgcgtaccgaggacgtaacgcgtaataccggactcggggtaccttagtaactcgngtcgaagtaggttancggggttaccggaaccctggttaaaacgtttcgaccgtgtacggcgggttcgcggaccggggtaaccgaacgggtaaccccg

SEQ ID NO: 380921 - DNA, 639 bp, Homo sapiens
  misc_feature: GZ8MTXP01CT0WH.13.76.G10.1.454.CMB.2.raw
  modified_base (254)..(254): a, c, t, g, unknown or other
  modified_base (562)..(562): a, c, t, g, unknown or other
  modified_base (567)..(567): a, c, t, g, unknown or other
  modified_base (573)..(573): a, c, t, g, unknown or other
  modified_base (603)..(603): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgcttattttaaaaggtgcccagtgtgaggtgcagcgtggtggagtcgtggaggaggcttgatccgaggccgtgggggtccctgacgactctcctgtgcngcctgtggtcacgtcagtcacacctacatcggagtcgtcgggtcccgacgacggccgtaccgggaagggggaagggggccgtgggtaggtcgtcgtttcttttacgttttatttagtagttaggttggtataccctatacgtcgcacgacgttcgggtggacggggtcctactccaccatcctacagtacgaaactaactaccgaaagacctacgttcttgttttacctaagaaagttcgaaactcggtaccgtaggaacggaccgacccgaagttacgacccgtacgggtccttagttacttacggngtcgngtaggngtacggcgggaccctagttaacgttcacgngtagcggtcgtcggacggaacccgttaaggaacccg

SEQ ID NO: 380922 - DNA, 672 bp, Homo sapiens
  misc_feature: GZ8MTXP01DF3PE.13.76.G10.1.454.CMB.2.raw
  modified_base (385)..(385): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtgggtcaccgtcagtcacacctacatgagcgtcgggtcccgcgacggcctccggaggggaacgggggcgtaggagtcgcggttctttcttttatttagtagtagtggtagtacatactcgcagactcgnggacgggccgtatcaccactctaccagacgaactaactaccaaagaacctcggtctttgtttacctaacaaagtacgaaacacggtacccgtaggaaacggaaccggacccgtaagtacggtaacccggaaccgggttacccgttagttaagtttacccgtgggtcggaacggtaaggacgggtacggttccgggggaacccctaaacggttaaaccgttccgaaccggtcttaacggcggggtaaccgtttcggggacgggggtaacccgaacggggtaaccccgg

SEQ ID NO: 380923 - DNA, 579 bp, Homo sapiens
  misc_feature: GZ8MTXP01DBM9B.13.76.G10.1.454.CMB.2.raw
  modified_base (439)..(439): a, c, t, g, unknown or other
  modified_base (465)..(465): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagctgggtccgccaggctccgagggaaggggctggagtgcgtctttctttatttatagtagtgtagtaccatactcgcagaactcgtggacgggccgattcaccatctccagagacaatccaaagaacacgtcttgtttctacaaaatcgaaacncgccttaggagtacgccgatcgaacncgggtccgttgtaattcgtgtgaacgagaggacgttcgggggaccccaaggttaaccgtttcacggcttaagtcgggaccgtcggttacgggggaacccaaagggggaaccccc

SEQ ID NO: 380924 - DNA, 706 bp, Homo sapiens
  misc_feature: GZ8MTXP01C44GY.13.76.G10.1.454.CMB.2.raw
  modified_base (296)..(296): a, c, t, g, unknown or other
  modified_base (324)..(324): a, c, t, g, unknown or other
  modified_base (342)..(342): a, c, t, g, unknown or other
  modified_base (561)..(561): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccaggccgtcgggggtccctgagactctcctgtgcagcctcgtgggtccacgtcagtcacactacatgagcgtcggtccncgacggcctaccggaggggaaggggcgngggtagtcgcgttctttntttatttagtagttagtggtataccatacgtccgacacgaacctcggtggacgggtccgtacttacccacctaactctacccgaagaacgtaacctaaacgttaccaaagtaaaccgtacggttactttgtttaccttaacaaaagttacggaaacttaccggcctagggaacgacgcccggaagttccgacgtaccggtccggttataagtttaccgnggttacggaacggaacggacggtacgggttacccgggggtaacccctaacgggttaaacgtttaccccggttcggtaacgttacggtgggtaaccccgggtcggttaacccgggggtaaccccgaaaacggggggtaaccccccg

SEQ ID NO: 380925 - DNA, 760 bp, Homo sapiens
  misc_feature: GZ8MTXP01DI3I0.13.76.G10.1.454.CMB.2.raw
  modified_base (246)..(246): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcacgcccgccctcagtcgtcgtcgggccccgagggcaggacggtccaccatcctccgtgcacgtgggacncagcctaccaactagttcgggcaacgtattagagtatcgtacacgtcgtaccagtctagttccgaggagacgacggtcccagacctctacactacgaaactaaccgtaaaccaactaacgtcccggacccggtaacccggtaaccgggttccccgtacggaaacccgttacgtttccgtcgtccgggtacctcccgggtacggttccgttccgggaccctaccgtccgtaccgtaccccgttcccgttaacgtccgtaacctccgtaacggtccggtacccgttacggggacgggttaccgtaagggtaaggtacggtacggtaccgttcggttaaggttttaaactttcgttttcccgtaccgggtcccttaaccgggtttccttaacggttccggaacaaacccgggtcaacccggttcggttaacggttggttaaccccggtttccgggtttaccggggttaaccgggggtttcccgggggaacccgggggtttccccgtaaccccggggg

SEQ ID NO: 380926 - DNA, 716 bp, Homo sapiens
  misc_feature: GZ8MTXP01AN6TP.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatccgagccgtgggggtccctgacgactctccgtgtcgcacgtcctcgtcgggttccaccggtcacgtcacacctacatgagcgtcggtcccgcgaggctaccggagggggacgggtcgtggagtcgtcgttcttcttttattagtagtagtggtaatactactactccgaacacgtcgtcggtgggacggggcctagttccactactcctacgaacgacgaacctaaacgttacccaaaacggaaccgtaccgttctttaacggtttaccttaaaccgtaaattacggaaacctacggtccgtaggaacggtacggaccccgtaagtcccggaaacggtacccgggtaccggtttagttaaccgtttaggtcgggttaacggaccgggtaaggaacgggtaacgggttacccgggggaccccttaaacggttaacccggttaaccgtaacggtaaccgttggtaccgggttacggttcgggaaccgggggtaacccgg

SEQ ID NO: 380927 - DNA, 669 bp, Homo sapiens
  misc_feature: GZ8MTXP01ECKWK.13.76.G10.1.454.CMB.2.raw
  modified_base (254)..(254): a, c, t, g, unknown or other
  modified_base (367)..(367): a, c, t, g, unknown or other
  modified_base (372)..(372): a, c, t, g, unknown or other
  modified_base (376)..(376): a, c, t, g, unknown or other
  modified_base (402)..(402): a, c, t, g, unknown or other
  modified_base (412)..(412): a, c, t, g, unknown or other
  modified_base (445)..(445): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagcttgggttttccttgttgcttattttaaaaggtgcccagtgtgaggtgcagctgggtggagtcgtgggaggaggcttgatccagccgtgggggtcctgagactctcctgtncacgcctcgtgggtcacgtcagtcacacctacatgagcgtcgggtccgccaggcctcggagggggaaggggctgggagtgtcgttcttcttttattagtagtagtggtagtanatacncganagcgtccgtggacgggcattcactancctacgaganactaataccaagacacgtcttagttacctaaanaaagtcgaaacgtacgtcgtaagacgacgccgtaagtaccggaaccggtaccggttccgtttaagttaacgtttcggtgggtcggaaacggtagggttaacgggtaaccggggttacccggggaaaccccgttaaacgggtttaaaccccgttaaccggtacggttaaccgtttaacgggtaccgggggttaccgggttccgggggttaaccgggggtaacccg

SEQ ID NO: 380928 - DNA, 663 bp, Homo sapiens
  misc_feature: GZ8MTXP01AFU3R.13.76.G10.1.454.CMB.2.raw
  modified_base (489)..(489): a, c, t, g, unknown or other
  modified_base (498)..(498): a, c, t, g, unknown or other
  modified_base (506)..(506): a, c, t, g, unknown or other
  modified_base (528)..(528): a, c, t, g, unknown or other
  modified_base (547)..(547): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcacgcccaccctcagtcgtcccgtgtcccccaggacagacagccagcatccactgctactaggaaaattaagttggacaagtaattaaactacttaaccttcctggtactcaagcaagtaagtccgacgtcccacgtcccctggtcgcgtggtacctatacctaatacgaacgtagtccgacccgaacgggtccccgtaccctcggaacggggtacctccccccgtaggacgtcgtacttcgtaacgtcggccttacccgaaccgttcgacgggtaaacctcgaaccgtccctactccgtactacccaagtccgaacggaccgggacccnggacttagngtaacggngacgtcgtagtacgttactcgngtcgacgggtgtacggacncgacgccgtcgccgtcgttacccgtacgttggttacgtaacgttaccgggaaccggttacggtaacccgtcggtaacccgtaaccgtacgttaccgtaaccgaacccggtaacccg

SEQ ID NO: 380929 - DNA, 536 bp, Homo sapiens
  misc_feature: GZ8MTXP01AY3KJ.13.76.G10.1.454.CMB.2.raw
  modified_base (388)..(388): a, c, t, g, unknown or other
  modified_base (393)..(393): a, c, t, g, unknown or other
  modified_base (409)..(409): a, c, t, g, unknown or other
  modified_base (411)..(411): a, c, t, g, unknown or other
  modified_base (413)..(413): a, c, t, g, unknown or other
  modified_base (416)..(416): a, c, t, g, unknown or other
  modified_base (418)..(418): a, c, t, g, unknown or other
  modified_base (420)..(420): a, c, t, g, unknown or other
  modified_base (422)..(422): a, c, t, g, unknown or other
  modified_base (424)..(424): a, c, t, g, unknown or other
  modified_base (427)..(427): a, c, t, g, unknown or other
  modified_base (432)..(432): a, c, t, g, unknown or other
  modified_base (437)..(437): a, c, t, g, unknown or other
  modified_base (458)..(458): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtgggtccgcaggctccgaaggggaagggggctggagtgcgttctcttttatttatagtagtggtagtacatactcgcagactcgtgagggccatcacatcncaganacatccaagacacgtntntntananananancgngaganacgangacgacgcgtgtatagtgtgngagagagcgggaccgaacgttaacgttacgttacgtaactagtcggtacggtcggttacgggaaccggaacggaaccg

SEQ ID NO: 380930 - DNA, 692 bp, Homo sapiens
  misc_feature: GZ8MTXP01AC8MH.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggtagttttggctgagctgggttttccttgttgctattttaaaaggtgcccagtgtgaggtgcagctggtggagtctggaggagcttgatccaggccgtgggggtccctgacgactctcctgtgcacgtcctcgttgggtcaccgtcagtcacacctacatgagcgtcgggtcccgccgaggccgtaccggaggggaacggggcttagggagtcgtcgtttctttactttttagttagttagtagtggtactacctactactccgcacgtaaccgtccggtggacggggccctattaccacctacttaccaccgaggtacaaactaaacgttacccgaaagtaaccctacggttctttaggttttacctaacgaaagttcggaaactcgccggtaagacgacgacccgtagtaccggaacctccggggtccttacgtatttaccggtggtcgaacggaaggaccggtacgggacccgggtacccgtaaacggttaaccgttacgttaccggtaacttacgggtcggtaccggtacggggttacccgggtaaccggaaccgggtcccg

SEQ ID NO: 380931 - DNA, 737 bp, Homo sapiens
  misc_feature: GZ8MTXP01BCL98.13.76.G10.1.454.CMB.2.raw
  modified_base (218)..(218): a, c, t, g, unknown or other
  modified_base (269)..(269): a, c, t, g, unknown or other
  modified_base (309)..(309): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggtagtttggctgagtcgttgggttttccttgttgacttaagttttaaaaggcgaccagtgtagaggtgcagtcgtggtggtagtcgtggaggnggtcttggactcgcggtccggtcgggggtcctgacgtctctcgtgtcgacncgtcctcggtcggttccaccgtacactaccacacctagancggacgtcggtcggcccgcgacggtccgaccggggagggagggtcgtggtacgtcggttcgttccttttagttttattaagtaggttacgtaggtactaccctaagtcgtaccgagtaccggtaaaccgttcgggtaacgggaacgggtccctattacccgaactcgtaccgttaaacccaaggaactaaaccttaaaccggttaaccaaacgggaaacccgttcgttaaaccgttttttacttaaaccgaaacgaagtaacgtaacgtacgtacggtacgtacgtacgacgtacgtacgtacgtacgtacgttacgtacgtacgtcgtagaacgacggacggtacggttaccggtaaccgtaacgttacgttacgttacgtaacgtacggtaacggtcggtacggacggtaaccggaaccgtaaccg

SEQ ID NO: 380932 - DNA, 679 bp, Homo sapiens
  misc_feature: GZ8MTXP01CXR4J.13.76.G10.1.454.CMB.2.raw
  modified_base (434)..(434): a, c, t, g, unknown or other
  modified_base (516)..(516): a, c, t, g, unknown or other
  modified_base (528)..(528): a, c, t, g, unknown or other
  modified_base (548)..(548): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggtagttttggctgagcttgggttttccttgttgtcttaattttaaaaggtgcccagtgtgaggtgcagcgtggtggagtcgtgggaggaggtcttgactccgacggtccggtgggggtccctgacgtaccttctccgtgtgccacgtcctcgttcggttccaccgtcagtaccacacctacagtgacgtcggtcgggtccccgcgacggccgtaccgggaaggggaaggggcgtgggagtcggtcgtttcttttacttttaattttagtagttagtggtaagtacccatccgtcgctagaaccgtccgnggacgggtccgtatccaccgactctaccgagaacgtaactaacgttaccaaagtaaccgacgttccttaggtttaccctaanaaacgtgaaacncgcgtagacgacgaccgtancgtacgcggttccgtgtatgcttggcgacggaggcgacggttccggggaacccttaaacggttaccgttacgtaacccgtgtaacgggtccgggtaccggttcggtccgggggttaacccgtaacccgggg

SEQ ID NO: 380933 - DNA, 716 bp, Homo sapiens
  misc_feature: GZ8MTXP01CHYXA.13.76.G10.1.454.CMB.2.raw
  modified_base (603)..(603): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttattttaaaaggtgcccagtgtgaggtgcagcgtgggtggagtcgtggaggaggcttgactccaggccgtgggggtccctgagtactctcctgtcgcagtcctcgttggtcaccgtcacgtccacacctacatggacgcgtcgggtccccgcaggccgtaccggaggggaacgggggtcgtgggtaggtcgtcggtttccttttactttttagtttaagttacggtttaaggttagggttaacgtaaccctacttaccgtacccgtacgtaacggtaacccgttcccgggtcggggaccgggggtacccgtaacttccaaccgtacttccaccgaaggtacaaactaacgttaacccaaagtaaccctacgttcgtttactttactaaacaaagttcgaactacgtccggagacgacgccgtaatcgaaccgtcggtaccgtnttaacgttcgtgtggaacgaagaggtcggttaccggggaacctaacgttaaaccggtttcacggtaatcgggtaacggtcgtcgggttaccgggaaccgttaacgggaacccg

SEQ ID NO: 380934 - DNA, 660 bp, Homo sapiens
  misc_feature: GZ8MTXP01CQ0L9.13.76.G10.1.454.CMB.2.raw
  modified_base (481)..(481): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgccagtgtgaggtgcagctggtggagtcgtggaggaggcttgactccgagccgtgggggtccctgagactctcctgtgcagcctcgtggtcaccgtcacgtcacactacagtgacgcgtcggtcccgcgaggccgtcggagggaaggggtcgtaggagtcgtcgttactttcttttaagtttagtagttaggttggtatacctatactcgacagtaaccgtcgtgggacgggtcccgtattccacactcctaccgaagaacgtaactaaacttacgaaacgtaacgtacgttactttacgtttactaanaaacgttacgaacgtacgtccgtaggaacggtacgaccgtaagtcgaacccgacgggttcccttagttaaccttacggtgtaggccgaaggccggaaagggttccccggaaaccgtaacgttaaccgttcacggttcgtagtcgggtcgtcggttaccggggaacgaacgggtaacccg

SEQ ID NO: 380935 - DNA, 748 bp, Homo sapiens
  misc_feature: GZ8MTXP01DAT7H.13.76.G10.1.454.CMB.2.raw
  modified_base (270)..(270): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtctggaggaggcttgatccaggccgtgggggtccctgagacctctcctgtgcagcctcgtggtcaccgtcngtcacacctacatgacgtcgtcgggtcccgcgacggccgtaccggaggggaacgggggcgtagggagtcgtccgtttcttttcttttaagtttagttaggttagttggttaacgtacctataccgtccgacacggtaccctcgggttgggaccggggccgtacttaccacctactccgtaccgagaacgacctaaacttacccgaaagtaaaccgacgttctttagtttacctaacaaattcgaaacaccgtccgtagggaacgacgcccgtagttaccggaccgtaacccggggttacccttagttaacttacggtcggtacggtccgggaaaggttacgggtaaccgggttccgggggaaaccccctaaaccgggtttaacccgtttaccgaccgggttaacgttaccggttcgggggtaaccccggtttcgggaccccgggggggtaacccggttaaacccggggtaacccccgg

SEQ ID NO: 380936 - DNA, 820 bp, Homo sapiens
  misc_feature: GZ8MTXP01EFFEN.13.76.G10.1.454.CMB.2.raw
  modified_base (274)..(274): a, c, t, g, unknown or other
  modified_base (285)..(285): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgcttattttaaaaggtgcccagtgtgaggtgcagctgggtggagtcgtggaggaggcttgatccaggccgtgggggtccctgagtctctctgtgcacgtcctgtcggtcaccgtnagcacacctanagtgagtcgtcgggcccgaccgcggccgtaccggagggggaagggcgtgggtagtcgtcgttctttacgtttttagttagtaggtaggttaggtacgtacacgtaccgttcccgaacgtacgtaaccggttccgggtacggggtaaccgggggtcccttaacgttaccaacccgttaacttcccgtaacccgaagggtaacgaaaccttaaaccgtttaaccccgaaaaaggtaacccgtaacgggtttctttacggttttaaaccctaataaaacgttcggtaaaccgtaacggggttaccccgtaagggaaaccggaacccggacccggtaaacgttccggaaaaccccggtaccggggtcccgtttaaggtttaaccgttttaaccggaaggttccgggaacgggaaaggttacgggtaaacggggttcccggggttaacccccgttaaaagggtttaccccggttaacgtaccccgttaagtaaccgggtcggggttaacctttcggggttaacccgggggaaaccccggg

SEQ ID NO: 380937 - DNA, 691 bp, Homo sapiens
  misc_feature: GZ8MTXP01DKHG9.13.76.G10.1.454.CMB.2.raw
  modified_base (252)..(252): a, c, t, g, unknown or other
  modified_base (457)..(457): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggagggaggcttgatccaggccgtgggggtcctgagactctcctgtgcngcctcgtggttcacgtcagtcacacctacatgagcgtcggtccgcgacggccgtcgaggggaaggggcgtggagtcgtcgttctttcttttattagttagtagtggtatacctatactccgcagtaaccgtcggtgggacggggtcctacttccgacctactcctacccgaagtaacgaactaacttacccgaaaggtaaacccncggttacctttagtttacctaaacaaaagtcgaaaccacggtccgttaagggaacgaccgtaccgtagttaccggaaccggtccgggtaccgttgtttaaacgtttaccgtgggtacgaacggtaaggttacgggtacgggttacccgggaaacccctaaaggttaaacccgtttcacggtcctaaggtccgggtaccgttcgggaccgggggaacccgttaaacgggggcccc

SEQ ID NO: 380938 - DNA, 741 bp, Homo sapiens
  misc_feature: GZ8MTXP01ALEYU.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactaaccatggagttttggctgagctgggttttccttgttgctattttaaaaggtgcccagtgtgaggtgcagctggtggagtcgtggaggaggcttgatccgagccgtgggggtccctgagactctcctgtgcagtcctcgtcgggttcaccgtcagtcacacctacatgacgcgtcgggtcccgccgaggcctccggaggggaacggggcgtgggagtgtcgttcgtttacttttagtttagtagttagtggtacgtactactacctcgactacgtacctcccgggtggaacgggggtccctaactttccaacccatttccaccgaaacggacgtaaaccctaaatttacccccgaaaagggtaaccctaacggttccgtttacggttttaaccttaacgaaaaacgttcgaaaacccgtcgtaaccccgttaggggaacggaccggtacccgaagttaacggacccgtaaccggttaccgttagggtttaaactttcccggtaggttcggggaacccgggttaagagggttcgggaaccccggaccggtaaaccgttaccgttacgcgttacgtcgggtacgttcggacgggaccggaccgggaaccgttaaccgggtccccg

SEQ ID NO: 380939 - DNA, 632 bp, Homo sapiens
  misc_feature: GZ8MTXP01ARPZ4.13.76.G10.1.454.CMB.2.raw
  modified_base (286)..(286): a, c, t, g, unknown or other
  modified_base (369)..(369): a, c, t, g, unknown or other
  modified_base (372)..(372): a, c, t, g, unknown or other
  modified_base (401)..(401): a, c, t, g, unknown or other
  modified_base (578)..(578): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggtagttttggctgagcttgggttttccttgttgcttattttaaaaggtgcccagtgtgaggtgcagctggtggagtcgtggaggaggcttgatccgaggccgtgggggtccctgagactctcctgtgcacgcctctgggttcaccgtcacgtcacacctangtgagtcgtcgggtccgcgaggcctacggagggaagggctggagtgtcgttcttcgttttattagtagtagtgtatacatacncgnacgacctcggtggcgggcgtacttcgacntctcaagacgtaactaactccgaaagtaacctcgtactttgttactaacgaaagttacgaaactcgggaccttagaacggacggaccccaagttccggaaaccggttcggaccgttattacgtccggagtcggaacgtagacggggtcgttccggggaaccctaacgttacccgttnttacggccttagggtcgggtaacgtcgggaccgggaaccgcgggggtaaccccg

SEQ ID NO: 380940 - DNA, 716 bp, Homo sapiens
  misc_feature: GZ8MTXP01D1GSN.13.76.G10.1.454.CMB.2.raw
  modified_base (632)..(632): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgccagtgtgaggtgcagcgtggtggagtcgtggaggaggcttgactccgaggccggttcggggggtccctggacgtactctccgtgtgcacgtcctcgttcggtcaccgtcacgtcacactacatgagcgtcgggtccgccgaggccgtaccggagggggaagggggtcgtggggtaaggttcggtccgtttccttttagttttttaagttttagttaaggtttaggtacggttaacgttaccctaacgttaccgtccgaccgtacgtaacccgttccgggtaaggggacgggggtcccttaacttccaacctactcctaccgagtaacgaacctaattaccgaaacgaaaccgtacggttctttacggttttacctaactaaaacgtcgtaaaaccgcgtaccggttaggaacggacgtaccggatacggcgtacggtaccgttgttattacgtggtacgngagaggtcggttccgggacctaacggttacgttcttacgcgttaaggtccggtacgcgggttcgggaacggaacggtaacccgg

SEQ ID NO: 380941 - DNA, 779 bp, Homo sapiens
  misc_feature: GZ8MTXP01C0BKY.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggtagtttggctgagtcgttgggttttccttgttgtcttaattttaaaaggtgcccagtgtgaggtgcagcgtggtggagtcgtggaggaggtcttgactccgacggtcccggtcgggggtccctgacgtaccttccttccgtgtcgctacgtccgttcgttcggttccaccgtcacgtacaccacctacagtgacgtcgtcggtcccgcgacggccgtaccgggaaggggaaggggtcgtggtacggtcggtccgtttcttttacttttaagtttagttaggttaggtaggttaacgttaccctacttaccgtccgacgtacgtaccgtccggtgggaccgggtcctacgttaccacctactcctaccgaagtaaccgtaactaaaccgttaaccgaaaactaaacccgtaccgttcttttacgtttacctaaactaaagtaccgaaactaccgtccggtaaggaacgtaccgaccgtaagtaccggtacccgtaccgggttccgttagttaacttaccgtggacggaacggtaagggaaggtacccggttaccgggggtaaacccccaagggttaaaaccccgtttcgttaccgcgtttacggcggggtaaccggtcgggttaaccgggggtaacccaacggggtaacccccg

SEQ ID NO: 380942 - DNA, 837 bp, Homo sapiens
  misc_feature: GZ8MTXP01CFPF7.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaggtgccagtgtgaggtgcagcgtggtggagtcgtggaggaggtcttgactccgacggccggtcggggggtccctggacgtacctctccgtggtcgcgacgtccgttcgttcgggttaccgacccggtctacggtccaaccaccctaacagtcggacgtcggtcgggtcccgccgacgggccgtaccgggaagggggacgggggcgtagggaggttcggtcggtttctttacgtttttaatttagttaaggttaggttaggttaacgttaaccacgttacgtccgacgacgtaacccggtcggttcgggacgggtcccgtacttaccacctacttctaccgaaggactaacctaaacttaccgaaaagtaacccgtaacgttcctttacggttttacctaacgtaaaacgtacgaacgtaccggtacccgggttaggaacggggaaccgtacccggtaaaggttaccggacccgggttaaacccggggtcccggttttaaggtaaaccgtttacccggttggggtacggtaaccggggaaggttaacggggtaaccgggttacccggggggtaaacccccgtaaggttaaacccgtttaccgggaccgttaacgtaacggttcggggtacgtacggggttaccgggggaacccgaacgggggtaaccccg

SEQ ID NO: 380943 - DNA, 650 bp, Homo sapiens
  misc_feature: GZ8MTXP01CAWSW.13.76.G10.1.454.CMB.2.raw
  modified_base (392)..(392): a, c, t, g, unknown or other
  modified_base (448)..(448): a, c, t, g, unknown or other
  modified_base (499)..(499): a, c, t, g, unknown or other
  modified_base (570)..(570): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagtctgggttttccttgttgcttaattttaaaaggtgcccagtgtgaggtgcagcgtggtggagtcgtggaggagcttgatccaggccgtgggggtcctggagtactctcctgtcgcacgtcctcgtgggtcaccgtcagtcacacctacatgacgcgtcggtccgccagggcctaccggaggggaaggggctggagtgtccgttctttcttttattatagttacgttaggtacgtatacttaccaccgtanacgccgtccggtaggggaccggggtccacttccgaacctattcccgacacggtaanaacctaaacgttaccaaaacggtacctacggttacccttatttccctaaanaaaacgttcgaaactacgcccgtagaggaccgaccctaagtcgaaaccgtcggtcccgtattacttacggngtagacgagttcgacggtcgggacccttaacggttaccgttaacacgtaacgtggtacggaccggtcggaacgggaaccg

SEQ ID NO: 380944 - DNA, 711 bp, Homo sapiens
  misc_feature: GZ8MTXP01BP3KM.13.76.G10.1.454.CMB.2.raw
  modified_base (286)..(286): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatccgagccgtgggggtccctgacgactctcctgtgcagcctcgtgggtccaccgtcagtcacacctacangagcgtcgggtcccgccgaggcctaccggaggggaagggggcgtgggagtgtcgttctttacgtttttaatttagttaggttagtggttaacgtaaccattacgtccgacacgtaacccgtccggtgggacgggtacccgtattacccacctactcctacccgaaggaacaaacctaacgttaacccgaaaaggtaaaccctaacccggttacttttacggttttaaccttaaaccgaaaagttcgaaaaccgtcggtaccgttaagggaacgacggacccgtaagtacggaccgaccggtaccgttgttaacttacgtggagcggaagacggcggttcggggaacccctaagttaaccgttccgacggtcgttacggtcgggtaccggtcgggttaccggggaaccgttaacggggtaaccccg

SEQ ID NO: 380945 - DNA, 613 bp, Homo sapiens
  misc_feature: GZ8MTXP01AE0ES.13.76.G10.1.454.CMB.2.raw
  modified_base (269)..(269): a, c, t, g, unknown or other
  modified_base (276)..(276): a, c, t, g, unknown or other
  modified_base (446)..(446): a, c, t, g, unknown or other
  modified_base (532)..(532): a, c, t, g, unknown or other
  modified_base (538)..(538): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtctggaggaggcttgatccagccgtggggggtccctgagactctcctgtgcagcctcgtcgggttcaccctnagtcacncctacatgagcgtcgggtccgccaggcctccggaggggaacggggctaggagtgcgttctttacttttatttataggtagtcggttagtaccctatactcgtcagtaaccgtccggtggacgggggcctattccgaactatcctaccgaggtacaaccaattaccgaaanaccgacgtcttacgtttactacgaaattacggaacacgccgttaggacgacgaccgagtacgacgcgtaccgtgtaatccgtgcgngtaagngacggttcggaccctaggttaactttcacgtaacctagtcggacgttacggacgggtaaccgaaggtaaccccgg

SEQ ID NO: 380946 - DNA, 718 bp, Homo sapiens
  misc_feature: GZ8MTXP01CJD1V.13.76.G10.1.454.CMB.2.raw
  modified_base (324)..(324): a, c, t, g, unknown or other
  modified_base (584)..(584): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttaattttaaaggtgcccagtgtgaggtgcagcgtggtggagtcgtggaggaggtcttgactccgacggcccggttcggggggtccctggacgaccttcctccgtgtgcacgtcctcgttcgggttccaccgtcagtcaacacctacatgacgcgtcgggtcccncgaggcctaccgggaaggggaacggggtcgtgggacggttcggtcgtttctttacgtttttattagttagttaggtggttacgtacctatctacgcacggtaacctccgggtggacgggtcctattccgacactcctaccgagacgaactaacttacccgaaagaacctacgtcgttattactaaacaataacgaacacggtaccgtaggaacgacgacccgtaagtccggaaccgaccggtccgttagtacgttaccgngggtcaacgggtaagacggtaacgggccggggtaaaccccacgggttaaaccgtttccgttaaccggaacgtttaacgggtcggggtacccgttcggggaaccgggggaacccgttaaaccgggggtaaccccg

SEQ ID NO: 380947 - DNA, 742 bp, Homo sapiens
  misc_feature: GZ8MTXP01CHF1C.13.76.G10.1.454.CMB.2.raw
  modified_base (248)..(248): a, c, t, g, unknown or other
  modified_base (283)..(283): a, c, t, g, unknown or other
  modified_base (518)..(518): a, c, t, g, unknown or other
tcagtcacgtactacacgaccggtgctcgatttagtcactcatacaggggggagaggagcccagcactgggattccgaggtgtttccattcggtgatcagcactgaacacagaggactaaccatggagttttggctgagctgggttttccttgttgcttattttaaaaggtgcccagtgtgaggtgcagctggtggagtcgtggaggaggcttgatccgagccgtcgggggtcctgagactctcctgngcacgtcctctgggtccaccgtcagtcacactacntgacgcgtcgggtcccgccgaggccgtaccggaagggggaacggggcgtaggggagtcggtcgtttactttactttttaagtttagtaggttaggttaggtagttacaacttaccgtccgagtacgtacccgtccgggtaggcggggtccctacttccaaccgtatcctacaaggaacacctaaattaccaaacgaactacgtcgtttagttaccttacaaaagttcggaaaacncgtcccgttaggggaacgaacggtacccgtaagtacgggaccccgaaccggggtttccgttaaggtttaaccgtttaacggtgggttacgggaaccgtaaggggaacgttcggggtttaccgggggacccctaaaacggggtaactttaaccggttcgactttaagggttcggaacccgggttcggtaccgggggacccgaaaacggggcccgttaaccccggg

SEQ ID NO: 380948 - DNA, 792 bp, Homo sapiens
  misc_feature: GZ8MTXP01AKCAU.13.76.G10.1.454.CMB.2.raw
  modified_base (256)..(256): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgcttaattttaaaaggtgccagtgtgaggtgcagctggtggagtcgtggaggaggcttgactccgaggccgtcgggggtcctgagactctcctgtgcncgcctcgtgggttcaccgtcacgtcacaccgtacatgacgcgtcgggtcccgccgagggtcctaccggaagggggaacgggggccgtggggaggttcgtcggtttctttacgtttttaagtttaagttaaggttaggttaggtaacggttactacgttaccgtacccgaacgtacggtaacccgttccgggtaggggtaccgggggtacccttaacgtttaccccgaaccgtaaacgtttccctaacccgtaaaggaacggtaaaccgtaaaaccttttaaaccccgggaaaacttaaaccccgtaccggttccccttttagggtttactttaaacccgaaaagtttccgaaaaacggcccgtaaccgttaggaaacccggtaaacgccgggttaaacccgtacgggaaacccggtccggtacggttaagttaaccgttcggtaaggtacggacggtacggacggtacggtaccggaccgttaccgttacgtaacgtacgtaacgtacgtacggttacggtcggttcgggtaacgg

SEQ ID NO: 380949 - DNA, 628 bp, Homo sapiens
  misc_feature: GZ8MTXP01BUWGB.13.76.G10.1.454.CMB.2.raw
  modified_base (363)..(363): a, c, t, g, unknown or other
  modified_base (367)..(367): a, c, t, g, unknown or other
  modified_base (453)..(453): a, c, t, g, unknown or other
  modified_base (532)..(532): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctatttaaaaggtgcccagtgtgaggtgcagctggtggagtcgtggaggaggtcttgactccgaggtccgtgggggggtccctggacgtactctctgtgcagcctctgggtcacgtcagtcacactacatgagcgtcggtccgctaggctccgagggaggctggagtgcgttcttcttttattatagtaggtgtagtaccattacnccgnacgtaaccgtccggtggacggggtcctattccgactacgtctaccgagagaacctaaagttcccgaaaagtaccgaacccggtttntttaacgttaccaagtaaactacgaaacgccgtacgtaggaacgacgacgagacgacgtacgtcgtgtaacttagtcgngaacggtagaggtccggttacggtaccctaacgttaacgttcacggtaatacgggtcggtacggtcgggttacgggtaacccgttaacgggtcccg

SEQ ID NO: 380950 - DNA, 722 bp, Homo sapiens
  misc_feature: GZ8MTXP01B4P6H.13.76.G10.1.454.CMB.2.raw
  modified_base (503)..(503): a, c, t, g, unknown or other
  modified_base (521)..(521): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttattttaaaaggtgcccagtgtgaggtgcagcgtggtggagtcgtggaggaggtcttgactccgagtccggtcgggggtccctgacgactctctgtgcgacgtccgtcgtcgggttccaccgtcagtccacaccctacagtgagccgtcgggtcccgaccgcggccgtccggagggggaaggggtcgtgggagtgtcgtttctttcttttatttagtagtaggttggtactaccactaccgtccgacgtacggtaaccgtcgggtcgggacggggtccctagttaccacctactcctacccgaaagtacgaaaccttaacgttaccaaaggtaccaccggttntttacgtttaccctaaanaaagtcgaactcggtaccgtaaggacggacgaccgtacgtaccggacccgtacggttaccgttagttaaccgttgtgggtacgaaggacggttacggtaccgggttacccgggtaaacccctaacgggttaaccgttcgttaccgtcggtacggtccggtacgggtccgggttaaccggggtaacccgaaccggggtcccg

SEQ ID NO: 380951 - DNA, 769 bp, Homo sapiens
  misc_feature: GZ8MTXP01EUO4J.13.76.G10.1.454.CMB.2.raw
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtcgtggaggaggcttgatccgagtccgtgggggtccctgagactctcctgtgcagcctcgtggtcaccgtcagtcacacctacatgagtcgtacgggtccgccgaggtcctaccggaagggggaaggggtccgtagggacgttggcccgtttcttttacgttttagtttagtaggttacgtggttaaccgtaacgtattaacccgccgaccgtaaacgtaccgttcgggtagggacgggggccctatttcccactatccctaccaaggacaactaacttaccgaaagtaaaccgccgtttcgttacggttttaacaaccgtaaaagttacgggtaaaacccgtacggggttaacggtaacggaacggtaacccggaccgtaacggtaccggtaaccggtaccgggttaccgttaagtttaacgttacgggtggtaacgggtacggaaacgggtacggttaccggggtaacccgggtaaacccgttaaacggttaccgttaccgtaacggttacgttaacgggttacgggtacccgggttaccgggtaaccggggaaacccgggtaaccggg

SEQ ID NO: 380952 - DNA, 662 bp, Homo sapiens
  misc_feature: GZ8MTXP01EFHC7.13.76.G10.1.454.CMB.2.raw
  modified_base (303)..(303): a, c, t, g, unknown or other
  modified_base (349)..(349): a, c, t, g, unknown or other
  modified_base (446)..(446): a, c, t, g, unknown or other
  modified_base (568)..(568): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgcttattttaaaaggtgcccagtgtgaggtgcagacgtggtggagtcgtgggaggaggcttgatccgagccgtgggggtccctgagactctcctgtgcagcctcgtgggtcaccgtcagtcacacctacatgacgcgtcgggtcccncgaggccgtaccggaggggaggggccgtaggagtcgtcgttctttnttttattagttagtagtggtacgtaccacttacgtccgactacgtaacccgttccggtgggacggggtacctagttccacctactcctaccaggtanaacctaaacttaccaaaggacctaacccggtttcttttacgtttaactaaactaaacgtacgaaacgcggaccgtaggaacgaccgacgtagtaccgacgtacggtcttagtacgtcgtggngaacggagacggtacggaccggaaccctaacggttaacgttacacggtgtacggtaacgggtcgtcggggaccgggtaacccgaacgggtcccg

SEQ ID NO: 380953 - DNA, 671 bp, Homo sapiens
  misc_feature: GZ8MTXP01B4JW2.13.76.G10.1.454.CMB.2.raw
  modified_base (284)..(284): a, c, t, g, unknown or other
  modified_base (320)..(320): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgtcttaattttaaaaggtgccagtgtgaggtgcagcgtggtggagtcgtggaggaggcttgactccgaggccggtcgggggtccctgacgtacctctcctgtgcacgtcctcgtcgggtcacccgtnacgtccacacctacagtgacgcgtcgggcccgacgnggccaccggaagggggacgggcgtggagtcggtcgtttctttacttttagtttagtaggttaggtaggtactacctactacgtccgcacggtaccgtccggtgggacggggccctattaccaccgtacttacccacgaaacgactaaacgtaaacctacgaaacgtacctacgttcgtttacgtttaaccaattaaacgagtaacgacgtcggtagacgacgctagcgtaaccgcgttcgttacttaatcggtgtcgaacggtagaacggtcgggttaccgaaacccgaggttaaccgttcaacgttgtaggtaacggtaccgggtgggaaccgggtccggaaacgtccgg

SEQ ID NO: 380954 - DNA, 862 bp, Homo sapiens
  misc_feature: GZ8MTXP01BS1RQ.13.76.G10.1.454.CMB.2.raw
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgcttattttaaaaggtgcccagtgtgaggtgcagctgggtggagtcgtgggaggaggcttgatccgaggtccgtcgggggtccctgacgtacctctcctgtcgcacgtccctcgtcggtccaccgtctacgtccaacacctacagtcgacgtccgtcgggtcccgaccgcggtaccgtcccgggaaggggggaacgggggtccgttagggggtacggttcggtaccgttttacgtttttacgttttttaagttttaacggttaaggttaaggtttacggggttaaaccgttaaccgtaaacgtttaacccgttaccccggtaccgtaaaaccgggttaaccccgggttcccgggggtaacggggtacggggggtaccccttaacgtttaccccaaccgttaccttacccgttaacccgaaagggtaaaccgtaaaccctaaaactttaaccccggaaaagtaaaacccgttccgtttaccgtttttacgtttaacccttaaaacctaaaggttaaccgaaaccgtacggggtacccgaaggtacggaacgtacccggtacgtacggtaacccgtacgggtccgttagttaccgttacgtggtaacggacgagggacgttcggtcccgggggaaacccttaacgttaacgttaccgtaagtcgtaacgtcgggtaaccggttcggtaacggggaaccgaaaccggg

SEQ ID NO: 380955 - DNA, 617 bp, Homo sapiens
  misc_feature: GZ8MTXP01B0Q7U.13.76.G10.1.454.CMB.2.raw
  modified_base (303)..(303): a, c, t, g, unknown or other
  modified_base (386)..(386): a, c, t, g, unknown or other
  modified_base (411)..(411): a, c, t, g, unknown or other
  modified_base (421)..(421): a, c, t, g, unknown or other
  modified_base (520)..(520): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagacctctcctgtgcagccttcgtcggggttcaccggtcagtcacacctacatgacgcgtgggtcccncgaggctccggagggaagggggctggagtgccgttctttcgtttttaattagtagttagtggtagtacactactcgcagaacnccggtggacggggctagttcacctntctccgaganactaagtccaaagaacacgtcttagtttcctagaaattcgaaactcgaccgtgaacgagcccgtaagtcggaaccgacgggtccctgttactttacggngtggaacgaggaggtacggttccgggaacccgtaagttaaccgttacgacggtaactaggcgggtacgtcgggacgggtaacccgaacggggtaacc

SEQ ID NO: 380956 - DNA, 635 bp, Homo sapiens
  misc_feature: GZ8MTXP01AFXRH.13.76.G10.1.454.CMB.2.raw
  modified_base (489)..(489): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtcgtggaggaggcttgatccgagccgtgggggtccctgacgactctcctgtgcacgtcctcgtgggttccaccgtcacgtcacactacactgagcgtcggtccgcaggcctaccggaggggaacgggctggagtcgcttctttacttttattagtagtagtgtacgtaccatacgtccgactaggtaacctccgtgggacggggccctagttccacctagtctacccaggaacaactaaacttccggaaacaactaccgtgtttacgtttccttaacgaaattacgaaacncgacgtagagacgccgtagcgacgacggtccgtgtatacgtgacgcgagttacgcgggttacgggaccctaaggttacccgttacaccggtaacgttagcggggttcgtaccgggttacggggtaacccaacgggggtaacccccg

SEQ ID NO: 380957 - DNA, 569 bp, Homo sapiens
  misc_feature: GZ8MTXP01C9AIP.13.76.G10.1.454.CMB.2.raw
  modified_base (283)..(283): a, c, t, g, unknown or other
  modified_base (325)..(325): a, c, t, g, unknown or other
  modified_base (382)..(382): a, c, t, g, unknown or other
  modified_base (392)..(392): a, c, t, g, unknown or other
  modified_base (435)..(435): a, c, t, g, unknown or other
  modified_base (468)..(468): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctatttaaaaggtgcccagtgtgaggtgcagctggtggagtctgggaggaggcttgatccgagccgtggggggtcccctgagactctccctgtgcaggcctcgtgggttcaccgtcagtcacncctacatgagctgggtccgccaggctccgaggggaaggggcngggagtgcgtcttcttttattatagtagtggtagtacatactccgaacagccgtcgngacggggccngttcacatctacagagacaattccaaagacacgctagttcctnaaagtcgaaacagcctgacgacgacagtgaacncggccttggtacttacgtgtgcggagagtagtcgggggaccccaggttaaccgttaaccgtaacgtcgttaagcgggttaccgtccggttgggggaacccg

SEQ ID NO: 380958 - DNA, 577 bp, Homo sapiens
  misc_feature: GZ8MTXP01EGF7F.13.76.G10.1.454.CMB.2.raw
  modified_base (271)..(271): a, c, t, g, unknown or other
  modified_base (297)..(297): a, c, t, g, unknown or other
  modified_base (336)..(336): a, c, t, g, unknown or other
  modified_base (370)..(370): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaggtgccagtgtgaggtgcagctggtggagtcgtgggaggaggcttgatccgagccgtgggggtccctgagactctcctgtgcagcctgtcgggttcaccgtnagtcacacctacatgagcgtggtccnccgaggctccggaggggaagggctggagtgtcgttcttnttttattagtagtagtgtagtacagtactccganacgtcgtcgtggacgggctatcacatcacagacgaacataccaaagactacgtcttattctaacaaatcgaacgtcgccgtagacgacgacccgtatacggaaccgcggttccgtattaacgtcgtggagacgtaggagtacgggtccggggaccccaaggttaaccttcgaacgtcttagacgggacgtccggttggggaacccgg

SEQ ID NO: 380959 - DNA, 596 bp, Homo sapiens
  misc_feature: GZ8MTXP01BMWAI.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtgggtcccgccgaggctccgaggggaaggggcgtggagtgcgtcttcttttattatagtagtggtagtaccatactccgcacgaaccgtccgtggacggggcctagttccaccgtatcctaccgaagacgaacaaacttccaaagaaccacgtctttagtttacctacaaatcgaaacagccgtagacgacgccgatcgacgacggccttgtacttacgtgtgaacgagacggtgttcggggacccaaggttaacgttccaacgtctagtcgggaccgtcggttacggggaacccgaacggggaaccccg

SEQ ID NO: 380960 - DNA, 640 bp, Homo sapiens
  misc_feature: GZ8MTXP01CVLK8.13.76.G10.1.454.CMB.2.raw
  modified_base (256)..(256): a, c, t, g, unknown or other
  modified_base (399)..(399): a, c, t, g, unknown or other
  modified_base (410)..(410): a, c, t, g, unknown or other
  modified_base (417)..(417): a, c, t, g, unknown or other
  modified_base (421)..(421): a, c, t, g, unknown or other
  modified_base (426)..(426): a, c, t, g, unknown or other
  modified_base (438)..(438): a, c, t, g, unknown or other
  modified_base (465)..(465): a, c, t, g, unknown or other
  modified_base (512)..(512): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaagggtgcccagtgtgaggtgcagctggtggagtcgtgggaggaggcttgactccgaggccgtcggggggtccctgagactctcctgtgcngcctcgtcgggttcaccgtcacgtcacacctacatgagcgtcggtcccgccgaggccgtccggaggggacgggggtcgtgggagtcgtcgttctttacttttatttagttagtagttaggtagtaccatctcgcacacgtcgnggacgggcctnttcaccnctcncaganactaataccaanaccagtcttattctacaaatgaactcnccgtagacgaccgcgtagaccgacgcggtccgttagtactttacggnggtcggaacggtaaggacggtaccgggttacccgggtaaccctaaacggttaacccgttcgttaccggtaacgttacgggtccgggtaccgggtccgggaccggggtaacccggaaccgggtaacccg

SEQ ID NO: 380961 - DNA, 529 bp, Homo sapiens
  misc_feature: GZ8MTXP01ELYCO.13.76.G10.1.454.CMB.2.raw
  modified_base (291)..(291): a, c, t, g, unknown or other
  modified_base (370)..(370): a, c, t, g, unknown or other
  modified_base (410)..(410): a, c, t, g, unknown or other
  modified_base (414)..(414): a, c, t, g, unknown or other
  modified_base (448)..(448): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctgggggatccctgagactctcctgtgcagcctctgggttcaccgtcagtcacactacatgagctgggtccnccaggctccgaggggaaggggctggagtgcgttctcttttatttatagtagtggtagtacatactccgcaagactccgngaggggccattcaccatctcagagacaatccaaagaaacncgtntgttactacaaatcgaacagctagagacgcgagngacgacgcgtgtatactgtgcgagagagtcgggccgacgaacgttactaactactaacgtgacgttcgtcgggcggaacgg

SEQ ID NO: 380962 - DNA, 789 bp, Homo sapiens
  misc_feature: GZ8MTXP01D2ORL.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctggattttccttgttgcttattttaaaaggtgcccagtgtgaggtgcagctggtggagtcgtgggaggaggtcttgatccgacggtccggtcggggggtcccctgacggtaccttccgtccgtggtcgcacggtcccttcggtcgggttccaccggtcacgtcaccaccacatagaggcgtcgggaccgccgacggtcctacggagggggacgggcgtggtagtcgtcgtttctttatttttaagtttaagttaggtaggttacggttaacgtactaacttacccgtccgacgtaaaccgtacgttcccgggtaggggtaccgggggacctacgttccaacctctacctaccgaagaaacgtaaacctaaacgttaccgaaaacgtaaaccgtaacgttcgtttacgtttaaacttaactaaaacgttacgaaacgtacggtaccggtaaggaagtaccggaccgtatacccggaacgaaccgggggttcgttaacggttactttaaacggggcggtaacgggaacggacggggtacggttaaccgggtaccggggtaacccttaaaccgggttaaccgttaccggtaacgtacgtaacgggttacgggtaccgggttaccgggaaccggggttaaccggaacccggg

SEQ ID NO: 380963 - DNA, 641 bp, Homo sapiens
  misc_feature: GZ8MTXP01EWVYR.13.76.G10.1.454.CMB.2.raw
  modified_base (170)..(170): a, c, t, g, unknown or other
  modified_base (243)..(243): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctcaggaaataattggacagataaatatacttcngtatcagcagaagtcaggccacgtcccctgtcgctggtcagttctatacaagctcgacctaaggccgccctagacgggtactcccccgagagcgtacttcgtacgtcggccttacccaagtccgtagggaaccttcgaacgtccctactctacggacctagtaccgacggaccccgggaccctagggtacctaggtacggacgttagggacgacggttacgtaactttaaacgttccgtaggttaccgaacggggtcgtaacgggggactacggcgaaccgccgtaaccggttcgaccccggtacttacgttccggttacgttaccgggttacggttaccggggaaccctaaggtcccgtaaacccggtttcgaacccgtccgttaacgaacccccgg

SEQ ID NO: 380964 - DNA, 761 bp, Homo sapiens
  misc_feature: GZ8MTXP01B71M7.13.76.G10.1.454.CMB.2.raw
  modified_base (547)..(547): a, c, t, g, unknown or other
tcagtcacgtactacacgaccggtgctcgatttagtcactcatacaggggtgggagaggagcccagcactgggattccgaggtgtttccattcggtgatcagcactgaacacagaggactcaccatggagttttggctgagctggtattttcctcgctgacttaattttaaaaggtgtccagtgtgaggtgcaagtggtggagtcggtgggggggcttggtaagccgtgggggtccctcagactctcctgtgcaacctctgtattctattttctctcgacgtccgtggtgagtcgtcgggtcccgccgacgggtcccggtaccccgggggaagggtcgtaggggtaggttgggggttcggtacccggtttaaaggtttaaaagggtaggaaaacgtaacgtaggttcgggtaaccggaaacaaacgtacggtaaaccccttacggtaggttccggttaccccggtaaggaaaaaacggtccgtaagtactttaccaacttaacgtacctacgaaagagtaactagtaaacctaaagaaaaagtaaangtaaattactaatacgtagaaacaaaacgtacgaaaacctaacgggaaacgaaaacggcgaaacggaactaaccgagggtaccttaggttaacttacgtacctaaccgaacgaaggtacggttacgggacaaagtagtacgaacgaaaggttccggaaccggacggtaacgtaacggtccggttaacgtccggggttaaccgggggaaccccgg

SEQ ID NO: 380965 - DNA, 794 bp, Homo sapiens
  misc_feature: GZ8MTXP01DEV5K.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagcttgggtttttccttgttgtcttaattttaaaaggtgcccagtgtgaggtgcagcgtggtggagtcgtgggaggaggtcttgatccgagccggtgggggtccctgagactctccgtgtcgcacgtcctcgttcgggttcaccgtcacgtcaacacctacatgacgcgtcgggtcccgccgagggcctccggagggggaacgggggtcgtggggacggttcggtccggtttcttttacgttttttaatttaagttaggttacgtttgggtaagttactagttacctcccgaacgacgtaaccgttccgggtacgggaaccgggggtacccctaacgttcccaaaccgtacttcccgtaccgaaagtaaacggtaaacctaaaacctttaacccgaaaacgtaaacccgtaaccgttaccgttttacgtttacccgttaaactaaaaacgttacgaaaaccggttaaccgtacccgttaacgggaacggaacccggttaccggaacgttacgggaaacccgtacggggttacccggttagtttaacgttaccgttaaggtcgacgggtaacggaggtacgggtcggggaaccccgttaacggttaacgttaaccgtacgtctaaggtcggttacggtccggcggggtaacccgg

SEQ ID NO: 380966 - DNA, 834 bp, Homo sapiens
  misc_feature: GZ8MTXP01C32YD.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggtttttccttgttgcttattttaaaaggtgcccagtgtgaggtgcagcgtggtggagtcgtggaggaggcttgactccagccgtggggacgtccctgagtactctcctgtgcacgtcctcgtcggttcaccgtcagtaccactaacctacagtaggacggtcggtcggggtacccgcccgaacgggtcccgtaccgggaagggggaacgggggtccgttagggaggttcgtccggttttactttacttttttaagtttaacgttaggtttaggttacggtttaacgttacctacgttacccgtacccggtactaaaccggtacccgttccgggtaggggaccgggggtacctaaccttaccgacccctacgtcccgtaaccgaaggtaaccgtaaacctaacgttaaaccccgaaaaggaaaccctaccggtttaccttttacggtttacctaaactaaacgttaacgaaaccgtgggtacccctagggaaaccgccggacgtacgtacggaaccgtaacccgggtgttacgttataccgggtggtaacgcgggaaacggtcggttacggggtaacccggggtaccccgttaaaacgggtttaaccgtttaccgtaaccgggtaccttaaggggtccgggttaccgggttacccgggttaaccggggggaacccggtaaaaccccggggg

SEQ ID NO: 380967 - DNA, 805 bp, Homo sapiens
  misc_feature: GZ8MTXP01CEAV6.13.76.G10.1.454.CMB.2.raw
  modified_base (189)..(189): a, c, t, g, unknown or other
  modified_base (221)..(221): a, c, t, g, unknown or other
  modified_base (295)..(295): a, c, t, g, unknown or other
tcagtcacgtactacacgaccggtgctcgatttagtcactcatacagggggaggctctgcttcagctgtgggcacaagaggcagcactcaggacaatctccagcatggccctggtctcctctcctcctcactctcctcgctcactgcacagggtcctgggcccagtctgtactgacgcacgccgccctnagtgtcgtcgggccccaggcaggacggtcacntctctgctacgtggacgcagcctacaacgtgtgggacacgtattagtagattcgtactacgttacggtaaccgngtacctacggttccgagggtacgtacgtaccggtcccaacgtcctactacatacgtaaagtaacccgtaaaccacgaaaccgtcccgggacccccgtaacgggtcccggggttaaccctacgggtaaccccgttactttcccgtaccgttaccgggtcccgttacccggtacggttcccgtcggtaaccctcccggttaacccgcccgtcccccgttaccggtcggttacccaaccttacccggtccggttaacggggtccccgttaaccgggggcggggttacccgtacggggtaaagggtaccgtccgggggttaacgttacccggtttaggtttaaaccggttttctttaaccccggtaccggtccccggtttaaaacttccccgtttaggacccgttaaaccgcgtaccgttaaccgggttccgttaacggttccgggttcccgggtcggtttttacccggggaccgggtttcccggggggtaacccgggttcccgtaacccgggg

SEQ ID NO: 380968 - DNA, 771 bp, Homo sapiens
  misc_feature: GZ8MTXP01BNK03.13.76.G10.1.454.CMB.2.raw
  modified_base (686)..(686): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcgttgggtttttccttgttgtcttaattttaaaaggtgcccagtgtgaggtgcagcgtggtggagtcgtggaggaggtcttgactccgacggtccggttcgggggtccctgacgtaccttccttccgtgtcgctacgtccttcgttcgggtccaaccgtctacgtccaaccacctacagtcggagtccggtcgggtccccgccgacggccgtaccgggaaggggaggggtccgtagggtacgtcgtcgtttccttttagtttttaagtttagttaggttaaggtacggttaacgttaaccctacgttaccgtaccggacgtaaaccggtacccgttacccgggtgggggaacccggggtacccgttaacttaccccgaaccgttacgttccgaaaccctaaaggtaacctaaactaacgtttaaccgaaaacgtaacctaaccgtttcgttttacgttttaaccaaactaaaacgttaccggaaacgtaccgtaccgtagggaaacgtccggaccttaagaccgacgcggttacgtgtattagtcgngaacgagttacggacggttaccggactaacggttacgttcgaacgtgtacgaacgggtcgacggttccgggaaccgcggtaaccg

SEQ ID NO: 380969 - DNA, 647 bp, Homo sapiens
  misc_feature: GZ8MTXP01EA9UI.13.76.G10.1.454.CMB.2.raw
  modified_base (569)..(569): a, c, t, g, unknown or other
  modified_base (576)..(576): a, c, t, g, unknown or other
  modified_base (580)..(580): a, c, t, g, unknown or other
  modified_base (592)..(592): a, c, t, g, unknown or other
  modified_base (617)..(617): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgtcttaattttaaaaggtgcccagtgtggaggtgcagcgtggtggagtcgtggaggaggtcttgactccgaggtccgtcgggggtccctgacgtactctcctgtgcacgcctcgtgggttcaccgtcagtcacacctacatgacgcgtcggtccgcgacggctaccggaggggaacggggcgtggagtcgtcgtttctttactttttagtttagttagtagtggtagtacctattactccgactacgaacccgtcggtgggacggggtccctaacttcccgaacctacttaccgtacccgaagtaacgtaacctaaacttaccgaaacggtaaacctcggttcttttagtttacctaacaaaagttcgaaaactcgtcggtaaggacgacgtccgaagcgacgacggttcgtnttaactntggngaacgtagacgnggttccgggacctaagttacgttancgctagcggtagtcggaggaaccgaagccg

SEQ ID NO: 380970 - DNA, 702 bp, Homo sapiens
  misc_feature: GZ8MTXP01C63BP.13.76.G10.1.454.CMB.2.raw
  modified_base (297)..(297): a, c, t, g, unknown or other
  modified_base (309)..(309): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtgggaggaggcttgactccgagccgtgggggtccctgacgcctctccgtgtgcacgcctcgtcggttcaccgtcacgtcacacctacagtgngcgtcggtcccnccgaggcctaccggagggggaacggggtctagggaggttcgtcggttcttttacgttttttaatttagtaggttaggttacggttagtactactaccgtcccgaacaacgtcccgtccgggtagggacggggtacctacgtaccacccgtaatccctacgaacgtaacgaacctaaacgttaccccgaaagtaaccgtaacgttccgtttacgtttaccttaaacgaaacgtacggtaaaccaacgtccgtaaggacggacgcccgagtaccgaaccggtacggtccgttagttacttacgtggtaggcggaagcgaacgggttcgggaacccgttacggttaaccttaagaccgtgtacgtcgggttacggttccggaacggggtaacccgg

SEQ ID NO: 380971 - DNA, 718 bp, Homo sapiens
  misc_feature: GZ8MTXP01A0CT5.13.76.G10.1.454.CMB.2.raw
  modified_base (320)..(320): a, c, t, g, unknown or other
  modified_base (397)..(397): a, c, t, g, unknown or other
  modified_base (602)..(602): a, c, t, g, unknown or other
  modified_base (657)..(657): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggtagttttggctgagtcttgggtttttccttgttgtcttaagttttaaaaggtgcccagtgtgaggtgcagcgtggtggagtcgtggaggaggcttgactccgacggccggtcggggggtccctgacgtacctctcctgtgcacgtcctcgtcgggttcaccgtcagtcacacctacatgagcgtcggtccgcgnggcctccgaggggaggggctggagtcgtcgttctttacttttagttataggttagtggtacgtacctactactccgntacgaaccgtcgggtggacgggggtccctattaccgacctactccctaccgaagtaagaacctaaacttacccgaaaagtaaccctacggtcctttaggttttacccttaacaaaacgttacggaaacccgtaagtcccgttaggggaaacgtagtacccgaagttccggaccgtaaccgggttcgttaacgttattaccgtggnggaaccgtaaggacggcggttaccgggggacccctaacggttaaccggtttaacnccggtaataacggtcgggaccgttaccgggggccggggtaacccgaacgggtaacccccgg

SEQ ID NO: 380972 - DNA, 751 bp, Homo sapiens
  misc_feature: GZ8MTXP01AVXH7.13.76.G10.1.454.CMB.2.raw
  modified_base (288)..(288): a, c, t, g, unknown or other
  modified_base (306)..(306): a, c, t, g, unknown or other
tcagtcacgtactacacgaccggtgctcgatttagtcactcatacaggggtctggggagaggagcccagcactgggattccgaggtgtttccattcggtgatcagcactgaacacagaggactcaccatggagttttggctgagctgggttttccttgttgctatttaaaaggtgccagtgtgaggtgcagctggtgagtctggaggaggcttgatccgagccgtggggggtccctggagactcgtcctgtgcacgcctcgtcgggttcaccgtcagtcacgacctanatggagccgtgggtcccnccgaggccgtccgagggggaaggggctgggtacggtgcgtttcgttactttttagttagtaggtacgttgtaacggtactacgtaccgtccgaactacgtcgtccggtagggacggggacctagttaccaacctactacccgtaccgaaagacgtaaactaaccgttaccgaaaacgtaaccgtacgttaccctttaggtttaaccccttaaaacgtaaacgttacggaaacgtacggtacgtaacgggaacggtaaccgtccgtaagtaccggtaaccggtaccgggttccgttaagtttaccgttaaggttaacggacgggttacggtaaggttaccgggtaaccgggtaaccggggaaccccgttaaacggttaaaccggtttaacgtaccgtaacggtacggtacggggttacccggtcggggttaaccggggtaacccgg

SEQ ID NO: 380973 - DNA, 774 bp, Homo sapiens
  misc_feature: GZ8MTXP01CG76C.13.76.G10.1.454.CMB.2.raw
  modified_base (170)..(170): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaagnccagtgtgaggtgcagcgtggtggagtcgtggaggaggcttgatccaggccgtcgggggtcccgtgagactctcctgtgcacgcctcgtggttcaccgtcagtcacacctacagtgagcgtcgggtccgccgaggccgtccggaaggggaacgggggcgtggagtcggtcgtttcctttatttttaagtttagtaggtaggtggtacgtaaccacttacgtcgctaacgaccgttcggtggacggggtacctactttcccaacctactccgtacccgaaagacgtaaacctaaacttacccgaaaagaaacccgtaccgtttaccgtttacgttttaacccctttaaagaaaacgttaacgtaaaccgacgtaccccggggttaaggaaacggtacgaaccccggtattaccggaaaccggtacccgggtacccgttttaggtaaactttaccgtggttaggaaccggtaaagggacggtacgggttaccgggggtaaaccccctaagggttaaaacccgttccggttaaccggtaacttaagggtccggggtaccggttaccggggttccgggggtaaaccccgaaaccgggggtaaccccgg

SEQ ID NO: 380974 - DNA, 835 bp, Homo sapiens
  misc_feature: GZ8MTXP01BQ8RG.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggtcaccgtcagtcacacctacatgacgcgtcgggtcccgccgaggccgtaccggaagggggaacgggggtccgtagggggtaggtcggtccggtttacctttacgttttttaagtttaagttaaggttaggttagggttaaacgttaacccaacgtttaccgtcccggacctaacggtaaaccccgttcccgggttggggaaccggggggtaccccgttaactttaccccgaaacccttaacgttccccgttaaaccccgaagggtaaacgtaaaacccttaaactttaaaccccgaaaacgtaaacccgttaacccggttacccgtttttaggtttttaccccctttaaagaaaaacgtttacgaaaaaccgtcggtaccccggttaaggaaccgggaacgaaccccggtaagtaccggaaccgtaccggggtacccgttgttaaacgttaccgtgggtcccgaacggtaaggacggttacggaccgggggtaccccaaacgttaacggttacgttaccgtgtaacggtcggtaacgggtccggttaccgggggaaccgttaacgggggaaccccg

SEQ ID NO: 380975 - DNA, 618 bp, Homo sapiens
  misc_feature: GZ8MTXP01EWV4F.13.76.G10.1.454.CMB.2.raw
  modified_base (302)..(302): a, c, t, g, unknown or other
  modified_base (377)..(377): a, c, t, g, unknown or other
  modified_base (386)..(386): a, c, t, g, unknown or other
  modified_base (409)..(409): a, c, t, g, unknown or other
  modified_base (421)..(421): a, c, t, g, unknown or other
  modified_base (450)..(450): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatggagcgtgggtcccgccgnggcctccggaggggaagggggcgtgggagtgtccgttctttctttttattatgttaggtgtagtaccatactcgnacgactcgngacgggcattcactatctcaganacaactccaaanacacgctttagttcttaacaatagaaacncgaccgtgaacgtacgcccgagtcgaccgtccggtccgtagtactttaacgtgtcgcggtaaggacggtacggttccgggggtacccctaacggttaaccgtttacgaccggtaactacggttcgggacggttacggacgggggtaacccggaacggggtaaccccgg

SEQ ID NO: 380976 - DNA, 662 bp, Homo sapiens
  misc_feature: GZ8MTXP01BHYFD.13.76.G10.1.454.CMB.2.raw
  modified_base (307)..(307): a, c, t, g, unknown or other
  modified_base (378)..(378): a, c, t, g, unknown or other
  modified_base (401)..(401): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagtttggctgagcttgggttttccttgttgtcttaattttaaaaggtgcccagtgtgaggtgcagcgtggtggagtcgtggaggaggcttgactccgaggccgtgggggtccctgacgtactctctgtgcagcctcgtcgggtcaccgtcagtcacacctacagtgagccgtcggtcccncgacggcgtccggaggggagggcgtggagtgtctttctttcttttaagtttataggtagtaggtacgtacnctacgccgacacgtaccgtcggnggacggggcctacttccgactactcctaccgaagacgaactaaacttacgaaagacctacgtctttgttactaacgaaatagaaactcggacgtagaacggacgtccgataccggacgtacggtccgttagttaccgttgtggtcgaaggtacggaacgggtacggttacccgggaaacccgtaaccggttaaacgtttcggaaccgtcgtaacggtcgggtaccggttcgggacggggaacccgttaaacgggccccggg

SEQ ID NO: 380977 - DNA, 771 bp, Homo sapiens
  misc_feature: GZ8MTXP01BB7BQ.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttattttaaaaggtgcccagtgtgaggtgcagctggtggagtcgtggaggaggcttgatcccgaggccggtggggggtccctgacgtactctctgtgcagtcctcgtcggtcaccgtcagtcacacctacatcgagtcgtcgggtcccgacgacggccgtaccggaaggggaagggggtcgtgggtacggtcggtccgtttcttttacttttttaagtttagttaaggttacggttaggtaaacgttaacccctacttacgtcccgacgtaacggtaacccgtccgggtgggaccggggtccgtactacccgacctacgtcctaacccgaagtaacgaaacctaaacgttaacccgaaaaggtaaaccctacggttccttttacgttttaaccctaaacgaaagttacggaaacacggtaccggtagggaacgtaccggcccgtaagtccggaacccgtaccgggttacgttacgttacgttacctggggtcaagggtaaggttacggtacggttcccgggggaaacccctaacgggttaaaccgtttcgaccggtcttaagggtccgggtaaccggtcgggttaccgggggaacccgaaacggggtccccg

SEQ ID NO: 380978 - DNA, 585 bp, Homo sapiens
  misc_feature: GZ8MTXP01D4J73.13.76.G10.1.454.CMB.2.raw
  modified_base (423)..(423): a, c, t, g, unknown or other
  modified_base (442)..(442): a, c, t, g, unknown or other
  modified_base (483)..(483): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagcgtcgggtcccgccaggcctccgaggggaagggggctgggagtgcgtcttcttttattatagtagtgtagtacatactcgcagaactccgtgacggggccgtattccgacatctaccagacgacaattccaaagacacgnttgttctacaaatgaaacngcgagacgagcgatcgacgcggtcgttagtacttacgtggngaacgaagaggtcggttaccgggacccctaacggttaaccgttccgacgtcgttaggtcggtaccggtcggttaccggggtaacccgaaacggggaaccccg

SEQ ID NO: 380979 - DNA, 643 bp, Homo sapiens
  misc_feature: GZ8MTXP01B3EWY.13.76.G10.1.454.CMB.2.raw
  modified_base (265)..(265): a, c, t, g, unknown or other
  modified_base (277)..(277): a, c, t, g, unknown or other
  modified_base (334)..(334): a, c, t, g, unknown or other
  modified_base (441)..(441): a, c, t, g, unknown or other
  modified_base (453)..(453): a, c, t, g, unknown or other
  modified_base (520)..(520): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtctggaggaggcttgatccagccgtgggggtccctgagactctcctgtgcagcctcgtggtcacgtnagtcacactacntgagctcgggtccgcgaggccgtaccggaggggaagggcgtggagtcgtcgtctttnttttattagtagtaggtgtagtacctatactccgacagtaaccgtccggtgggacgggtccgtattccaccatctccagacaccaaattcccgaaagaccaccgttntttacttacaanaaagtcaaacgcgtacgggtagaaggccgtacgagtcgaacccgtcggtacgttagttaacgttcgngggtgaacgaaaggttacggtacggttaccccgggtacccgtaaacggttaaccgttacgttaccgtaagttcggtaaccgggtccggtcggggaaccggggaaccgttaaccggggaacccg

SEQ ID NO: 380980 - DNA, 614 bp, Homo sapiens
  misc_feature: GZ8MTXP01AC3J2.13.76.G10.1.454.CMB.2.raw
  modified_base (401)..(401): a, c, t, g, unknown or other
  modified_base (446)..(446): a, c, t, g, unknown or other
  modified_base (568)..(568): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggtcaccgtcagtcacacctacatgagcgtcgggtcccgccgaggcctaccggaggggaacggggcgtggagtgcgtctttcttttattatagtagtggtagtaccatactcgcagtacctcggtgacggggcctattccaccntctaccagacgacaattaccaaagaaccacgtcttgtttacctanaaagttacgaaacacgaccgtaggaagacggacccgttagcggaaccgacggcccgtttagtactttaccgtggtgcggaagaggacggttacgggggaccctaacggttacgttacacgtnttacgtcggtaccggtcgggttacggggcccgaaaggggaaccccg

SEQ ID NO: 380981 - DNA, 766 bp, Homo sapiens
  misc_feature: GZ8MTXP01ALWDJ.13.76.G10.1.454.CMB.2.raw
  modified_base (714)..(714): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgcttaattttaaaaggtgcccagtgtgaggtgcagcgtggtggagtcgtggaggaggtcttgactccgaggtccgtcgggggtccctgacgacctctcctgtgctagtcctcgtcggtccaccgtacacgtccaccacctacagtcgacgtccggtcgggtccccgaccgacggccgtccggagggggaacgggcgtggacgtcgtacgtttccgttttatttttaagtttacgttaaggttaggttacggttaacgttaaccctaccgttaccgtcccggtacgaacggtaacccgttacccgggttgggaccgggggtaccctaacttccccaaccgtactccgtacccgaaacgtaacgtaaccctaaacgttaccccgaaaagtaacccgtaaccgttcgtttacttttacgtaaacaaacgttaggaaaccgacgtcgggtagggaacgcggtaccgtaagtcggaccgtaccgggtagttacttagttaccgtgggtcgaacggaagacgggtacggttcccgggaaacccgttacggttaacccgtttacnccggtaattgaaccgggtacgtcgggttacggggaaccgaacggtaaccccg

SEQ ID NO: 380982 - DNA, 573 bp, Homo sapiens
  misc_feature: GZ8MTXP01D7W8Q.13.76.G10.1.454.CMB.2.raw
  modified_base (294)..(294): a, c, t, g, unknown or other
  modified_base (370)..(370): a, c, t, g, unknown or other
  modified_base (373)..(373): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggtcaccgtcagtcacacctacatgagctgggtcccncaggctccgagggaggggctggagtgcgttcttcttttatttatagtagtgtagtaccatactccgcagactccgnggngggccagttccacctatctccagagaacaacttaccaaagaaccaacgtcttagtttctacaaatgaacagccgttagacgagacccgatcgaacgacgttacgggccgttaggttacttaccgtggtaagccgagtagagtcggggacccaacggttacttactaacgctaagtcggacgttcgtcgggcgaaaccggg

SEQ ID NO: 380983 - DNA, 604 bp, Homo sapiens
  misc_feature: GZ8MTXP01CTGLM.13.76.G10.1.454.CMB.2.raw
  modified_base (305)..(305): a, c, t, g, unknown or other
  modified_base (378)..(378): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagcccgccctcagtgtctcggggccccagggcagagggtcaccatctcctgcactggggagcagctccaacattggggcacattatgatgtacactggtaccagcagtttccaggtagcaggtcccanactcctcatcaatacgtaacaaacatccggcccgacgagggtccctagacccgattctactggctccaggtcncggtcacctcacgtcctcccgtggtcatccacgtgggcctcggacggctggacggtagtcgagggtctacggtatttacgttttcgtacgtcctaacggttacccttattacggaaccgtacgggccttaacgggttcccgttacggtaagggtttaccggtccggttttccggggttaacgggttcccgggggtaaccggggggggttaaccccccgtaacgggg

SEQ ID NO: 380984 - DNA, 744 bp, Homo sapiens
  misc_feature: GZ8MTXP01BPJAE.13.76.G10.1.454.CMB.2.raw
  modified_base (253)..(253): a, c, t, g, unknown or other
  modified_base (646)..(646): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagcttgggttttccttgttgctattttaaaaggtgcccagtgtgaggtgcagctggtggagtcgtggaggaggcttgatccagccgtgggggtccctgacgctctccgtgtncacgcctcgtcgggttcaccggtcacgtccacaccctacagtcggagtccgtcggggtcccgcccggacgggaccctacccgggaagggggtaacgggggccgtgggtacggttcggtccgtttctttactttttttaaagtttaagttaggttaggttaggttaacgttaacctaagttacccgtcccgtaacgaacggtccgtcccgggttagggaccgggggtccctacttaccccgactacgtcctaccggagaaacgtactaaaccttacgaaaacgacctacgttcgttactttacctaactaaactacgaaccggacggtaccctagggaacgacgtacgaacgttcggaaaccgtacccgggtccgttaaggttaactttccggnggtacggacggaggttacggacggtacccggaccgttaacgttaaccgtaacgtacgtaacgtacggtacgggttaccggtcgggaaccgggaaccgg

SEQ ID NO: 380985 - DNA, 767 bp, Homo sapiens
  misc_feature: GZ8MTXP01CA0TU.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgcttaattttaaaaggtgcccagtgtgaggtgcagcgtggtggagtcgtggagggaggtcttgactccgaggccggtgggggtccctgacgtactctcctgtcgcagcctcgtcggtcaccgtcacgtcacacctacagtgagcgtcggtcccgcgacggccgtccgggaaggggaacgggcgtagggagtcggtccgttcttttactttttaagtttagttaggttacggttaggtaacgtaacctacgttaccgtccggtaccaacgtaacccgttaccgggtcggggacgggggtaccctactttacccgaacctacgtaccgtacccgaaaggtaacctaaactaaacgttacccgaaaagtaaccttaccggttctttacggttttacaaacaaaagttacgaaaccgacgttccggaagggaacggaccgtaccgtaagccgggaaccctcggggtttaccgttaatacgttaccggtggacgaaggtacggaggttacccgggcgggtaaacccctaacgggttaaaccgtttccgacgttaacgttaacgggtcgggaaacccggttgggaaacccgggggaacccgaacggggtaacccccg

SEQ ID NO: 380986 - DNA, 754 bp, Homo sapiens
  misc_feature: GZ8MTXP01AHUI9.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggtttttccttgttgctattttaaaaggtgccagtgtgaggtgcagctggtggagtctggaggaggcttgatccgagccgtgggggtcctgagctctctgtgcagcctcgtggttcaccgtcagtcacacctacatgagcgtcgggtcccgccgaggcctccgagggggaagggggcctgggagttcggtcgtttaccgtttcttttttaatttacgttaggttaacggttgggttaaacgttaaccacgttaccgttcccgacgtaacggtaaacccgtccgggttcggggaacgggggtcccgtaaacttcccgaaccctactccgtacccgaagaacgtaacctaaacgttacccgaaaacgtaaccgtaacccgtcgtttacgtttaccgttaacctaaaagtcggaaaccacgggtacctggtaaacgcgtaccgaacgtggacccgtaacggtccgttacgttaacgttccgtgtcggaacgtaagggacggtaacggttcggggtaacccccgtaagggttaaccccgtttaacggttaccgtccgttaaagtcggggtaaccggtcggggttaccggggaaccggttaacggggtaacccccgg

SEQ ID NO: 380987 - DNA, 634 bp, Homo sapiens
  misc_feature: GZ8MTXP01EIZEQ.13.76.G10.1.454.CMB.2.raw
  modified_base (298)..(298): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtcgtggaggaggcttgatccagccgtgggggtccctgagactctcctgtgcacgcctcgtgggttccacgtcagtcacacctacatgagcgtgggcccncacggctccgaggggaggggctagggagtgcgtcgtttacttttatttaatagtagttggtagtacataccgtccgctacgaacgtccggtagggacgggggcctatttacccgacactctacccagaacgactaacttacccgaaagaacacgtcttacgtttacttacaaattacggaaacacgaccgttagacgacgccgtacgtcgaaaccgccggtacgtacgttattaacggtgtcggacggaggacgaggtcggggaccccgttaacggttaacggtttaacaccggtaaccttaggacgggttaccgtcgggttccggggaacccggg

SEQ ID NO: 380988 - DNA, 744 bp, Homo sapiens
  misc_feature: GZ8MTXP01EJ99V.13.76.G10.1.454.CMB.2.raw
  modified_base (237)..(237): a, c, t, g, unknown or other
  modified_base (251)..(251): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacgaggtcctgggcccagtctgtactgacgcacgcccgcctgagtggtccgtcgggggccccagggcgaggacggtccaccgatcctccgngcacgtggggaacncacgcctaccaacgtagttcggggccatattaagtcgtatcgtactacgtacggtaaccgacgtactaggtttaccgaggagaccgtacggtacccgtaacgtacctaccttactaactactaaacgtaaacctaaacaaacgtaacgtacccggacccgaacggtaccgggtcccgtacgtaacccgtacttccgttacgtccggccgttcgtaacggtccgtaaccgggtcccgtacccttaccccgacccggtccccccgttacgggttaccaaccggttccacccgggtccggtaccgtaccggtacgggggtaccgtagggaacgggtacgtacgggtcggtaccgttagtttaacccgtttgtttaccgtacggtccctagtaacccttgttacgaacttcgactacggttcgttgttaccggtggttacggtttaaccgggttccgggtaccggggttacccggggtaaccgttccggtaacccgg

SEQ ID NO: 380989 - DNA, 764 bp, Homo sapiens
  misc_feature: GZ8MTXP01CWYZC.13.76.G10.1.454.CMB.2.raw
  modified_base (271)..(271): a, c, t, g, unknown or other
tcagtcacgtactacacgaccggtgctcgatttagtcactcatacagggggcccagcactgggattccgaggtgtttccattcggtgatcagcactgaacacagaggactcaccatggagttttggctgagctgggttttccttgttgctattttaaaaggtgccagtgtgaggtgcagctggtggagtctggaggaggcttgatccgagccgtgggggtccctgagactctcctgtgcagcctcgtggtcaccgtcacgtcacactacangagcgtcggtccgcgacggctaccggaggggaaggggctagggacgtcgtcgttacgtttactttttaagtttagttaaggtaggttaggttaacgtaacgtacttaacccgtcccccggacgtaacggtacccgtacccgggtacggggaaaccgggggtacctaacgtttacccaaccccgtaattcccgttacccgaagggtaacaacccttaaactttaaccccggaaaaggtaaacccgtacggttaccttttaacggtttaaccgttaaacctaaaagttacggaaaccaacggtcccgttaagggaacgacggggaaccccgtagttaccgaaccggtaccgggtaccgttagttacgtacgtggtgaccggagaacgggtaagacccgggggaccctaaaggttaccgttaacgcgacgttacggcgggtaaccggtcggtccggggaacccgaacgggttaccgtaaccgggttcctaaccccg

SEQ ID NO: 380990 - DNA, 610 bp, Homo sapiens
  misc_feature: GZ8MTXP01BLV7E.13.76.G10.1.454.CMB.2.raw
  modified_base (246)..(246): a, c, t, g, unknown or other
  modified_base (521)..(521): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggagggaggcttgatccagccgtgggggtccctgagactctccngtttgcagcctctggtcacgtcagtcacacctacatgagcgtcggtccgccaggcgtaccgaggggaacggggctggagtgcgtctttcttttatttatagtagtacggtataccatactccgcagaacgtccgtggacggggtcattcacctactctccaagacaactaaacttccaaaaggaactaccgttctttacgttactaaagaaataacgaacgacgacggtacgagacgacgacgtacgacgacggtacgtacgttagttacgtcgngaacggaaggaggacggaccggaccgtaacgttaacgttacgttacgtaagtacgtaacgacggtcggacgggtaacggaacggaaccg

SEQ ID NO: 380991 - DNA, 636 bp, Homo sapiens
  misc_feature: GZ8MTXP01BM50B.13.76.G10.1.454.CMB.2.raw
  modified_base (176)..(176): a, c, t, g, unknown or other
  modified_base (235)..(235): a, c, t, g, unknown or other
  modified_base (360)..(360): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacncagccgccctcagtgtctcggggccccagggcagaggtcaccatctcctgcactgggancagctccaacattggggcacattatgatgtacactggtaccagcagtttccagagcacggtcccagacctcctcgactacaactaacgtaaaccaaacaacgtccggcccgaacgacgggtcccngaacccgtattcctcgtacgctaccgaggttctggccctacctcgacgtcccgtcccgtggtccaattccgaacgtcggggtccttcccgggaagggtcccgttacggacggtaagttcggaacggttccgttacggtaattttacgttccgttcgggacccccttaaggttcccttaaagtttccgaaacgaacggtccaacggttccccgttgtaacggtcgtaaccgtttcggggtacggttccgggggaacccgggggttcccgtaaccggg

SEQ ID NO: 380992 - DNA, 750 bp, Homo sapiens
  misc_feature: GZ8MTXP01E43F2.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagtcttgggtttttccttgttgacttaattttaaaaggtgcccagtgtgaggtgcagcgtggtggagtcgtggaggaggcttgatccgaggtccggtgggggtccctggagactctcctgtgcacgtcctgtcgggtcaccggtcacgtccaacacctacagtgacgtcgtacgggtcccgccgtaggcctaccggaagggggacgggcgtggagtcgtcgttctttacttttaattagtaggttacggttaggtacgtaactacgtacctccgaacgtaacggtccgtaccgggtacggggacggggtaccctaacgttacccaaccctacttcccgtaaccgaaagggaacgtaaacctaaacctttaaccgaaaaacggtaacctaccggttacctttacggtttaaccttaaacaaaagtaccggaaactacggacccgtaaaggacggaccgacgtacgtacgggaaccgccggggttaccttagttaacgtttcggtgtacgggaacgaggttacgaaacgggtcccggggaaacccttacggttaaaccgtttaacaccgttaagtcggtacggttaccggttaacgggccggggaacccgg

SEQ ID NO: 380993 - DNA, 687 bp, Homo sapiens
  misc_feature: GZ8MTXP01BM9AQ.13.76.G10.1.454.CMB.2.raw
  modified_base (514)..(514): a, c, t, g, unknown or other
  modified_base (580)..(580): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctatttaaaggtgccagtgtgaggtgcagcgtggtggagtcgtggaggaggtcttgactccgacggccggtcggggggtccctggacgtacctcctcctgtcgcacgtccgtcgttcgggtccaccgtcacgtcacacctacagtggacgcgtcgggtcccgcgacggccgtaccggaaggggaacggggcgtaggagttcgtcgttctttacttttagttagttagttacgtaggtactacctacgtacctccgacgtacgtaaccgtccgggtgggaacgggggtccctagttaccaccgtactctaccgagacgaacctaacgtaccaaagactacgtctttagttacctaaanaagtacgaactcgacggtacgacgaccgacgtagtaccgacggtccggtacgttacgtagttacgnggaggaacgaaggttacggacggttacccggaaccgtaacgttaaccgttcgacgtaacgtgggtaaccggtacggtacgggaccgggtaaccgaacgggtaacccg

SEQ ID NO: 380994 - DNA, 820 bp, Homo sapiens
  misc_feature: GZ8MTXP01EK7FN.13.76.G10.1.454.CMB.2.raw
  modified_base (288)..(288): a, c, t, g, unknown or other
tcagtcacgtactacacgaccggtgctcgatttagtcactcatacaggggtatgggagaggagcccagcactgggattccgaggtgtttccattcggtgatcagcactgaacacagaggactcaccatggagttttggctgagcttgggttttccttgttgtcttaattttaaaaggtgcccagtgtgaggtgcagctgggtggagtcgtggaggaggcttgatccgagccgtgggggtccctgagctctcctgtgcagcctcgtggtcaccgtcacgtcacacctanatgagcgtgggtccccgccgaggcctccggaggggaacggggcgtgggtacgttgtccgtttctttacgtttttaattacgttaaggttaggttaggttaacggtactaacgttcccgtacccgaacgaacggtaacccgttccgggtagggaccgggggtaccctactttaccccgaaccttacttaccctacccgaaaggaataaaccctaaacgtttacccgaaaacgtaacccgtaacgttcctttagtttaacctaaacgttaaaacgtcgaaaccggtcggtaccgttagggaaccgtaccggaaccggtactacgggaacccgtaccgggtaccgttagtttaaccgttagtaaccgggttaggccggtaaaggggacggttaccggggtaacccgggggttaacccccgttaaaacggggttaaaaccccgttttaacccggtaaaccgggtaacccgtttaaacgggggtccggggttaaacccgggtttcccgggggaacccggggggttaaaaaccccggg

SEQ ID NO: 380995 - DNA, 861 bp, Homo sapiens
  misc_feature: GZ8MTXP01B1ACA.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtcctgagactctcctgtgcagcctgtcggtcaccgtcagcacacctacatgagcgtgggtcccgccgaggccgtaccggagggggaacgggggtctaggggtacgttcggtccggttacttttacgtttttaatttaagttaggttaacggtttaggggttaaggttaacctaacgttacccgttcccggaaccgtaacggtaacccggttcccgggtacggggaaccgggggtaccccgtaactttacccgaaccctaacgttaccccgttacccgaaaggtaaccggtaaaccttaaaaccgtttacccgaaaaaacgggtaacccttaaccgggttccttttacgggttttacccttaaaccgtaaaaagtttccgggaaaacctaccgggtacccgttaagggaaagggttaaccccgggaacccgtaaggttaccggaaaccccggtaacccggggttcccggttaaggttaaacgtttccggtaagggtaccgggaccgggtaaaggacgggtaaccggggttacccggggggaccccttaaaacggggttaaccgtttaaacccgtacgggtcgttaacggtggggttaacccggttccgggaaccggggggtaaaccccgg

SEQ ID NO: 380996 - DNA, 640 bp, Homo sapiens
  misc_feature: GZ8MTXP01C7PXC.13.76.G10.1.454.CMB.2.raw
  modified_base (299)..(299): a, c, t, g, unknown or other
  modified_base (336)..(336): a, c, t, g, unknown or other
  modified_base (344)..(344): a, c, t, g, unknown or other
  modified_base (404)..(404): a, c, t, g, unknown or other
  modified_base (450)..(450): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatccagccgtgggggtccctgagactctcctgtgcagcctcgtgggttcaccggtcagtcacaccctacatgagcgtgggtcccnccaggcctccgagggaggggctggagtgtcgtctttnttttattntagtgtgtagtacatactcgcagaaccgtccgtggaggggcccattccacatctccaganacaattccaaagaacacgtcttgtttacttacaaaatggaaaaccncgtcgtagacgacgacgagtcgacgtacggtaccgttagttacttagtggtcggaacggtaaggttacggtacgggttacccggggtaacccgtaaaccggttaaaccgtttaccgaaccggtaacgttaacgggtcgggtaccgggttccggggttaccgggggtaacccggaaaccggggtaaccccg

SEQ ID NO: 380997 - DNA, 665 bp, Homo sapiens
  misc_feature: GZ8MTXP01AV1N8.13.76.G10.1.454.CMB.2.raw
  modified_base (322)..(322): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttcctgttgctattttaaaaggtgcccagtgtgaggtgcagctggtggagtctggaggaggcttgatccagccgtggggggtccctgacgactctcctgtgcagcctgtcggggttcaccgtcagtcacacctacatgagctggtccgcaggctcgagggaggctggatgcgtctntttatatagtagtgtagtaccatactcgacagtaaccgtccggtggacggggtccctaattccgaacctaacttcgtaaaccccaggggaaactaaacgtaaacgttaaccctaaacgggtaaaccaaccggtaacccgttttacgtttaaccgttaacgtaaacgtaacgtaacgacgtacggtacgacgacgacgacgtacgacgacgtacgtacgtacgttacgtcgtgaacgaacggaggtacggttaccgggtaacccggtaaccgttaaccgttacgttaccgtaacgtacgtaacggtacggtacgggttaccgggtaaccgggaacggtaaccgg

SEQ ID NO: 380998 - DNA, 694 bp, Homo sapiens
  misc_feature: GZ8MTXP01ARMG6.13.76.G10.1.454.CMB.2.raw
  modified_base (617)..(617): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgcttattttaaaggtgccagtgtgaggtgcagcgtggtggagtcgtggaggaggcttgatccaggccgtcgggggtccctgacgactctctgtgcacgtcctcgtgggttccaccgtcagtcaacctacctacaagtggacgtcgtaccggggtcccgaccgacggccgtacccgggaaggggggtaaacgggggcgttgggggacgtttcggtccggttttacttttcgtttttttaaatttagttaggtttaggttacggttacggttaactaagtacccgttccgaacccgtaagtcccgtacggtcggggaaccgggggtcctactttccgaacctactccctaccgaaggtaacaacctaactcccgaaaagacctaacgtcgttatttctaaacaaattacgaaacgcgaccgtagcggaacaccgtgacacggccggtcttagtacttacgngtagccggaagttcgagggtccggcccgaacgttacgtaacgtacgtcgtagcggttcggtaacggcggggaacccg

SEQ ID NO: 380999 - DNA, 631 bp, Homo sapiens
  misc_feature: GZ8MTXP01EMX9R.13.76.G10.1.454.CMB.2.raw
  modified_base (293)..(293): a, c, t, g, unknown or other
  modified_base (423)..(423): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtctggaggaggcttgatccagccgtggggggtccctgagactctctgtgcagcctcgtggtcaccgtcagtcacacctacatgagcgtgggtccncaggcctccggagggaacggggctaggagtgtcgttctttcttttagttatagtagtgtagtaccatactccgacagaactccgtggacggggtcctattccaccatctacagacgactaacttccaaanacgacgtctttcgtttactacaaagttcgaaactcggtcctaaggaggacgtacccgaagtacgaaccgtaccggtccgttagtacgtttacgtgtaggccggtaagacgggtaacgttcggggaccctaacggttaaaccgtttacgaccgtgttacggcgggtaacggtccgggttacgggggtaacccgttaaggggtaaccccg

SEQ ID NO: 381000 - DNA, 835 bp, Homo sapiens
  misc_feature: GZ8MTXP01ANSJA.13.76.G10.1.454.CMB.2.raw
  modified_base (663)..(663): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtctggaggaggcttgatccgagccgtggggggtccctgacgactctcctgtgcagcctctagggtcaccgtcagtcacacctacatgagcgtcgggtacccgccgaggcctccggaggggtaacgggggccgtagggtaacgttcgtcgtttctttaccgttttttaagtttagtaagggtttaggttacggggttaaacgttaacccccgtaacttaccgttccccggacccgtaaacgggtaaccccgttccccggggttaagggggaaaccggggggtcccccgtaaagttttcccccgaaacccgttacgtaccccttaaccccgaaggggtaaacccgaaaccttaaacttacccccgaaaaaggtaacccaaccggtttctttacgggtttttacctaccgaaaaaagttcgaaacccgaacgttcccggtaaggacccggaacgaccccggtttaaancggacccggtaaaccgggtccccgtttagggttaaaccctttacgggtcggtcgggaacgtaagggttacggtacgggttacccgggaaacccctaacgggttaaccgttacgaccgtaacgtacggtcgggtaaccggtccggttacggggaaccccgaacgggtaacccg

SEQ ID NO: 381001 - DNA, 788 bp, Homo sapiens
  misc_feature: GZ8MTXP01DKKME.13.76.G10.1.454.CMB.2.raw
  modified_base (287)..(287): a, c, t, g, unknown or other
  modified_base (737)..(737): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagcgtggtggagtcgtggaggaggcttgatccaggccgtgggggtccctgacgactctcctgtgcacgcctcgtgggttccaccgtcagtcacacctanatgacgcgtcgggtcccgcgaggccgtaccggagggggaagggggcgtagggaggtcggtccgtttcttttactttttaagtttagttaggttaggttggtaacgtaacctactaccgtccgacacggtaaccgtccgggtcgggacggggcccgtaacttccgaaccctactacccgtacccgaaagggtaaacctaaacctaaaacgttccccgaaaaagtaacccgtaaccggtttccttttaacggttttaacccttaaacaaaaacgttcggaaaacccgtacggtacccggttaaggggaaacggtacccgtaaccccgggtaaattacccgggaaacccgtaccgggtacccggtttagttaaccgtttaccgtgggtaacggaacgaaagggaggtaccgggttacccggggaacccctaacgttaaccgttcgttaccgtnttaaggcgggtacggtacgggttacggggaacccgttaacggggaaccccg

SEQ ID NO: 381002 - DNA, 764 bp, Homo sapiens
  misc_feature: GZ8MTXP01A55KI.13.76.G10.1.454.CMB.2.raw
  modified_base (243)..(243): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccaggtcctgtactgacgcagccgcctgagtcgtcgtcggggccccagggcagagggccaccgtatctcctgcacgtgggacncacggtcctaccgaacgtagttcggggactactatttagcgtagttcgtactaacgttcgggtaaaccccaggtacctaacggtttacccgaagggtacgtaccgaacggggtccccaaggtaccctacccttagtaaacttacgtaaaacgttaaacggttaaacccaacgaaacggtttccccgggacccgtaaaccgtaccgggggttccccctagggtaaacccgttacgttttaccgccgttacggggtaccccttacccgtaacggggtttaccccgtaccgggtaacccctaccgttaccggtacccgttacccgttacccgttacggtacctacgttacccgtacggtaccgtccgtacggggtagtacggtaggtacgtcgtacggtacgtacgttaacgttacgtttaccgttcgaccgtaccgttaacgtcttaggtacgttacgacgtcgttacgttcgttaggtcgttcgtcggttaccggtacggttcccggggtaaccggcgtcgg

SEQ ID NO: 381003 - DNA, 737 bp, Homo sapiens
  misc_feature: GZ8MTXP01AEKLJ.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaggtgcccagtgtgaggtgcagcgtggtggagtcgtggaggaggtcttgactccgagtccgtcggggggtccctgagtacctctcgtgtgcacgtcctcgtggttcaccgtcacgtcacactacatgagcgtcggtccgccgaggcctaccggaggggacgggcgtgggagtcgtccgttcgtttacttttatttaacgtggttacgttacggtagtacacgttaccctccgacgacgtaaccgtccgggtagggaccgggggccctagttccacctactccctaccgaacggaactaacctaacttacccgaaaagaacccgtacgtcgtttacgtttaccttaaacgaaacgttacggaaacctcggtacccgttaggaaacggaccggacccggagttaccggaaccggtacccgggtcccgtttagttaaacgtttccgtaagggttcggacggtaacgggacggtaacgggttcccgggggaacccccttaaggttaaacccggtttaaccacgggtaactttacgggtccgggttaccgttccgggaacggggaaccccgggg

SEQ ID NO: 381004 - DNA, 524 bp, Homo sapiens
  misc_feature: GZ8MTXP01BW1D8.13.76.G10.1.454.CMB.2.raw
  modified_base (172)..(172): a, c, t, g, unknown or other
  modified_base (400)..(400): a, c, t, g, unknown or other
  modified_base (417)..(417): a, c, t, g, unknown or other
  modified_base (420)..(420): a, c, t, g, unknown or other
  modified_base (425)..(425): a, c, t, g, unknown or other
  modified_base (428)..(428): a, c, t, g, unknown or other
  modified_base (430)..(430): a, c, t, g, unknown or other
  modified_base (432)..(432): a, c, t, g, unknown or other
  modified_base (434)..(434): a, c, t, g, unknown or other
  modified_base (447)..(447): a, c, t, g, unknown or other
  modified_base (470)..(470): a, c, t, g, unknown or other
  modified_base (472)..(472): a, c, t, g, unknown or other
  modified_base (500)..(500): a, c, t, g, unknown or other
  modified_base (504)..(504): a, c, t, g, unknown or other
  modified_base (506)..(506): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtncccagtgtgaggtgcagctggtggagtcgtggaggaggcttgatccagccgtggggggtccctgagactctcctgtgcagcctctgggtcaccgtcagtcacacctacatcgagcgtggtccgcaggctaccgagggaaggggctggatcgcgtcttcttttattatagtagtgtagtaccatactccgatagaaactccgtggagggcattcactatctccagacanaatccgaaagacacgtnttntacanaanananancgagagagacgangacgacgacgtagtatacgtagngngagagagcgacgacgacgttacttacgntagngngtgacgaacgaacgaacg

SEQ ID NO: 381005 - DNA, 781 bp, Homo sapiens
  misc_feature: GZ8MTXP01CZ7XX.13.76.G10.1.454.CMB.2.raw
  modified_base (245)..(245): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgcctcagtgtccgtcggggccccagggcaggagggtccaacctatcctcctgccacgtggggancagcctacaactagttcgggcactattatagtatgtaaccacgtacggtaccagtcctacggtttcccgaagggacgccgtaacggtaccccgtaacgtacctaccttactaactactaaaactaaaccggttaaaaccaaaaccgtaacgttaccccggggacccccggaacccgggtaacccgggggtttccccgttaccggaaaccccgggttaatttccccgtacgtacccgggtcccgtacccggtacgggttcccgtccgggtaccctaccccggttaccaacccgggttcccttaccccggttcggtaccgtaacttaccggaccggttacgggggtaccccttacggggacgggtccgtagggaaccgggtagttcgggaaggtcgttaacggttattttactttcgccggtccttaacggttaaccttacggttaacacgaaaccggtcgttaaccgttcccgttaggtaacgtcgtcggttttcggtacgggtttccgggggaaccccggggttaaccgtaacggg

SEQ ID NO: 381006 - DNA, 783 bp, Homo sapiens
  misc_feature: GZ8MTXP01AWDUK.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtcgtggaggaggcttgatccgacggtccgtgggggtccctgacgtacctctcctgtcgcagcctcgtcgggtcaccgtcacgtcacacctacatgacgcgtcgggtcccgccgaggccgtaccggaggggaacggggcgtgggagtcgcgttctttacttttattagtagttagtggtagtacctatacgtccgcgaacgtaaccgtccggtgggaccgggggtccctactccctacacttccgtaccaagaacgaacctaaacgttacccgaaacgtaaacaccggttacttttacggtttaccttaaacgaaaacgttacggaaacctaggaccccggggttagaaacgggacccgtacccggtagttaccggaaccgtacccgggttaccggtttagttaacgtttaaccggtgggttaacccgggtgggaaacgggttaacgggttaccggggttacccgggggaacccctaaaaccggggttaaaccgttaccgttaccggtaacgtttacgggtaaccgggtaacggggtttcccgggttaccgggggaacccggttaaaacgggggtaaccccccgg

SEQ ID NO: 381007 - DNA, 731 bp, Homo sapiens
  misc_feature: GZ8MTXP01BV343.13.76.G10.1.454.CMB.2.raw
  modified_base (238)..(238): a, c, t, g, unknown or other
  modified_base (254)..(254): a, c, t, g, unknown or other
  modified_base (262)..(262): a, c, t, g, unknown or other
  modified_base (284)..(284): a, c, t, g, unknown or other
  modified_base (302)..(302): a, c, t, g, unknown or other
tcagtcacgtactacacgaccggtgctcgatttagtcactcatacaggggtgggagaggagcccagcactgggattccgaggtgtttccattcggtgatcagcactgaacacagaggactcaccatggagttttggctgagcttgggttttccttgttgctattttaaaaggtgccagtgtgaggtgcagcgtggtggagtctggaggaggcttgactccgagccggtgggggtcccngagactctcctgtgcngccttcgnggttcacgtcagtcacacctanagtgagcgtcgggtcccnccgaaggcctacggaaggggaacgggcgtgggagtcgtccgtttacgtttcttttaaagtttagtaaggttacggtaggttaaacctaccgtaaactacccgtacccgcgtaaaacgggtacccgttcccgggtagggaaccgggggtaccctattacccacctaagttcccaccgtagacgtaaactaaacgttacccgaaagtaaaccgtcgtactttacggtttacttaccgaaaagtcgaaaccgtacggggtaccgtaaggaacgacggaccgtaaacgttcggaaccggtaaccggtccgttagttaaccgttaagccggtaacgacggaggacggttcggtaccggacccgttaacgttaacgttacctaaccggataacggtacgggaccgttcgggaaccgggttaacggtaaaccgggg

SEQ ID NO: 381008 - DNA, 729 bp, Homo sapiens
  misc_feature: GZ8MTXP01EXRLW.13.76.G10.1.454.CMB.2.raw
  modified_base (253)..(253): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgcttattttaaaaggtgcccagtgtgaggtgcagcgtggtggagtcgtggaggaggcttgatccagccgtgggggtccctgagtactctcctgtgcngtcctcgtggtcaccgtcagtcacactacatgagcgtcggtccgccgacggctccggaggggaaggggcgtggacgtgtcgtttctttctttttaatttagtaaggttagtaggggtactacctacttaccgacgtccacgaaccgttcccgggtaagggtacgggggaccctagttcccaacccgtactccctaccgaagtaacggaaacctaaacgttacccgaaacgaaaccgtaccggtccttttagtttaccctaaataaaacgttcggaaaaccgttcgacccggttaagggaaaccgtacgggtaaccccgaagtccggaaccgtaccggggtacctttaggttaacttaaccgtgggaacgcggtaaaggttaggtacggttaccgggcccgtaaacgttaaccggtttacacgggtcaaggtttggggacccgttcgggaccggggtaaccgaacggggtaaccccg

SEQ ID NO: 381009 - DNA, 742 bp, Homo sapiens
  misc_feature: GZ8MTXP01AI4SN.13.76.G10.1.454.CMB.2.raw
  modified_base (292)..(292): a, c, t, g, unknown or other
  modified_base (626)..(626): a, c, t, g, unknown or other
  modified_base (652)..(652): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagcttgggttttccttgttgcttaattttaaaaggtgcccagtgtgaggtgcagctggtggagtcgtggaggaggcttgatccgagccgtggggggtccctgacgactctcgtgtgcacgcctcgtggttccacgtcacgtcacacctacngtgacgtcgtcgggtcccgccgacggccgtacgggaagggggaagggggtcgtagggacggttcgtccgttttcctttacgtttttatttaaggttaggtttacggttagggttacgtactaagttacccgtacccggtaacgaaccggtaacccgttcgggtacggggtacggggtaccctacgtttaccacccgtacttaccacccgaaagggtaaactaaaccttaacgttaacccgaaaacggaaccttacccgggtatttttaccgtttaaacctaactaaagggttaaccaaaccgtcgtccgtaaggacgacgtcgaatcgggaacnccggtcgttattaacgttcgtgggancggacgttagaaccgggtcgggttaacccaacgttacggtaacgtcgtaagttaacggggtcgggttacgttccgggcggggaaaccccg

SEQ ID NO: 381010 - DNA, 745 bp, Homo sapiens
  misc_feature: GZ8MTXP01EZFFR.13.76.G10.1.454.CMB.2.raw
  modified_base (300)..(300): a, c, t, g, unknown or other
  modified_base (610)..(610): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctaattttaaaggtgcccagtgtgaggtgcagcgtggtggagtcgtggaggaggcttgatccaggtccggtcggggggtccctgaggtaccttctcctgtgcgacgccgtcgttcgggttcaccgtcagtccaacacccctanagtaggagtcgtcgggtccccgcgacggccgtaccggaggggagggcgtgggtagttgtgtttccttttgtttttaagtttataaggttaggttaggttagtacctacgtacgtcccggataccgtaacccgtcggtggtaccggggcgtaatccctaccctaacgtcctaaccgagtaagtaactaaaccgttaacgaaacggtactaccggttacttttgtttaacctaacaaagtcggaaaactcgacgggtagacgtaacgaccggtatccggacggtacccggtacgtttagttacgtttacggnggtacggaacggtaaggacggtaccgggttcccgggtaaacccgtaaacgggttaaccgttcgttaaacgtcggttaaccgggttcggggtaccggtacgggggttaccgggtaaacccggaaccgggggaaccc

SEQ ID NO: 381011 - DNA, 598 bp, Homo sapiens
  misc_feature: GZ8MTXP01AIC3X.13.76.G10.1.454.CMB.2.raw
  modified_base (285)..(285): a, c, t, g, unknown or other
  modified_base (460)..(460): a, c, t, g, unknown or other
  modified_base (560)..(560): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagcgtgggtggagtcgtggaggaggcttgatccaggtccgtgggggtccctgagactctcctgtgcagcctcgtgggttcacgtcagtcacacctangtgacgcgtcggccgcgaggcctacggagggacgggctggagtgtcgttctttacttttattagtagtgtgtagtaccatactcgcacgtactccgggtggacgggcctatccgacctactaccgtaccaggaacaactaacgttaccaaacgtaacacgtcttacgtttactanaaactgaacctcgacgtaggagacgtccgagtcgacgaccggtctagtacttacgcgtgcgtaggacgttagcgggtaccctaagttaacgttcgttacncgtagcggacgtcgaccgggggaacttaacggggcccc

SEQ ID NO: 381012 - DNA, 666 bp, Homo sapiens
  misc_feature: GZ8MTXP01CPZIH.13.76.G10.1.454.CMB.2.raw
  modified_base (249)..(249): a, c, t, g, unknown or other
  modified_base (389)..(389): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtctggaggaggcttgatccagccgtgggggtcctgacgactctcctgtgcngcctcgtggttccaccgtcacgtcacacctacatgagcgtcggtcccgcgaggcctccggaggggaggggcgtggagtcgtcgtctttacttttagtttagtagtaggtgtagtacctatactcgcacgaaccttccggnggacgggtcctacttccaccgacttccaccgaagacgaacctaaacgttaccgaaagaacccgtacgtacttttcgtttactaaacgaaagtcgaaacacgtaccgtaggacggacgcccgaagtccgacgtaccgggtccgttagttagtccgtggtcggaacggtaacgacgggtacggccgggggtaaacccctaacgggttaaccggtttaccgacgtaacgttaggcgggtaaccggttcggggacggggtaacccgaaggggtaacccccg

SEQ ID NO: 381013 - DNA, 650 bp, Homo sapiens
  misc_feature: GZ8MTXP01BDAU7.13.76.G10.1.454.CMB.2.raw
  modified_base (473)..(473): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgtctaattttaaaaggtgcccagtgtgaggtgcagctggtggagtctggaggaggcttgatccagccgtgggggtccctgagactctcctgtgcagcctctgggttcaccgtcagtcacacctacatgagctgggccgcaggctaccgagggaaggggctaggagtgtcgtcttctttttaattagtagtagtggtatacatactcgacagaactccgtgacggggccatcacatctccagacgacaacttacgaaagaacacgtcttgtttaccctataaaatgtaaacacggcctagggtaagacgaccgtaanaccgaacgaccgggtaccgttagtaacgtttacgtagtcggaaccgaagggaaggaacggttcgggggtaaccccaaaccgggttaaaacggttaccttaaacggaacccgttaagtaaccggggtcccggtttacgggttaccggggggaacccgttaaaacgggggtaacccccg

SEQ ID NO: 381014 - DNA, 606 bp, Homo sapiens
  misc_feature: GZ8MTXP01DRIJH.13.76.G10.1.454.CMB.2.raw
  modified_base (233)..(233): a, c, t, g, unknown or other
  modified_base (358)..(358): a, c, t, g, unknown or other
  modified_base (433)..(433): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtcccngagactctcctgtgcagcctcgtgggttcaccgtcagtcacacctacatgagctggtccgcgaggctccgagggaggggctggagtgcgtcttcttttattatagtagtggtagtacatactcgnagtaactcgtggagggcgtattcaccatctccagagaacataccaagaacacgcttagttctacaaagtgaaacngccgtagagacgccgaatcgaaccacgggtaccgtagttacttacgtgttacggaagaaggacggagttccgggggaacccctaacgggttaaacccgtttacgttaccggaacctttaaggcgggtaaccggtcggttacggggggaaccgttaaacgggggtaacccccgg

SEQ ID NO: 381015 - DNA, 657 bp, Homo sapiens
  misc_feature: GZ8MTXP01DDKYO.13.76.G10.1.454.CMB.2.raw
  modified_base (290)..(290): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatcagccgtgggggtccctgagactctcctgtgcagcctctgggttcaccgtcagtcacactacatgagcgtggtccncgaggcctccgagggaaggggctcggagtcgcgttctttctttatttattagtagtggtacgtacctatactcgacagaaacccgtcgtgggacggggcctacgttccaccgtatcctacccgagagaactaacttcccgaaagtaaccaacgtctttacggttttaccttacaaacgttacgaaaccgtacgtacccgggttaggaacggaccgtaccggtacgtacgaccgtaccgggtacccgttaggttactttaaccgtggtcggaacgtaggagtaccggttgggggacccacggttaaaccgttccgttacgtccgtagtcgggtaccgtcgggttacgggtccgaacggggtaaccccg

SEQ ID NO: 381016 - DNA, 765 bp, Homo sapiens
  misc_feature: GZ8MTXP01BXEK1.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtctggaggaggcttgatccagccgtgggggtccctgagactctctgtgcagcctcgtgggttcaccgtcagtcacacctacagtgacgcgtcgggtcccgccgacggcctccggaaggggtacggggctgggagtcgtccgttatttcttttaagtttagttagttagtaggtacgtaccattactccgcgagtaacccgttccggtgggacggggtacccgtacttaccaacccgtattacccgtacccgaagaacgaaactaaacgttaacccaaagtaaacccgtacgttacgtttacgtttaccttaacaaaacgttacgaaacgacgtacccggtaaggaacggacggtccccgtaaagttaccggaacccgttaacggggtcccgtttaaggtttaacttaaccggtggtggtaaccgggtaagttacggggtacggttaccccgggggaacccctaaaccgggttaaacccgttacggttaaacccgttaagtaacggtaacccggggtaaacggttccggttaaccgggggtaacccgttaaacgggggtaaccccgg

SEQ ID NO: 381017 - DNA, 484 bp, Homo sapiens
  misc_feature: GZ8MTXP02GH2FS.13.76.G10.1.454.CMB.2.raw
  modified_base (237)..(237): a, c, t, g, unknown or other
  modified_base (481)..(481): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagcccgccctcagtgtctggggccccagggcagagggtcaccatctcctgcactggggancagctccaacattggggcacattatgatgtacactggtaccagcagtttccaggagcaggtcccagactcctcataaatagtaaccaaacaatcgcccgcaacggggtccctgaccgattctctggctccagtctggcacctcagcctccctggtcatcactggctccaggctgagatgagctgattattctgccagtccaatgacagcagcctgagtgcttcggtacttcggcgggggacccngcg

SEQ ID NO: 381018 - DNA, 546 bp, Homo sapiens
  misc_feature: GZ8MTXP02G3B0K.13.76.G10.1.454.CMB.2.raw
  modified_base (337)..(337): a, c, t, g, unknown or other
  modified_base (414)..(414): a, c, t, g, unknown or other
tcagtcacgtactacacgaccggtgctcgatttagtcactcatacagggggagaggagcccagcactgggattccgaggtgtttccattcggtgatcagcactgaacacagaggactcaccatggagttttggctgagcgtgggttttctgttgctattttaaaaggtgcccagtgtgaggtgcagctggtggagtctgggaggaggcttgatccagcctgggggggtccctgagactctcctgtgcagcctctggggttcaccgtcagtcacacctacatgagctgggtccgccaggctccgaggggaaggggctggagtgcgtctcttttattanagtagtggtataccatactcgcagactcgtgagggcggacttcacactctccagagacaatacaaacaacacgactnttcttactaatagaacacgacagagagacgagacgacgacgacgtacgtattactgtgacgagagacgtacggaccgacgtaacgtaacgtacgtaacgtacgtacggtacgtacgtcggacggaacggacg

SEQ ID NO: 381019 - DNA, 478 bp, Homo sapiens
  misc_feature: GZ8MTXP02J1Q20.13.76.G10.1.454.CMB.2.raw
  modified_base (291)..(291): a, c, t, g, unknown or other
  modified_base (328)..(328): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataatggcagataaatatacttcctggtatcagcagaagtcaggccagtcccctgtgctggtcatctatcaagntgccaagcggccctgagggatccccctgagcgattcnctggctccaactctgggaactcagccactctgaccatcagcggaccaggcatgatgagctgactatactgtcaggcgtgggacagcagcactgcccgctatcgtcgttcggaactgggaaccaggtccaccggtccaaggtcagaccccg

SEQ ID NO: 381020 - DNA, 538 bp, Homo sapiens
  misc_feature: GZ8MTXP02J3O5Z.13.76.G10.1.454.CMB.2.raw
  modified_base (315)..(315): a, c, t, g, unknown or other
  modified_base (325)..(325): a, c, t, g, unknown or other
  modified_base (387)..(387): a, c, t, g, unknown or other
  modified_base (408)..(408): a, c, t, g, unknown or other
  modified_base (433)..(433): a, c, t, g, unknown or other
tcagtcacgtactacacgaccggtgctcgatttagtcactcatacagggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtcccgtgagactctcctgtgcagcctctgggttcaccgtcagtcacacctacatgagctgggtccgccaggctccgaggggaggggcnggagtgcgtntctttttattatagtagtggtagtaccatactccgcagactcgtgaggggccatcaccatcnccagagacaattccaagaacncgctgtttctacaaatgaacagccngagagccgatgaccacggccgtgtattactgtgacgagagacgtcggggccccagaaccgttactacgctaagtggacgttcgcgggggacccaaagggaccccg

SEQ ID NO: 381021 - DNA, 552 bp, Homo sapiens
  misc_feature: GZ8MTXP02II807.13.76.G10.1.454.CMB.2.raw
  modified_base (449)..(449): a, c, t, g, unknown or other
  modified_base (524)..(524): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctctgggttcaccgtcagtcacacctacatgagctggggtccccgccgaggcctccgaggggaaggggctgggagtgcgttcttctttttattatagtagtggtagtaccatactccgcagactccgtggaggggccgattccaccatcctccagagacaatccaaagaacacgtcttgtttcttacaaatgaaacngcctgagagccgatcgacacggccgtagtattactgtgcgagagagtcggggacccacgaacgttacacgcgtancggacgtcgtcggggaccaagggacccg

SEQ ID NO: 381022 - DNA, 676 bp, Homo sapiens
  misc_feature: GZ8MTXP02JY0PI.13.76.G10.1.454.CMB.2.raw
  modified_base (250)..(250): a, c, t, g, unknown or other
  modified_base (276)..(276): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcgtggtttcgtgtaggctatttaaaagtgccagtgtgaggtgcagctggtggagtctggaggaggcttgatccagcctggggggtccctgagactctcctgtgcagcctntgggttcaccgtcagtcacaccctanatgagcgtcgggtcccgccgaggcctccggaaggggaacggggcgtgggaggtggtcgttctttacttttatttagttagttagtaggtagtacctactactccgacgacgacgtcgtcggacggggaccggtactaccacctactctacgacgacgaactaactacaaacgaaaccgacgtacttacgtttacttactaaactaacgaaacgacgtacgtacgagacggaccgacgtacgaccgaccggtaccggttacgttacgttacgttacggtacggtacggacggaacggtacgggtaccggggtaacccggtaaccggtaaaccgttaaccgtaaccgtaacgtacggttacggtacggtacgggtaccggggaaccgggaacgggtaaccgg

SEQ ID NO: 381023 - DNA, 579 bp, Homo sapiens
  misc_feature: GZ8MTXP02JALB6.13.76.G10.1.454.CMB.2.raw
  modified_base (294)..(294): a, c, t, g, unknown or other
  modified_base (385)..(385): a, c, t, g, unknown or other
  modified_base (431)..(431): a, c, t, g, unknown or other
  modified_base (473)..(473): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggggttcaccgtcagtcacacctacatgagctgggtcccnccaggctccgaggggaggggctggagtgcgtcttcttttattatagtagtggtataccatactcgcagactcgtgaggggcattcacatcncagagaacaatccaaagaacacgctgtttactacaaaatgaaaccngctagagacgaccgatacgacgaccggtctagttacttacgngtcggacgagaggacggtccggggaacccctaacggtaaaccgttacgacgtaacgttacggtacgggaccggttccggacgggggaacccgaaacggggtacccg

SEQ ID NO: 381024 - DNA, 545 bp, Homo sapiens
  misc_feature: GZ8MTXP02JPCEA.13.76.G10.1.454.CMB.2.raw
  modified_base (362)..(362): a, c, t, g, unknown or other
  modified_base (383)..(383): a, c, t, g, unknown or other
  modified_base (418)..(418): a, c, t, g, unknown or other
  modified_base (435)..(435): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagcgtggtttctgtgctatttaaagtgccagtgtgaggtgcagctggtggagtctggaggaggcttgatccagccgtgggggtccctgagactctcctgtgcagcctctgggttcaccgtcagtcacacctacatgagctgggtccgccaggcctccgaggggagggctggagtgcgtcttcttttatttatagtagtggtagtacatactcgcagctccgngacggggcatcaccatctcanagacatcaagacacgctgttctacaaatgaaaccncgctagacgacgacganacgacgacggtcgttagtacgttacgtgtcgacggagtacgacggtaccgggaccctaacggtaacgttaacgtacgtacgtacggtacggtacggtcggacgggtaccg

SEQ ID NO: 381025 - DNA, 629 bp, Homo sapiens
  misc_feature: GZ8MTXP02HX7SW.13.76.G10.1.454.CMB.2.raw
  modified_base (196)..(196): a, c, t, g, unknown or other
  modified_base (205)..(205): a, c, t, g, unknown or other
  modified_base (209)..(209): a, c, t, g, unknown or other
tcagtcacgtactacacgaccggtgctcgatttagtcactcatacagggggagaggagcccagcactgggattccgaggtgtttccattcggtgatcagcactgaacacagaggactcaccatggagtttttggctgagcgtggttttcgtgtagcgtatttaaaagtgccagtgtgaggtgcagctggtggagtntggagaggntgancagcggtggggtccgtgagactctcgtgtgcgcgcctcgtcggttcgaccgtcacgtacaccacctacatgagcgtcggtccgccgacggcgtaccggagggagggcggtaggaggtgtcgttcgtttacttttatttagttaagttaggtaggtagtacctactaccgtaccgacgacgtacgtcggtcggacgggacgtacgtactacctactactaccacgaacgaactaactaacaaacgaacgacgtacgttacgtttacttaactaaactaacgaaacgacgacgtagagacgacgagtacgacgacggtaccgtacgttagttacgtgtgacgagagacggtacggaccgaacgtaaccgttaacgtacgtaacgtacgtacggtacggtacggtacggaccggaacggaacg

SEQ ID NO: 381026 - DNA, 524 bp, Homo sapiens
  misc_feature: GZ8MTXP02GPWSX.13.76.G10.1.454.CMB.2.raw
  modified_base (384)..(384): a, c, t, g, unknown or other
  modified_base (428)..(428): a, c, t, g, unknown or other
  modified_base (438)..(438): a, c, t, g, unknown or other
  modified_base (460)..(460): a, c, t, g, unknown or other
tcagtcacgtactacacgaccggtgctcgatttagtcactcatacagggggagaggagcccagcactgggattccgaggtgtttccattcggtgatcagcactgaacacagaggactaaccatggagttttggctgagcgtggtttcgtgttaggctatttaaaggtgccagtgtgaggtgcagctggtggagtctggaggaggcttgatccagcctggggggtccctgagactctcctgtgcagcctctggggttcaccgtcagtcacacctacatgagctgggccgccaggctccaggggaaggggctggagtgcgtcttcttttatttatagtagtggtagtacatactccgcagactccgtgaggggccattcaccatcnccagagacaattccaagaacacgctgttctacaaatgacagccngagagccgangacgacgccgtgtattatgtgngagagagcggaccgacgtacgtacgtacgacgtaagtcgtacgtcgtcggacggacggacgacg

SEQ ID NO: 381027 - DNA, 543 bp, Homo sapiens
  misc_feature: GZ8MTXP02GQF2G.13.76.G10.1.454.CMB.2.raw
  modified_base (296)..(296): a, c, t, g, unknown or other
  modified_base (391)..(391): a, c, t, g, unknown or other
  modified_base (435)..(435): a, c, t, g, unknown or other
tcagtcacgtactacacgaccggtgctcgatttagtcactcatacagggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctctggggttcaccgtcagtcacacctacatgagctggggtcccnccaggctccgaggggaaggggctggagtgcgtctcttttattatagtagtggtagtaccatactccgcagactcgtgaggggccattcaccatcnccagagacaattccaaagaacacgcttgttcttcaaatgaaacngcctgagagccgaatgacacggccgtagtattactgtgcgagagagtcgggggcccaacgaacgttactaacgctagtcggacgtcgtcgggggaccaacggggaccc

SEQ ID NO: 381028 - DNA, 501 bp, Homo sapiens
  misc_feature: GZ8MTXP02HAZIB.13.76.G10.1.454.CMB.2.raw
  modified_base (334)..(334): a, c, t, g, unknown or other
  modified_base (388)..(388): a, c, t, g, unknown or other
  modified_base (406)..(406): a, c, t, g, unknown or other
  modified_base (422)..(422): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagccggccctcaggggatcccccctgacgcgattcnctggctccaactctgggaactcagccactctgaccatcagcggacccaggctangatgaggctgactatacngtcgaggcgtgggacngacagcacgcgccgtctagtcgtcgtacggacgtcggaaccgtacggtaccgtaccgtaccgtaacgtccgacgacccg

SEQ ID NO: 381029 - DNA, 593 bp, Homo sapiens
  misc_feature: GZ8MTXP02GAXEH.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtgggtcccgccgaggctccgaggggaaggggctggagtgcgtcttcttttattatagtagtggtataccatactccgcagacctccgtggacggggccgattccaccatctccagagacaatccaaagaacacgtcttgtttctacaaatgaaactagcctagagagccgatcgacgacggccttagtattacgtgtgacgagaggacgtcgggggacccctaaacggtaaaccgtttactaaccggaacttaacggtcggggtaaccgttcggtacgggggacccgaaaacgggggtaacccccg

SEQ ID NO: 381030 - DNA, 542 bp, Homo sapiens
  misc_feature: GZ8MTXP02JBPWY.13.76.G10.1.454.CMB.2.raw
  modified_base (296)..(296): a, c, t, g, unknown or other
  modified_base (362)..(362): a, c, t, g, unknown or other
  modified_base (391)..(391): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcgtggttttcgtgtaggctatttaaaagtgccagtgtgaggtgcagctggtggagtctggaggaggcttgatccagcctggggggtccctgagactctcctgtgcagctctgggttcaccgtcagtcacacctacatgagctgggtccgccaggcnccagggaaggggcgtggagtgcggtctcttttatttatagtagtggtagtaccatactcgcagacncgtgagggcggattcaccatctccagaanacactacaacaacacgtcttcgtttacttactaaatacgaacacgacgtagagacgacgacgtacgacgacggcgtcgtattagtgtgcgagagacgcggaccgacgacgtacgtacgaacgtacgtacggcgtcgtcggacggacggacg

SEQ ID NO: 381031 - DNA, 480 bp, Homo sapiens
  misc_feature: GZ8MTXP02JGYVZ.13.76.G10.1.454.CMB.2.raw
  modified_base (307)..(307): a, c, t, g, unknown or other
  modified_base (394)..(394): a, c, t, g, unknown or other
  modified_base (434)..(434): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttcctggtatcagcagaagtcaggccagtcccctgtgctggtcatctatcaagatgccaagcggccctnagggatccccctgagcgattctctggctccaactctgggaactcagcccactctgaccatcagcggacccaggctatcggatgaggntgactattactgtcaggcgtgggacagcagcactgcccgntatcgtcttcggaactggaacaaggtcacgtctaacgtcagacccg

SEQ ID NO: 381032 - DNA, 523 bp, Homo sapiens
  misc_feature: GZ8MTXP02JOESX.13.76.G10.1.454.CMB.2.raw
  modified_base (365)..(365): a, c, t, g, unknown or other
tcagtcacgtactacacgaccggtgctcgatttagtcactcatacaggggcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctgggggtacctgagactctcctgtgcagcctctgggttcaccgtcagtcacacctacatgagctgggtccgccaggctccgagggagggctggagtgcgtctctttattatagtagtggtagtacatactcccgcagactccgtgaggggccgnttcacatctccagagacaattccaagacacgctgttctcaaatgaacagcctgagagccgatgacacggccgtgtattactgtgcgagagagtcggggcccacggaacgttactacgctagtggaacgtcgtcggggaccaagggccacggtcacccg

SEQ ID NO: 381033 - DNA, 544 bp, Homo sapiens
  misc_feature: GZ8MTXP02JTH7W.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgaggggaggggctggagtgcgtcttcttttattatagtagtggtagtacatactccgcagactcgtggaggggccgattcaccatctccagagacaattcccaaagaacacgctgtttctacaaatgaaacacgcctgagagccgatcgaccgacggccgtgtattacgtgtgcgagagacgtcggggacccacgaacgttacacgcgtagtcgggactcgtacggggaccgaagggacccg

SEQ ID NO: 381034 - DNA, 525 bp, Homo sapiens
  misc_feature: GZ8MTXP02IV7BV.13.76.G10.1.454.CMB.2.raw
  modified_base (292)..(292): a, c, t, g, unknown or other
  modified_base (388)..(388): a, c, t, g, unknown or other
  modified_base (458)..(458): a, c, t, g, unknown or other
tcagtcacgtactacacgaccggtgctcgatttagtcactcatacagggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggggttcaccgtcagtcacacctacatgagctgggtccnccaggctccgagggaaggggctggagtgcgtctctttattatagtagtgtagtaccatactcgcagactcgtgagggccattcaccatctccaganacaattccaagaacacgctgttctacaaatgaacagcctgagagccgatcgacacggccgtgtattacgngtgcgagagagtcggggacccacgaacgtactacgctagtggacgtcgtcggggaccgaaggacccg

SEQ ID NO: 381035 - DNA, 487 bp, Homo sapiens
  misc_feature: GZ8MTXP02G1DWQ.13.76.G10.1.454.CMB.2.raw
  modified_base (236)..(236): a, c, t, g, unknown or other
  modified_base (304)..(304): a, c, t, g, unknown or other
  modified_base (314)..(314): a, c, t, g, unknown or other
  modified_base (324)..(324): a, c, t, g, unknown or other
  modified_base (402)..(402): a, c, t, g, unknown or other
  modified_base (417)..(417): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataatggcagataaatntacttctggtatcagcagaagtcaggccagtcccctgtgctggtcatctatcaagatgcaagcgcctnaggatccccngagcgattcnctggctccgaatctgggaactcacgccactctgacccatcagcggacccaggcaagtgaatgaggctgactattacgngtcaggcgtgggacngcagcgactgcccgtctacgtcgtcgtacgacgtacggaacgtacgtaccaccgtactacgcgacgaccg

SEQ ID NO: 381036 - DNA, 533 bp, Homo sapiens
  misc_feature: GZ8MTXP02GHNHF.13.76.G10.1.454.CMB.2.raw
  modified_base (465)..(465): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccatcagtcacacctacatgagctgggtccgccaggctccgagggaaggggctggagtgcgtctcttttattatagtagtggtagtacatactccgcagactccgtgagggggccattccaccatcctccagagacaattccaaagaacacgctgttctacaaatgaaacagcctgagagccgatgacacggccgtgtattacngtgcgagagagtcggggacccaacgaacgttacaacgctagtcggacgtcgtcggggaccaaacgggg

SEQ ID NO: 381037 - DNA, 549 bp, Homo sapiens
  misc_feature: GZ8MTXP02IK72H.13.76.G10.1.454.CMB.2.raw
  modified_base (361)..(361): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggttcaccgtcagtcacacctacatgagctgggtccgccaggctccgaggggaaggggctggagtgcgtctcttttattatagtagtggtagtacatactcgnagactcgtgaggggccattcaccatctcagagacaattccaaagaacacgtcttgtttctacaaatgaaacagcctagagacgccgatacgaccacggccgtgtattacgtgtgcgagagacgtcgggggcccaacggtaacgttacacgcgtaagtcgggaccgtcgtcggggaccaacgggacccg

SEQ ID NO: 381038 - DNA, 530 bp, Homo sapiens
  misc_feature: GZ8MTXP02HL4DZ.13.76.G10.1.454.CMB.2.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttctggtatcagcagaagtcaggccagtcccctgtgctggtcatctatcaagatgccaagcgccctcgagggactcccccgtgacgcgattctcgtggcctccaacttcgtacgggaacctcacgcccacgtcctacgaccatcaggccgggacccaggctagtcggatggaggcttaggacttagttactgtcgaggcggtgggacaggcagcacgtcgcccgctacgtcgtccgttacggaacgtcgggaaccgtaacggtccaccggtactaacgtccgacgaaccccg

SEQ ID NO: 381039 - DNA, 530 bp, Homo sapiens
  misc_feature: GZ8MTXP02GXVHM.13.76.G10.1.454.CMB.2.raw
  modified_base (328)..(328): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggtttccttgttgctattttaaaaggtgcccagtgtgaggtgcagctggtggagtctggaggaggcttgatccagccgtgggggtccctgagactctcctgtgcagcctctgggttcaccgtcagtcacacctacatgagctgggtccgccaggctccgaggggaaggggctggagtgcgtnttctttattatagtagtggtagtacatactccgcagctccgtgaggggccattcacatctccagagacatccaagacacgctgttctcaaatgaacagctagagagccgatgacagtcggccgtgtaacttactgtgacgaggacgagttcggggaccccaagtaaaccgtttacgacgacgtatcggacgttcggacgggg

SEQ ID NO: 381040 - DNA, 561 bp, Homo sapiens
  misc_feature: GZ8MTXP02IR1BT.13.76.G10.1.454.CMB.2.raw
  modified_base (454)..(454): a, c, t, g, unknown or other
  modified_base (473)..(473): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctgggggtccctgagactctcctgtgcagcctctgggttcaccgtcagtcacacctacatgagctgggtccgccaggctccgagggagggctggagtgcgtcttcttttattatagtagtggtagtacatactccgcagacctccgtggacggggccgattccaccatcctccagagactaatccaaagaacacgtcttgtttctacaaatgaaacagcctaggagacgcgaangacacggccgtgtattacngtgacgagtaggacgtcgggggaccctacggtaaaccttcgtaacgctaagtcggaccgttcgtcggggaaccgaacggggaaccccg

SEQ ID NO: 381041 - DNA, 497 bp, Homo sapiens
  misc_feature: GZ8MTXP02JY3OS.13.76.G10.1.454.CMB.2.raw
  modified_base (331)..(331): a, c, t, g, unknown or other
  modified_base (436)..(436): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttcctggtatcagcagaagtcaggccagtcccctgtgctggtcatctatcaagatgccaagcggccctgagggactcccccgtgagcgattcnctgggcctccaactctagggaactcgagcccactctgaccatcagcggacccaggctatggatgagctgactatactgtcaggcgtggacagcagcactgcccgntactcgtacgtcggaacgtcgggaaccctaaggtccaaccggtcctaacgtcacgaccccg

SEQ ID NO: 381042 - DNA, 540 bp, Homo sapiens
  misc_feature: GZ8MTXP02F1PCX.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggttcaccgtcagtcacacctacatgagctggggtccgccaggctccgagggaaggggctggagtgcgtctcttttatttatagtagtgtagtaccatactcgcagactcgtgaggggccattcaccatctccagagacaattccaaagaacacgcttgtttcttcaaaatgaaacagcctagagagacccgatgacacggccgtgtattactgtgcgagagagtgggggacccacgaaacgttctaacgctagtggacgtctagggggccaaggggacccg

SEQ ID NO: 381043 - DNA, 538 bp, Homo sapiens
  misc_feature: GZ8MTXP02HAPYV.13.76.G10.1.454.CMB.2.raw
  modified_base (431)..(431): a, c, t, g, unknown or other
  modified_base (439)..(439): a, c, t, g, unknown or other
  modified_base (468)..(468): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctggggttttccttgttgctattttaaaaggtgcccagtgtgaggtgcagctggtggagtctggaggaggcttgatccagcctggggggtccctgagactctcctgtgcagcctctggggttcaccgtcagtcacacctacatgagctgggtccgccaggctccgagggaggggctggagtgcgtctcttttattatagtagtggtagtacatactcgcagactcgtgaggggccattcacatctcccagagacaattccaaagaaccacgctgtttctacaaatgaaacngcctgagngaccgatcgacacggccgtagtacttacngtcgcgagtagacgtcggggcccaacgaaccgttacacgctagcggtacgtcgcgggaccaagggacccg

SEQ ID NO: 381044 - DNA, 563 bp, Homo sapiens
  misc_feature: GZ8MTXP02H8J5C.13.76.G10.1.454.CMB.2.raw
  modified_base (192)..(192): a, c, t, g, unknown or other
  modified_base (292)..(292): a, c, t, g, unknown or other
  modified_base (377)..(377): a, c, t, g, unknown or other
  modified_base (395)..(395): a, c, t, g, unknown or other
  modified_base (402)..(402): a, c, t, g, unknown or other
  modified_base (408)..(408): a, c, t, g, unknown or other
  modified_base (420)..(420): a, c, t, g, unknown or other
  modified_base (423)..(423): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcgtggtttctgtagctatttaaagtgccagtgtgaggtgcagctggtggagtntgggaggaggcttgatccagccgtggggggtccctgagactctcctgtgcagctctggttcaccgtcagtcacacctacatgagctgggtccgccaggcnccgagggaaggggcgtggagtgcggtctcttttatttatagtagtggtagtacatactcgcagactcgtgagggcggattcacanctccagagacattacaanaacaacncctttnttctactaatanaanacgacagagacgacgacgacgacgacggtacgtacgttagttacgtagtagacggaggaggacggtacgggaccgaaccgtaaccgttaacgtacgtaacgtacgtacggtacggtacggtacgggacggaacggaccgg

SEQ ID NO: 381045 - DNA, 583 bp, Homo sapiens
  misc_feature: GZ8MTXP02FMTGT.13.76.G10.1.454.CMB.2.raw
  modified_base (517)..(517): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgctattttagaaggtgtccagtgtgaggtgcagctggtggagtcgtgggggaggcttggtccaggccgtggggggtccctgagactctcctgtgcagcctctggattcacctttagtagctattggatgagctgggtccgcaggctccgaggggaaggggctggagtgggtggccaaacataaagcaaagttggaaagtgaagaaatactaatgtaggacttctggtggaaaggggccgtaattccaccattcctacccaaggaacgacaaacggccctaaaagaaacctcaacttgtactacctgaaccaaaatgaaaccagccctaggagacgccgaggaccagggctgtctaattacnggtgcgtaagagtacgtttgggggacggtaaaggtaagacggacgaggtcggactacgttactacg

SEQ ID NO: 381046 - DNA, 544 bp, Homo sapiens
  misc_feature: GZ8MTXP02HVMLL.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtcccgccaggctccgaggggaaggggctggagtgcgtcttcttttatttatagtagtggtagtaccatactccgcagactcgtgaggggccattccaccatctccagagacaattccaagaacacgctgtttcttcaaatgaaacagcctgagagaccgatgacacggccgtagtattactgtgcgagagagtcggggacccacgaacgttactacggctaagtcggacgtcgtacgggggaccaagggaacccg

SEQ ID NO: 381047 - DNA, 494 bp, Homo sapiens
  misc_feature: GZ8MTXP02GS3WX.13.76.G10.1.454.CMB.2.raw
  modified_base (306)..(306): a, c, t, g, unknown or other
  modified_base (406)..(406): a, c, t, g, unknown or other
  modified_base (423)..(423): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttcctggtatcagcagaagtcaggccagtcccctgtgctggtcatctatcaagatgccaagcggcctnagggatccccctgagcgattctctggcctccaactctgggaacctcagccactctcgaccatcagcggacccaggctagtggatgaggctgactattacngtacgaggcgtgggacnggcagcactcgccgctagcgtcgttacggaactggggaaccaaggtccacggtcctaagtccacgaccccg

SEQ ID NO: 381048 - DNA, 546 bp, Homo sapiens
  misc_feature: GZ8MTXP02FSHMV.13.76.G10.1.454.CMB.2.raw
  modified_base (266)..(266): a, c, t, g, unknown or other
  modified_base (293)..(293): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggtcaccgtnagtcacacctacatgagctgggtcccnccaggcctccgaggggaggggctggagtgcgtctcttttatttatagtagtggtagtaccatactcgcagacctccgtggaggggccattcaccatctcagagacaataccaagaacacgctgtttacttcaaatgaaacagcctagagagccgatcgacacggctagtattacgtgtgcgagagacgtcggggacccacgtaacgttactacggctagtcggacgtcgtacgggggaccaacgggggacccg

SEQ ID NO: 381049 - DNA, 535 bp, Homo sapiens
  misc_feature: GZ8MTXP02HGR59.13.76.G10.1.454.CMB.2.raw
  modified_base (415)..(415): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggcagataaatatacttcctggtatcagcagaagtcaggccagtcccctgtgctggtcatctatcaagatgccaagcggccctgagggactccccctgacgcgattctctgggcctccaaactcgtgggaacacagcccactctcgacatcagcggacccagccctatcggatgaggctagtactattacngtacattacagtagggaacaaacgtataagttacggattgggccttaggttcgggcggtaacgggaaccctaaaacgtcgtaaccgtccgtaacggtccgaacggccccgtaaggtcccg

SEQ ID NO: 381050 - DNA, 518 bp, Homo sapiens
  misc_feature: GZ8MTXP02HRZ8U.13.76.G10.1.454.CMB.2.raw
  modified_base (236)..(236): a, c, t, g, unknown or other
  modified_base (419)..(419): a, c, t, g, unknown or other
  modified_base (437)..(437): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggcagataaatntacttctggtatcagcagaagtcaggccagtcccctgtgctggtcatctatcaagatgccaagccggccctcgagggactccccctgacgcgattctctgggcctaccaaacttcgtacgggaactcgagcccactctgaccatcgacgcggacccaggctagcggatgagctgactattacngtacgaggcgtagggacngacagcacgtcgccgtctagtcgtacttcggaacgtgggaaacccgtaggtacccgaccgtactaacgccgacgaaccccg

SEQ ID NO: 381051 - DNA, 484 bp, Homo sapiens
  misc_feature: GZ8MTXP02HQ9VN.13.76.G10.1.454.CMB.2.raw
  modified_base (403)..(403): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggcctcagggatcccccgtgagcgattctctggctccaactctgggaactcagccactctgaccatcagcggacccaggctatgatgaggctgactattacngtcaggcgtggcagcagcacgtcgcccgctagtcgtctcggaactgggaaccaagggtcaccgtctaacgtcacgaccccg

SEQ ID NO: 381052 - DNA, 508 bp, Homo sapiens
  misc_feature: GZ8MTXP02G4N6J.13.76.G10.1.454.CMB.2.raw
  modified_base (235)..(235): a, c, t, g, unknown or other
  modified_base (463)..(463): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatntacttcctggtatcagcagaagtcaggccagtcccctgtgctggtcatctatcaagatgccaagccggccctcgagggactccccccgtgagcgattctcgtggccttccaaacttcgtacggggaaccttcgagcccactctacgacccatcacgcgggaccccaggcctagtgggatggaggtctggactattacgtgtcgaggcgtgggacagcagcactgcccntatcgtctcggaactggaaccaggtcacgtctaacgtcacgaccc

SEQ ID NO: 381053 - DNA, 535 bp, Homo sapiens
  misc_feature: GZ8MTXP02F6HMD.13.76.G10.1.454.CMB.2.raw
tcagtcacgtactacacgaccggtgctcgatttagtcactcatacagggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggggtcaccgtcagtcacacctacatgagctggggtcccgccaggctccgaggggaaggggctggagtgcgtctcttttatttatagtagtggtagtaccatactcgcagactccgtgaggggccattcaccatctccagagacaatccaagaacacgctgttctcaaatgaaacagcctgagagaccgatcgacacggccgtgtatactgtgcgagagacgtcggggacccacgaacgttactacgctagtacggacgtcgtcggggaccaaggggacccg

SEQ ID NO: 381054 - DNA, 593 bp, Homo sapiens
  misc_feature: GZ8MTXP02GW0L3.13.76.G10.1.454.CMB.2.raw
  modified_base (401)..(401): a, c, t, g, unknown or other
  modified_base (444)..(444): a, c, t, g, unknown or other
  modified_base (458)..(458): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgaggggaggggctggagtgcgtctctttttattatagtagtggtagtaccatactccgcagacctccgtggacggggccattccaccatcctccaaganaacaacttccaaagaaccacgctgtttctacaaatgaaaaccngctagagacgcgancgacgacggtcgtagttattacgtggtacgacggaaggaggtacggtaccggggaaccctaaacggtaaaccgttacgacgtaacgtacggtacgggaccgttcgggtacgggggaacccgaaacggggtacccg

SEQ ID NO: 381055 - DNA, 490 bp, Homo sapiens
  misc_feature: GZ8MTXP02GE739.13.76.G10.1.454.CMB.2.raw
  modified_base (236)..(236): a, c, t, g, unknown or other
  modified_base (356)..(356): a, c, t, g, unknown or other
  modified_base (429)..(429): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactggggancagctccaacattggggcacattatgatgtacactggtaccagcagtttccaggagcaggtcccagactcctcatcaatacgtaacaacaatcggcccgcaggggtccctgaccgattcnctggctccagtctggcaccgtcagcctccctggtcatcactgggctcaggctgaggatgaggctgattattcngccagtcctatcgacacgcacgcctgaagtcgcttcggtagttcgggcgggggtaccacgg

SEQ ID NO: 381056 - DNA, 578 bp, Homo sapiens
  misc_feature: GZ8MTXP02JTVUA.13.76.G10.1.454.CMB.2.raw
  modified_base (255)..(255): a, c, t, g, unknown or other
  modified_base (260)..(261): a, c, t, g, unknown or other
  modified_base (263)..(263): a, c, t, g, unknown or other
  modified_base (268)..(270): a, c, t, g, unknown or other
  modified_base (272)..(272): a, c, t, g, unknown or other
  modified_base (280)..(280): a, c, t, g, unknown or other
  modified_base (283)..(283): a, c, t, g, unknown or other
  modified_base (292)..(292): a, c, t, g, unknown or other
  modified_base (294)..(294): a, c, t, g, unknown or other
  modified_base (297)..(297): a, c, t, g, unknown or other
  modified_base (299)..(299): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagcgtggtttcgtgtagctatttaaagtgccagtgtgaggtgcagctggtggagtctggaggaggcttgatccagcctggggggtccctgagactctcctgtgcagctctggttncgtcnncncacannngngtggcgcngcncgaggaggngnggngngcgtcttctttatttatagtagtgtagtactatactcgcacgcgtccgtcggacggggccgactcaccactctaccacgacgaactaactaccaacgaacacgtacttacgtttacttactaaatagaacacgacgtagacgacgaccgacgtacgacgaccggtaccgtacgttacgttacgttacggtacggacggtacggaggacggtacggggacccggtaaccggtaaccgttaacgtacgtacgtacgtacggtacggtacggtacgggacgg

SEQ ID NO: 381057 - DNA, 569 bp, Homo sapiens
  misc_feature: GZ8MTXP02HII4J.13.76.G10.1.454.CMB.2.raw
  modified_base (294)..(294): a, c, t, g, unknown or other
  modified_base (363)..(363): a, c, t, g, unknown or other
  modified_base (437)..(437): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctcgggttcaccgtcagtcacacctacatgagctgggtccnccgaggcctccgagggaaggggctggagtgcgtcttcttttattatagtagtggtagtacatactccgnagactcgtgaggggccgattccaccatctccagagacaatccaaagaaccacgcctgtttctacaaatgaaacngacctgagacgccgatgacgacggccgtagtattacgtgtgacgagagagtcgggggaccctaacggtaaccgttacgtacgaacctaagttcgggaccgttcggtacgggggacccaaagggggacccccg

SEQ ID NO: 381058 - DNA, 555 bp, Homo sapiens
  misc_feature: GZ8MTXP02HDS1B.13.76.G10.1.454.CMB.2.raw
  modified_base (435)..(435): a, c, t, g, unknown or other
tcagtcacgtactacacgaccggtgctcgatttagtcactcatacaggggggagaggagcccagcactgggattccgaggtgtttccattcggtgatcagcactgaacacagaggactcacccatggagttttggctgagctgggttttccttgttgctattttaaaaggtgcccagtgtgaggtgcagctggtggagtctgggaggaggcttgatccagcctggggggtccctgagactctcctgtgcagcctctggggttcaccgtcagtcacacctacatagggggctggggtccgccaggctccgaggggaggggctggagtgcgtctcttttattatagtagtggtagtaccatactccgcagactccgtgacggggccgattcaccatctccagagacaatccaagacacgctgtttctcaaatgaacngcctgagagccgatcgacacggccgtgtattactgtgcgagagacgtcgggggaccccaacggtaaccggttacaacggctaagtcgggaactcggtacgggggcccaaaggggaccccg

SEQ ID NO: 381059 - DNA, 510 bp, Homo sapiens
  misc_feature: GZ8MTXP02G03BP.13.76.G10.1.454.CMB.2.raw
  modified_base (234)..(234): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagaggtcaccatctcctgcactgggancagctccaacattggggcacattatgatgtacactggtaccagcagtttccaggagcaggtcccagactcctcatcaatacgtaacaacaatcggacccgcacggggtccctgaccgattctctggctccagtctggcacctcacgccctccctacggtcatccactgggcctccgacggctgacggatggagcgtgtagttattcgtgtccgtacgtcctatcgacagcacgcctgaagtcgtcgttcggtacgttcgggcgggggaccctacgg

SEQ ID NO: 381060 - DNA, 530 bp, Homo sapiens
  misc_feature: GZ8MTXP02GIZA9.13.76.G10.1.454.CMB.2.raw
  modified_base (364)..(364): a, c, t, g, unknown or other
  modified_base (392)..(392): a, c, t, g, unknown or other
  modified_base (417)..(417): a, c, t, g, unknown or other
  modified_base (420)..(420): a, c, t, g, unknown or other
  modified_base (426)..(426): a, c, t, g, unknown or other
  modified_base (465)..(465): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagcgtggtttctgtgctatttaaagtgccagtgtgaggtgcagctggtggagtctggaggaggcttgatccagccgtgggggtccctgagactctcctgtgcagcctctgggttcaccgtcagtcacacctacatgagctgggtccgccagggcctccgaggggaggggctggagtgcgtcttcttttattagtagtagtggtatacatactcgcagctccgnggacggggcctatcacctatcctcaganacatccaaagacagtctgttctaanaancacacncgagagagacgagagacgacgcgtagtagtacgtcgtgngacgagacggacggaccgacgtacgtaacgtacgtacgtacgtacggtacggtacggtacggacg

SEQ ID NO: 381061 - DNA, 621 bp, Homo sapiens
  misc_feature: GZ8MTXP02FTMTT.13.76.G10.1.454.CMB.2.raw
  modified_base (245)..(245): a, c, t, g, unknown or other
  modified_base (257)..(257): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcgtggtttctgtaggctatttaaaagtgccagtgtgaggtgcagctggtggagtctggaggaggcttgatccagccgtggggggtccctgagactctcctgtgcncgctcgtggtcncgtcagtcacactacatgagcgtcggtccgccgacggcgccggacggggacggggcgtggagtgtcgttcttactttatttagttagtagtaggtagtactactaccgtacgacgacgtacgtccggtcgggacggggacgtactacctacctactcctacacgaacgaactaactaaccaaacgaacgacgtacttacgtttacttaactaaactaacgaacgacgacgtacgagacgacgacgtacgacgacggtacgtacgtagttacgtgtgacggaggaggtacggtacgggaccggtaccgtaaccgtaacgtacgtaacgtacgtacggtacggtcggtacgggaccggacggaccg

SEQ ID NO: 381062 - DNA, 636 bp, Homo sapiens
  misc_feature: GZ8MTXP02GN9P8.13.76.G10.1.454.CMB.2.raw
  modified_base (319)..(319): a, c, t, g, unknown or other
  modified_base (330)..(330): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcgtggtttccgtgtagctatttaaaaggtgcccagtgtgaggtgcagctggtggagtctggaggaggcttgatccagcctggggggtcccctgagactctcctgtgcagcctctggggttcaccgtcagtcacacctacatgagctgggtccgccaggctccgagggaaggggcgtggngtgtcgtcttntttatttatagtagtggtagtactatactcgcgacgtacgtcggtcgggacgggcgtacgtactacctactcctacacgacgaactaactacaacgaacacgtacttacgtttacttactaaactacgaacgaacgtacgtacgtagacgacgtacgtacgtacgaccggtaccggtacgttacgttacgtacgtacggtacggacggtacggtacggtaccgggtacccggtaaccggtaaccgttaaccgtaacgtaacgtacgtacggtacggtacggtacgggtaccggaacgggtaaccgg

SEQ ID NO: 381063 - DNA, 511 bp, Homo sapiens
  misc_feature: GZ8MTXP02GEBO7.13.76.G10.1.454.CMB.2.raw
  modified_base (384)..(384): a, c, t, g, unknown or other
  modified_base (392)..(392): a, c, t, g, unknown or other
  modified_base (395)..(395): a, c, t, g, unknown or other
  modified_base (397)..(397): a, c, t, g, unknown or other
  modified_base (399)..(399): a, c, t, g, unknown or other
  modified_base (411)..(411): a, c, t, g, unknown or other
  modified_base (417)..(417): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagcgtggtttcgtgtagctatttaaaggtgccagtgtgaggtgcagctggtggagtctggaggaggcttgatccagcctggggggtccctgagactctcctgtgcagcctctgggttcacgtcagtcacacctacatgagctgggtccgccagggctccgagggaagggctggagtgcgtctcttttattatagtagtgtagtacatactcgcagctcgtgaggggccattcaccatctcaganacatcaanacncntnttctactaatanacagcngagagacgagagacgacgcgtagtatatgtgtgagagacgacggaccgacgaacgtaacgtacgtacgtacgtaggtacgtacggtacggacgg

SEQ ID NO: 381064 - DNA, 483 bp, Homo sapiens
  misc_feature: GZ8MTXP02IFZ0S.13.76.G10.1.454.CMB.2.raw
  modified_base (236)..(236): a, c, t, g, unknown or other
  modified_base (363)..(363): a, c, t, g, unknown or other
  modified_base (436)..(436): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtcccgtgtccccaggacagacagccagcatcacctgctctggaaataattggcagataaatntacttcctggtatcagcagaagtcaggccagtccccctgtgctggtcatctatcaagatgccaagcggccctcagggatccccctgagcgattctctggctccaactctgggaactcagcccactcngaccatcagcgggacccaggctatggatgaggctgactattactgtcaggcgtgggacagcagcactgcccgntatcgtcttcggactgggaaccaaggtcacgtctaacgtcagacccg

SEQ ID NO: 381065 - DNA, 512 bp, Homo sapiens
  misc_feature: GZ8MTXP02JL1JL.13.76.G10.1.454.CMB.2.raw
  modified_base (291)..(291): a, c, t, g, unknown or other
  modified_base (355)..(355): a, c, t, g, unknown or other
  modified_base (379)..(379): a, c, t, g, unknown or other
  modified_base (384)..(384): a, c, t, g, unknown or other
  modified_base (401)..(401): a, c, t, g, unknown or other
  modified_base (410)..(410): a, c, t, g, unknown or other
  modified_base (412)..(412): a, c, t, g, unknown or other
  modified_base (415)..(415): a, c, t, g, unknown or other
  modified_base (455)..(455): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagcgtggtttcgtgtaggctatttaaagtgccagtgtgaggtgcagctggtggagtctggaggaggcttgatccagccgtgggggtccctgagactctcctgtgcagcctcgtgggttcaccgtcagtcacacctacatgagctgggtccnccaggctccgaggggaagggctggagtgcgtcttctttattatagtagtggtatacatactcgnagctcgtgagggccattcacatcncaganacatccaagacagcttntctatatananacncagagacgacgacgacgacgacgcgtagtatacgtcgtgngagagacgacggaccgacgacgtaacgtacgtacgtacgtacgtacgtcgacggacg

SEQ ID NO: 381066 - DNA, 539 bp, Homo sapiens
  misc_feature: GZ8MTXP02IA87S.13.76.G10.1.454.CMB.2.raw
  modified_base (294)..(294): a, c, t, g, unknown or other
  modified_base (440)..(440): a, c, t, g, unknown or other
  modified_base (451)..(451): a, c, t, g, unknown or other
tcagtcacgtactacacgaccggtgctcgatttagtcactcatacagggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctctggggttcaccgtcagtcacacctacatgagctgggtccnccaggctccgagggaggggctggagtgcgtctctttttattatagtagtggtagtaccatactcgcagactccgtgacggggcagttcaccatctccagagacaattccaaagacacgtctgtttctacaatgaacagcctaggangccgatgaacncgccgtgtatactgtgcgagagatcgggggacccacggaaccgtttacacgctagtcggacgttccgacggggccaaaagggggcccg

SEQ ID NO: 381067 - DNA, 544 bp, Homo sapiens
  misc_feature: GZ8MTXP02JH7EO.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgagggaggggctggagtgcgtctcttttattatagtagtggtagtaccatactccgcagactccgtgaggggccattccaccatcctccagagacaattccaagaacacgctgtttctcaaatgaacagcctgagagccgaatgacacggccgtgtattactgtgcgagagacgtcgggggaccccacgtaaacgttaccacgcctagtacggacgtcgtacgggggaccaacgggtaacccg

SEQ ID NO: 381068 - DNA, 547 bp, Homo sapiens
  misc_feature: GZ8MTXP02IPVU7.13.76.G10.1.454.CMB.2.raw
  modified_base (334)..(334): a, c, t, g, unknown or other
  modified_base (398)..(398): a, c, t, g, unknown or other
  modified_base (427)..(427): a, c, t, g, unknown or other
  modified_base (433)..(433): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtcgggtccgccaggcctccgaggggaaggggctggagtgcgttcttntttttattatagtagtggtagtaccatactcgcagactcgtgaggggccattcacatctcaganacatccaaagaacacgtctgtttactaanaaatanaacacgacgagagacgacgagacgacgacgacgtcgtatacgtgtgacgagagacgcggaccgacgtaacgtacgtacgaacgtagtacggtacgtacgacggacggacggacg

SEQ ID NO: 381069 - DNA, 497 bp, Homo sapiens
  misc_feature: GZ8MTXP02JTMI3.13.76.G10.1.454.CMB.2.raw
  modified_base (410)..(410): a, c, t, g, unknown or other
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggactcccgtgacgcgatctctggctccaactctgggaactcagcccactctgaccatcagcgggacccaggctatggatgaggctgactattacgngtcaggcgtgggacagcaagcacgtcgcccgctatcggtacttcgggaacgtgggaaccaagggtccaccgtccgtaaagcaaccgg

SEQ ID NO: 381070 - DNA, 632 bp, Homo sapiens
  misc_feature: GZ8MTXP02GQB5Q.13.76.G10.1.454.CMB.2.raw
  modified_base (388)..(388): a, c, t, g, unknown or other
  modified_base (435)..(435): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggtttccttgttgctattttaaaaggtgcccagtgtgaggtgcagctggtggagtctggaggaggcttgatccagccgtggggggtccctgagactctcctgtgcagcctcgtggggttcaccgtcagtcacacctacatgagcgtgggtcccgccaggcctccgaggggaggggctggagtgcgtcttcttttattatagtagtggtagtacatactcgcagactcgtgaggggcatcacatcncagagacaataccaagaacacgcttgtttactacaaaatgaaaaccncgtacctaggaacgacgaccgatacggaaccgtaccgggtccgttagttacttacgtggtacggacggaaggacggtacggggtacccgggggaacccctaaacgggttaaaccgttaccgtaaccggtaacgttaacgggtcggggtaacccggttcggggtaccgggggaacccggtaaaaccgggggtaccccg

SEQ ID NO: 381071 - DNA, 499 bp, Homo sapiens
  misc_feature: GZ8MTXP02GNBL2.13.76.G10.1.454.CMB.2.raw
  modified_base (332)..(332): a, c, t, g, unknown or other
  modified_base (414)..(414): a, c, t, g, unknown or other
  modified_base (448)..(448): a, c, t, g, unknown or other
tcagtcacgtactacacgaccggtgctcgatttagtcactcatacagggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctgagggatcccccctgagcgattctcnggctccaactctgggaactcagcccactctgacccatccaggccggaccccaggcctagtcggatggagctggacttatacngtcgaggcgtgggacagcagcacgtcgccgctancgtcgttcggaactgggaacccaggtccaccgtaccaacgtcgacgacccg

SEQ ID NO: 381072 - DNA, 532 bp, Homo sapiens
  misc_feature: GZ8MTXP02GVSVU.13.76.G10.1.454.CMB.2.raw
  modified_base (512)..(512): a, c, t, g, unknown or other
  modified_base (522)..(522): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctgggggtccctgagactctcctgtgcagcctctgggttcaccgtcagtcacacctacatgagctgggtccgccaggctccgaggggaaggggctggagtgcgtcttcttttatttatagttagtggtagtacatactcgcagctccgtgagggccgattcaccatctcagagacaattccaaagacacgcttgttcttacaaaatgaaacagcctagagagccgatcgacacggcctagtattactgtgcgagagagtcggggacccaagtaacgtaactacgctagnggacgttcgnggggaacccg

SEQ ID NO: 381073 - DNA, 491 bp, Homo sapiens
  misc_feature: GZ8MTXP02F02FY.13.76.G10.1.454.CMB.2.raw
  modified_base (235)..(235): a, c, t, g, unknown or other
  modified_base (335)..(335): a, c, t, g, unknown or other
tcagtcacgtactacacgaccggtgctcgatttagtcactcatacaggggaggctctgcttcagctgtgggcacaagaggcagcactcaggacaatctccagcatggcctggtctcctctcctcctcactctcctcgctcactgcacagggtcctgggcccagtctgtactgacgcagcccgccctcagtgtcgtcggggccccagggcaggaggtcacatctctgcactgggancagctccaacagttggggcacattatgatgtacactggtaccagctagttccaggagcaggtcccagactcctcatcaatagtaacaacaatcggacccncgacggggtccctgaccgtattcctctggcctcagtctggcacctcacgccctccctgtcatcactggctccgagctgagatgagctgattattctgctagtcctatcgacagcagcctgaagtcgtcttcggtagtcgggacgggggtaccacgg

SEQ ID NO: 381074 - DNA, 501 bp, Homo sapiens
  misc_feature: GZ8MTXP02G0MV3.13.76.G10.1.454.CMB.2.raw
  modified_base (235)..(235): a, c, t, g, unknown or other
  modified_base (308)..(308): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagcccgccctcagtgtctggggccccagggcagaggtcaccatctcctgcactgggancagctccaacattggggcacattatgatgtacactggtaccagcagtttccaggagcaggtcccagactcctnatcaatacgtaacaacaatcggcccgcaggggtccctgaccattctctggctccagtctggcacctcacgcctccctggtcatcactcgggctccgaggctgacggatgagctgattattctgcctagtcctatcgacacgcacgtcctgaagtcgtacgttcggtagttccgggaccgggggtacctacggg

SEQ ID NO: 381075 - DNA, 531 bp, Homo sapiens
  misc_feature: GZ8MTXP02IFHSQ.13.76.G10.1.454.CMB.2.raw
  modified_base (328)..(328): a, c, t, g, unknown or other
  modified_base (353)..(353): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagcctacatcacctgctctggagatgtattgactaacgagtatggttcctggtatcagcagaaggcaggccagccccctgtcctactcatctttacaaaatccggcggccctctggggtccctgacgcgattcnccccgctccgcctctgggaaccacngtcactctgacccatcagccgaccagcctattcgatgaggtctgtctacgtctgtcaggcgtgggacacgagcgtgcgtgttcgggcggaggaccgacgtctcgacccgtgttaacggcgacgacccgtaaggcctcggtcccccgtcggtctaccctcgttccgttccccgtccccg

SEQ ID NO: 381076 - DNA, 648 bp, Homo sapiens
  misc_feature: GZ8MTXP02G2JVZ.13.76.G10.1.454.CMB.2.raw
  modified_base (451)..(451): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggttcaccgtcagtcacacctacatgagcgtgggtcccgccgaggcctccgaggggaaggggcgtggagtgcgtcttcttttattatagtagtggtatacatactcgcagactcgtggacgggccgtatccacctatcctaccagacgaactaataccaaagaacacgcttacgtttctacaaaatcgaaacncgtacctaggacgacggacccgatacggaaccaccggggtccgttagttaacgtttaccgtgggttacggaccggaaggtaacggacggttaccgggggacccccctaaacgggtaaacccggtttacctaacggcctttaaggtacggggaacccggtttcggtaccgggggaacccgaaaacgggggtacccccg

SEQ ID NO: 381077 - DNA, 566 bp, Homo sapiens
  misc_feature: GZ8MTXP02IBX8L.13.76.G10.1.454.CMB.2.raw
  modified_base (459)..(459): a, c, t, g, unknown or other
  modified_base (487)..(487): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctctgggttcaccgtcagtcacacctacatgagctgggtccgccaggctccgagggaaggggctggagtgcgttctctttttattatagtagtggtagtaccatactcgcagacctcgtgaggggccattccaccatctccagagacaattccaaagaacacgcttagtttctacaaatgaaacagcctgagagccgaatgaaaccncggccgtagtattacgtgtacgcgaagnggaagtcgggggacccaacggaaacgtttaccgaacgcgtaagtgggacgttcggacgggggacccaaacggggacccg

SEQ ID NO: 381078 - DNA, 477 bp, Homo sapiens
  misc_feature: GZ8MTXP02JVT6Z.13.76.G10.1.454.CMB.2.raw
  modified_base (331)..(331): a, c, t, g, unknown or other
  modified_base (385)..(385): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttcctggtatcagcagaagtcaggccagtcccctgtgctggtcatctatcaagatgccaagcggccctcagggactccccctgacgcgattcnctggctccaactctgggaactcagcccactctgaccatcagcggaccaggctangatgagctgactatactgtcaggcgtgggacagcagcactcgcccgctatcgtcttcggactggaaccaggtcaccgtcacgtcacgacccg

SEQ ID NO: 381079 - DNA, 534 bp, Homo sapiens
  misc_feature: GZ8MTXP02JJUKK.13.76.G10.1.454.CMB.2.raw
  modified_base (234)..(234): a, c, t, g, unknown or other
  modified_base (290)..(290): a, c, t, g, unknown or other
  modified_base (308)..(308): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagaggtcaccatctcctgcactgggancagctccaacattggggcacattatgatgtacactggtaccagcagtttccaggancgaggtcccagactcctnatcaatacgtaacaacaatcggcccgcgacggggtccctgaccgtattcctcgtcggcctccgaggtctggccacctcacgccctccctggtcatccacgtcgggcctccgaggcctggaggagtcgaggctagtatttagttctcgccgtacgtcctatacgacctaagccgagtccctggaagtcgtcgtttcgggtacgtccggggtaccgggggacctacgg

SEQ ID NO: 381080 - DNA, 539 bp, Homo sapiens
  misc_feature: GZ8MTXP02HR9B4.13.76.G10.1.454.CMB.2.raw
  modified_base (294)..(294): a, c, t, g, unknown or other
  modified_base (326)..(326): a, c, t, g, unknown or other
  modified_base (426)..(426): a, c, t, g, unknown or other
tcagtcacgtactacacgaccggtgctcgatttagtcactcatacagggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagcctggggggtccctgagactctcctgtgcagcctctgggttcaccgtcagtcacacctacatgagctggggtcccnccaggctccgaaggaaggggctggagtgcgtntctttttattatagtagtggtagtacatacctcgcagactcgtgagggcgattcacatctccagagacaatccaagaacacgctgtttctacaatgaacngcctgagagccgaatgacacggccgtgtacttacgtgtgcgagagacgtcgggggacccaacggaacgtttacgacgcgtagtcggacgtcgtacggggaccaacgggacccg

SEQ ID NO: 381081 - DNA, 547 bp, Homo sapiens
  misc_feature: GZ8MTXP02JI1ZY.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgccaggctccgagggagggctgcagtgcgtctcttttattatagtagtggtagtacatactcgcagactccgtgaggggccgattcacatctccagagacaattccaaagaacacgtcttgtttctacaaatgaaacagcctgagacgccgaatcgaacgacgggcctagttatactggtcgacgagagagtcggggaccccaaggtaacgttacaacggctaagtcgggactcggtcggggacctaaacggggg

SEQ ID NO: 381082 - DNA, 491 bp, Homo sapiens
  misc_feature: GZ8MTXP02G6NLR.13.76.G10.1.454.CMB.2.raw
  modified_base (308)..(308): a, c, t, g, unknown or other
  modified_base (330)..(330): a, c, t, g, unknown or other
  modified_base (404)..(404): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctnagggatccccctgagcgattcnctggctccaatctgggaactcagcccactctagaccatcagcggacccaggctatggatgaggctgactatacngtcagcgtgggacagcagcacgtgcccgctatcgtcttcggaacttgggaaccgaaggtccaccggtactaaacgtcaacgaccccg

SEQ ID NO: 381083 - DNA, 586 bp, Homo sapiens
  misc_feature: GZ8MTXP02FULCD.13.76.G10.1.454.CMB.2.raw
  modified_base (438)..(438): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtcccgccaggctccgaggggaggggctggagtgcgtcttcttttatttatagtagtggtagtaccatactcgcagactccgtggagggccattccaccatcctccagagacataccaaagaacacgcttgtttctacaaaatgaaacngcctagagagccgatacgacaccggcgtagtattactggtacgcgtaggagacgtcgggggacccctaacggtaaaccgttaccgtaacggccgttaaagtcggggtaccggtccggtacgggggaaccctaaacgggggtaaccccg

SEQ ID NO: 381084 - DNA, 484 bp, Homo sapiens
  misc_feature: GZ8MTXP02FJ9WH.13.76.G10.1.454.CMB.2.raw
  modified_base (306)..(306): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttcctggtatcagcagaagtcaggccagtcccctgtgctggtcatctatcaagatgccaagcggcctnagggatccccctgagcgattctctgggctccaactctgggaactcagcccactctgaccatcacgcgggacccaggctatggatgagctgactattactgtcaggcgtgggacagcagcactcgcccgctatcgtctcggactaggaaccgacgtacacgtcctaacgtcacgacccg

SEQ ID NO: 381085 - DNA, 504 bp, Homo sapiens
  misc_feature: GZ8MTXP02F40YS.13.76.G10.1.454.CMB.2.raw
  modified_base (234)..(234): a, c, t, g, unknown or other
  modified_base (306)..(306): a, c, t, g, unknown or other
  modified_base (329)..(329): a, c, t, g, unknown or other
  modified_base (405)..(405): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataatggcagataaatntacttcctggtatcagcagaagtcaggccagtcccctgtgctggtcatctatcaagatgccaagcggccctnagggactccccctgagcgattcnctggctccaactctgggaactcagccactctgaccatcagcggacccaggctagtggatggaggctgactattacngtccaggcgtgggacagcagcacgtcgccccgtctacgtcgtccgttacggaacgtacggaaccgtaacggtccaccgtaccgtaacgtccgacgaccg

SEQ ID NO: 381086 - DNA, 525 bp, Homo sapiens
  misc_feature: GZ8MTXP02GSIKM.13.76.G10.1.454.CMB.2.raw
  modified_base (411)..(411): a, c, t, g, unknown or other
  modified_base (419)..(419): a, c, t, g, unknown or other
  modified_base (432)..(432): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccacctcagtgtccgtgtccccaggacagacagccagcatcactgctctaggaaataatggcagataaatatactctggtatcagcagaagtcaggccagtcccctgtgctggtcatctatcaagatgaccaagccggccctgacggggactccccccgtaggacgcgtactttcgtctcgggtcctcccaaacttcgtacggggaaacctcacgtccactctagaccatcgagccggacccaggctangatggagntagactattacgngtacgaggcgtaggacagcagcactcgccgctagtcgtcttacggaactacggggaaccaacggtcgacccgtactaacgccaacgaaccccg

SEQ ID NO: 381087 - DNA, 545 bp, Homo sapiens
  misc_feature: GZ8MTXP02JDDZN.13.76.G10.1.454.CMB.2.raw
  modified_base (474)..(474): a, c, t, g, unknown or other
tcagtcacgtactacacgaccggtgctcgatttagtcactcatacgaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgccaggctccgaggggaggggctggagtgcgtcttcttttattatagtagtggtagtaccatacctccgcagactccgtggaggggccgattcaccatctccagagaaccaattcccaagaacacgctgtttctacaaatgaaacagcctgagagccgaatgacacggtcctgtattacgngtgcgagagagtcgggggacccacggaacgttcaacgctagtggacgtgtcgggggaccaaaggggacccg

SEQ ID NO: 381088 - DNA, 487 bp, Homo sapiens
  misc_feature: GZ8MTXP02JQHB7.13.76.G10.1.454.CMB.2.raw
  modified_base (391)..(391): a, c, t, g, unknown or other
  modified_base (423)..(423): a, c, t, g, unknown or other
  modified_base (438)..(438): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatactcctggtatcagcagaagtcaggccagtcccctgtgctggtcatctatcaagatgccaagccggccctgagggctccccctgagcgattctctggcctccaaactcgtagggaactcagcccactctgaccatcacgcgggacccaggctagngatgagctgactatactgtcaggcgtgggacngcagcacgtcgcccnctatcgtcttacggaactggaaccaggtcaccgtcaacgtcacgacccg

SEQ ID NO: 381089 - DNA, 618 bp, Homo sapiens
  misc_feature: GZ8MTXP02JQPYT.13.76.G10.1.454.CMB.2.raw
  modified_base (243)..(243): a, c, t, g, unknown or other
  modified_base (254)..(254): a, c, t, g, unknown or other
  modified_base (260)..(260): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcgtggtttcgtgtagctatttaaaagtgccagtgtgaggtgcagctggtggagtctggaggaggcttgatccagcctggggggtccctgagactctcctgtgcngctcgtggtcncgtcancacacctacatgagcgtcggtccgccgacggcgtccgacgggaggggcgtggtaggtcgtcgtcttacgtttatttagtagtagtaggtagtactactactcgacgacgacgtcgtcgtagtcggtcgtacgtacctacctactcctaccgacgaacgaactaacgtaccgtaaacgaaacgacgtacgttcgttacttactaactagtaacgacgtacgtagacgacgacgacgtacgacgacggtcgtacgtacgttacgtcgtacgtacgaggacggtacggtacgggtaccgtaaccgtaaccgttaacgtaacgtacgtacgtacggtacggtacggtacgggtacggaacgg

SEQ ID NO: 381090 - DNA, 568 bp, Homo sapiens
  misc_feature: GZ8MTXP02JQBQ6.13.76.G10.1.454.CMB.2.raw
  modified_base (394)..(394): a, c, t, g, unknown or other
  modified_base (440)..(440): a, c, t, g, unknown or other
  modified_base (479)..(479): a, c, t, g, unknown or other
  modified_base (527)..(527): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggttcaccgtcagtcacacctacatgagctcgggtccgccaggctccgaggggaaggggctggagtgcgtcttcttttattatagtagtggtagtacatactccgcagactccgtggacggggccattcaccatcnccagagacaatccaaagaaccacgtctgtttctacaaatgaaaccngcagagacgccgatcgaccgacggtcgtagtacttacgngcgacggagacggacggtccggggaccctaacggtaaccgttacacgngtacggtacgggtacgtcggacggggaccgaacgggacccg

SEQ ID NO: 381091 - DNA, 500 bp, Homo sapiens
  misc_feature: GZ8MTXP02I30OS.13.76.G10.1.454.CMB.2.raw
  modified_base (350)..(350): a, c, t, g, unknown or other
  modified_base (359)..(359): a, c, t, g, unknown or other
  modified_base (376)..(376): a, c, t, g, unknown or other
tcagtcacgtactacacgaccggtgctcgatttagtcactcatacagggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagatgtattgactaacgagtatggttcctggtatcagcagaagcaggccagccccctgtcctactcatctttacaaaatccaggccgccctcgtcggggtcccctgagcgattcctccggctccgctcgtgggacnagtcactcngaccatcagcggacccngcctatgatgagctgtctacttctgcgtaggcgtagggaacaacgagcgtgctggtacggcggagggtccagtctgaccgttgtacggcagcccaaggcctcggccccctggtcaccgtctccg

SEQ ID NO: 381092 - DNA, 536 bp, Homo sapiens
  misc_feature: GZ8MTXP02IHA62.13.76.G10.1.454.CMB.2.raw
  modified_base (295)..(295): a, c, t, g, unknown or other
  modified_base (363)..(363): a, c, t, g, unknown or other
  modified_base (442)..(442): a, c, t, g, unknown or other
  modified_base (468)..(468): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagctgggtccnccaggctccgaggggaaggggctggagtgcgtcttcttttattatagtagtggtagtacatactccgnagctccgtgacggggccattcacatctcagagacaattccaaagaccacgctgttactcaaaatgaaacagcctgaganccgatgacacggccgtgtatttacgngtgagagagacgacggaccgacgtaacgtaacgtacgtacgtacgtacggtacgtcggtacgggacgg

SEQ ID NO: 381093 - DNA, 576 bp, Homo sapiens
  misc_feature: GZ8MTXP02G0CRX.13.76.G10.1.454.CMB.2.raw
  modified_base (295)..(295): a, c, t, g, unknown or other
  modified_base (409)..(409): a, c, t, g, unknown or other
  modified_base (434)..(434): a, c, t, g, unknown or other
  modified_base (449)..(449): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggggttcaccgtcagtcacacctacatgagcgtgggtccnccaggctccgaggggaggggctggagtgcgtctcttttattatagtagtggtagtaccatactccgcagactccgtggacggggccattcaccatctccagagacaatccaaanacagcctgtttctacaaatgaaacngacagagacgccgancgacgacggtcgtagtattacgtgtgacggaggacggtacggaccgggaacccgtaacggtaaccgttaccgacgtaacgtacggtacgggtaccggtacgggaccggggaaccggaaccggacccg

SEQ ID NO: 381094 - DNA, 584 bp, Homo sapiens
  misc_feature: GZ8MTXP02GTHXZ.13.76.G10.1.454.CMB.2.raw
  modified_base (451)..(451): a, c, t, g, unknown or other
  modified_base (504)..(504): a, c, t, g, unknown or other
  modified_base (514)..(514): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtacccagtgtgaggtgcagctgggtggagtctggaggaggcttgatccagccgtgggggtccctgagactctcctgtgcagcctcgtgggttcaccgtcagtcacacctacatgagcgtcggggtcccgccgaggcctccgaggggaaggggctggagtgcgtctcttttattatagtagtggtagtacactactccgcagactccggtggacggggccgattccacctactctaccagtaacgactaaattcccaaaggaaccacgtcttagtttcctaanaaatgaaactagcctagagagcccgatcgaaccacgggccttagtacttacgngtgcgagagngtcggggacccaacggtaacgttacacgctaagcggtacgtcggacggggaccaacggggaccctaccgg

SEQ ID NO: 381095 - DNA, 476 bp, Homo sapiens
  misc_feature: GZ8MTXP02GS71H.13.76.G10.1.454.CMB.2.raw
  modified_base (236)..(236): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactggggancagctccaacattggggcacattatgatgtacactggtaccagcagtttccaggagcaggtcccagactctcatcaatagtaacaacaatcgaccgcaggggtccctgaccgatctctgctcagtctgcactcagcctcctgtcatcactcggctccgaggctgaggactgagctgattattctgcacgtcctatcgacagcacgcctgaagtcgcttcggattcggcgggggaccacgg

SEQ ID NO: 381096 - DNA, 502 bp, Homo sapiens
  misc_feature: GZ8MTXP02FWU42.13.76.G10.1.454.CMB.2.raw
  modified_base (397)..(397): a, c, t, g, unknown or other
  modified_base (418)..(418): a, c, t, g, unknown or other
  modified_base (451)..(451): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaattggggataaatatgcttgctggtatcagcagaagccaggccagtcccctgtgctggtcatctatcaagatgccaagccggccctcgacgggactccccgtgagcgtattcctctggcctccaactcgtgggaactcacgcccactctgaccatcgacgccgggaccaggctagnggatgaggctgacttattacngtcgaggcgtagggacagcagcacgtcgcccgntacgtcgtcgttcggaactcgggaccacggtccaccgtactaacgcaaccg

SEQ ID NO: 381097 - DNA, 533 bp, Homo sapiens
  misc_feature: GZ8MTXP02I4E9H.13.76.G10.1.454.CMB.2.raw
  modified_base (248)..(248): a, c, t, g, unknown or other
  modified_base (416)..(416): a, c, t, g, unknown or other
  modified_base (423)..(423): a, c, t, g, unknown or other
  modified_base (438)..(438): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagcgtggtttctgtgctatttaaagtgccagtgtgaggtgcagctggtggagtctggaggaggcttgatccagcctggggggtccctgagactctcctgtgcagcctntgggttcaccgtcagtcacacctacatgagctgggtccgccagggctccgagggaaggggctgggagtgcgtcttcttttattatagtagtggtagtacatactcgcagctccgtggagggggcccattcaccatcctcagagacaattccaagacacgctgttctanaatgacngctagagacgccganacgacgacgcgtagtattacgtcgtgtgagagacggtcggaccgaacgtaacgtaacgtacgtacgtacgtacggtacggtacggtacgggacgg

SEQ ID NO: 381098 - DNA, 576 bp, Homo sapiens
  misc_feature: GZ8MTXP02FZS7W.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggggttcaccgtcagtcacacctacatgagctgggtcccgccaggctccgaggggaaggggctggagtgcgtctcttttatttatagtagtggtagtaccatactccgcagactccgtggacggggcgattccaccatctccagagacaatccaaagaacacgctgtttctacaaaatcgaaacagcctaggagacgccggaatcgacgaacgggccgtagtattaactggtgacgagagacgtcgggggaccccaacggtaaccgttaacgtacgaaccgtagtacggacgtcgtacgggggacccgaaggggaaccccg

SEQ ID NO: 381099 - DNA, 543 bp, Homo sapiens
  misc_feature: GZ8MTXP02FTQ7S.13.76.G10.1.454.CMB.2.raw
  modified_base (471)..(471): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagctgggtccgccaggctccgaggggaggggctggagtgcgtcttctttattatagtagtgtagtacatactcgcagctccgtggacggggccattcacatctcagagacaattccaaagacacgtctgtttactacaaaatgaaactgcctgaagacgccgatcgacacggccgttagtattacgngtgtagagagagtcggggacccaacggtaaacgttaacacgtctaagtcggacgtcggtacgggggaacccg

SEQ ID NO: 381100 - DNA, 580 bp, Homo sapiens
  misc_feature: GZ8MTXP02JZQ6B.13.76.G10.1.454.CMB.2.raw
  modified_base (393)..(393): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtgggtcccgccaggcctccgaggggaaggggctggagtgcgtcttcttttattatagtagtggtagtaccatactcgcagactcgtgacggggccattcacatcnccagagacactacaagaacacgcttgtttactacaaatcgaaacagcctgagacgtccgaagtcgaaccgtacgggcccgttagttaacttacgtgtcggacgaggaggacggtcgggggaccccaacggtaaccgttactaacgcgtaagtcggacgtccggtacgggggaccaacggggaacccg

SEQ ID NO: 381101 - DNA, 535 bp, Homo sapiens
  misc_feature: GZ8MTXP02ICW95.13.76.G10.1.454.CMB.2.raw
  modified_base (360)..(360): a, c, t, g, unknown or other
  modified_base (388)..(388): a, c, t, g, unknown or other
  modified_base (465)..(465): a, c, t, g, unknown or other
tcagtcacgtactacacgaccggtgctcgatttagtcactcatacagggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtccctgagactctcctgtgcagcctctgggttcaccgtcagtcacacctacatgagctgggtccgccaggcctccgagggaaggggctggagtgcgtctcttttattatagtagtggtagtaccatactccgnagactctgtgaggggccgattcacatcnccagagacaattccaaagaacacgctgtttctacaaatgaacagcctgagagccgatgacacggcgttgtacttacngtgacgagagagtcggggacccacgaacgttacaacgctaagtcggacgtcgtagggggaccaaacgggg

SEQ ID NO: 381102 - DNA, 503 bp, Homo sapiens
  misc_feature: GZ8MTXP02JRPKM.13.76.G10.1.454.CMB.2.raw
  modified_base (277)..(277): a, c, t, g, unknown or other
  modified_base (295)..(295): a, c, t, g, unknown or other
  modified_base (336)..(336): a, c, t, g, unknown or other
  modified_base (391)..(391): a, c, t, g, unknown or other
  modified_base (418)..(418): a, c, t, g, unknown or other
  modified_base (452)..(452): a, c, t, g, unknown or other
tcagtcacgtactacacgaccggtgctcgatttagtcactcatacatgggagcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggcagataaatatacttctggtatcagcagaagtcaggccagtcccctgngctggtcatctatcaagntgaccaagccggccctgaggggactccctgacgcgtattcncgtggcctccaactcgtagggaactcacgcccatctagaccatcagccgggaccngctagtggatgaggctagactattacngtcgaggcgtgggacaggtcagcactcggccctntacgtcgtcgtacggaacgtcggaaccgtacggtccaccgtacgtacgtcg

SEQ ID NO: 381103 - DNA, 478 bp, Homo sapiens
  misc_feature: GZ8MTXP02FS09K.13.76.G10.1.454.CMB.2.raw
  modified_base (332)..(332): a, c, t, g, unknown or other
  modified_base (405)..(405): a, c, t, g, unknown or other
  modified_base (434)..(434): a, c, t, g, unknown or other
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttcctggtatcagcagaagtcaggccagtcccctgtgctggtcatctatcaagatgccaagcggccctcagggactcccctgagcgattcnctggctcaactctgggaactcagccactctgaccatcagcgggacccaggctatgatgaggctgactattacngtcaggcgtgggacagcagcactgcccgntatcgtcttcggaactgggaccaaggtcaccgtctaagtcaacg

SEQ ID NO: 381104 - DNA, 558 bp, Homo sapiens
  misc_feature: GZ8MTXP02JAJER.13.76.G10.1.454.CMB.2.raw
  modified_base (235)..(235): a, c, t, g, unknown or other
  modified_base (424)..(424): a, c, t, g, unknown or other
  modified_base (450)..(450): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataatggcagataaatntacttctgtatcagcagagtcaggccagtcccctgtgctggtcatctatcaagatgaccaagccggcctacgagggactcccccgtgacgtcgtattcctcgttcgggccttacccaaacgttcgtacggggtaacctcgaacgccctactctacgaccaacgtcgaacggccgggacccaggtctagnggactggacggctagtactattacgngtacgaggcgtgggacagcgacgcacgtcgcccgtatacgtcggtccgttaacggacgtcgggaaccgtaacggtccaccggttaccgtaaacgtccgacgaaccccg

SEQ ID NO: 381105 - DNA, 565 bp, Homo sapiens
  misc_feature: GZ8MTXP02IWAKH.13.76.G10.1.454.CMB.2.raw
  modified_base (388)..(388): a, c, t, g, unknown or other
  modified_base (413)..(413): a, c, t, g, unknown or other
  modified_base (475)..(475): a, c, t, g, unknown or other
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagcgtgggtccgccaggctccgaggggaaggggctggagtgcgtctcttttattatagtagtggtagtacatactcgcagactccgtgacggggcctattccacntctccagagacaattccaaagaacncgcttgtttctacaaatgaaacagcctagagagaccgatcgaacaccggtcgtagtatacgngtcggacgaggagaggtcggggaccccaaacggtaacgtttaaccgaacgctaagtcgggaaccgttcggacgggggaccaaaccggggg

SEQ ID NO: 381106 - DNA, 541 bp, Homo sapiens
  misc_feature: GZ8MTXP02HNM6G.13.76.G10.1.454.CMB.2.raw
  modified_base (362)..(362): a, c, t, g, unknown or other
  modified_base (469)..(469): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggggttcaccgtcagtcacacctacatgagctgggtccgccaggctccgaggggaaggggctggagtgcgtcttcttttatttatagtagtggtagtacatactcgnagactcgtgacgggcattcaccatctccagagacaattaccaagaacacgcttgtttcttacaaatgaacagcctgagagccgatcgacacggccgtagtattacgngtgcgagagagtcgggggacccacgaacgttacacgtcgtagtggaccgtcgtcggggaccgaagggacccg

SEQ ID NO: 381107 - DNA, 538 bp, Homo sapiens
  misc_feature: GZ8MTXP02JZFQ8.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggcctccgagggaggggctggagtgcgtctcttttattatagtagtggtagtaccatactccgcagactccgtggacggggccattcaccatctccagagacaattccaaagaacacgctgtttctacaaatgaaacagcctgagacgccgatgaccgacggccgtgtattacgtgtgcgagagacgtcggggcccacgaacgttcacgctagtcggacgtcgtcggggaccaagggacccg

SEQ ID NO: 381108 - DNA, 501 bp, Homo sapiens
  misc_feature: GZ8MTXP02JJFVB.13.76.G10.1.454.CMB.2.raw
  modified_base (234)..(234): a, c, t, g, unknown or other
  modified_base (259)..(259): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagaggtcaccatctcctgcactgggancagctccaacattggggcacattangatgtacactggtaccagcagtttccaggagcaggtcccagactcctcatcaatacgtaacaacaatcggcccgcgacggggtccctgaccgattcctctggctccagtctcggcacctcacgccctcctggtcatcacgtgggcctcgaggctgaggatgaggctgattattctgccagtcctatcgacagcacgcctagaacgtcgtcgttacggtagttccggggccgggggaccacgg

SEQ ID NO: 381109 - DNA, 568 bp, Homo sapiens
  misc_feature: GZ8MTXP02INKJZ.13.76.G10.1.454.CMB.2.raw
  modified_base (363)..(363): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctggggttttccttgttgctattttaaaaggtgcccagtgtgaggtgcagctggtggagtctgggaggaggcttgatccagcctggggggtccctgagactctcctgtgcagcctctgggttcaccgtcagtcacacctacatgagctgggtcccgccaggctccgagggaaggggctggagtgcgtcttcttttattatagtagtggtagtaccatactccgnagactccgtgacggggccgattccaccatctccagagacaatccaagaacacgcttgtttctacaaaatgaaactacgacctagacgacgacccggatacgacgacgggtccgtgtaactttacgtgtcgacgaggagacgtcgggggacccacgaaacgttctacgcgtaagtcggacgtcgtacggggaccgaaagggacccg

SEQ ID NO: 381110 - DNA, 574 bp, Homo sapiens
  misc_feature: GZ8MTXP02HV2U1.13.76.G10.1.454.CMB.2.raw
  modified_base (279)..(279): a, c, t, g, unknown or other
  modified_base (292)..(292): a, c, t, g, unknown or other
  modified_base (306)..(306): a, c, t, g, unknown or other
  modified_base (308)..(308): a, c, t, g, unknown or other
  modified_base (311)..(311): a, c, t, g, unknown or other
  modified_base (324)..(324): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagtttttggctgagcgtggtttcgtgtaggctatttaaaagtgccagtgtgaggtgcagctggtggagtctggaggaggcttgatccagccgtggggggtccctgagactctcctgtgcagcctctggttcaccgtcagtcacactacatgngcgtcggccgcgngcgcgagggagggngnggngtgtcgttctttnttttatttatagtagtggtagtactatactcgcacgacgtcggtcggacgggacgtacttacctaccactcctacacgaagaactaactaacaacgaacacgtcttcgtttacttactaatagaacacgtacgtagagacgacgagacgacgacggcgtagtattacgtgtgacgagagacggcggaccgaccgtaacgtacgtacgtaacgtacgtacggtacggtcggtacgggaccggaacggaccg

SEQ ID NO: 381111 - DNA, 571 bp, Homo sapiens
  misc_feature: GZ8MTXP02GGSP1.13.76.G10.1.454.CMB.2.raw
  modified_base (294)..(294): a, c, t, g, unknown or other
  modified_base (339)..(339): a, c, t, g, unknown or other
  modified_base (353)..(353): a, c, t, g, unknown or other
  modified_base (390)..(390): a, c, t, g, unknown or other
tcagtcacgtactacacgaccggtgctcgatttagtcactcatacaggggggagaggagcccagcactgggattccgaggtatttccattcggtgatcagcactgaacacagaggactcaccatggagttttggctgagctgggttttccttattactattttaaaggtgtccagtgtgaggtgcagttggtggagtctggaggaggcttggtccaggccggggggtccctgagactctcatgtgcggcctcgtgggctcaccgtcaacaccaactacatgagctggggtcccnccaggctccgaggggaagaggccggagtgggtctcagtttattangtcgacggtgccanattcacgcagactccgtgacggggccgttcaccatcnccagagacaattccaaagaacacggtgtatcttacaaatgaacgacctagagagtcgaggacgacggccgtctattactgtgacgaaagatgcagacggacgggcccccgtaagtcggggccgtgggtgggtagggtttcgttcgtttgacgtggcgtcgggggccgacgggtaaccccgg

SEQ ID NO: 381112 - DNA, 637 bp, Homo sapiens
  misc_feature: GZ8MTXP02HMNBG.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtcgggtcccgccgaggcctccggaggggaaggggctgggagtgcgtcttctttattatagtagtggtatacatactccgcacgactcggtgggacggggcctattccacctatcctccaagacgaactaaataccaaagaaccacgtcttgtttacctacaaaattcgaaaccagtaccctaggaagacgaccgaagtcgaaccgaccgggtccgtagttaattaccgtggttcgacggaaggacggacggtccgggggacccctaacgggtaaaccgttaccgtaccggtaaccgttaggtacgggtaccggtcggtaccgggggacccgtaaaacgggggacccccg

SEQ ID NO: 381113 - DNA, 498 bp, Homo sapiens
  misc_feature: GZ8MTXP02I40LF.13.76.G10.1.454.CMB.2.raw
  modified_base (330)..(330): a, c, t, g, unknown or other
  modified_base (425)..(425): a, c, t, g, unknown or other
  modified_base (440)..(440): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttcctggtatcagcagaagtcaggccagtccccctgtgctggtcatctatcaagatgccaagcggccctcagggatccccctgagcgattcnctggctccaactctgggaactcacgccactctcgaccatcagccgggacccaggctagcggatggaggctgactattactgtcaggcgtgggacngcagcacgtgcccgntagtcgtccgtacggactggggaacctaggtccaccgtccgtaacgtcgacgtacccg

SEQ ID NO: 381114 - DNA, 535 bp, Homo sapiens
  misc_feature: GZ8MTXP02I930Q.13.76.G10.1.454.CMB.2.raw
  modified_base (418)..(418): a, c, t, g, unknown or other
  modified_base (426)..(426): a, c, t, g, unknown or other
  modified_base (439)..(439): a, c, t, g, unknown or other
  modified_base (458)..(458): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggggttcaccgtcagtcacacctacatgagctgggtccgccaggctccgagggaggggctggagtgcgtctcttttatttatagtagtggtagtaccatactcgcagactccgtgagggccgattcacatctccagagacaatccaagacacgctgttctaanaatgaacngctgagacgcgancgacgcggctagtattcgngcgacgagacgacggtacgggacccacgtaacgttacacgtcgtagtacggtacgtcggacgggaccgaacgggacc

SEQ ID NO: 381115 - DNA, 529 bp, Homo sapiens
  misc_feature: GZ8MTXP02IS4MT.13.76.G10.1.454.CMB.2.raw
  modified_base (236)..(236): a, c, t, g, unknown or other
  modified_base (333)..(333): a, c, t, g, unknown or other
  modified_base (435)..(435): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataatggcagataaatntacttcctggtatcagcagaagtcaggccagtcccctgtgctggtcatctatcaagatgccaagccggcctcgagggctcccccgtgacgcgattcnctggctccaactcgaggaactcagccactctgaccatcaacgcggaccaggctagtggatggagtctagtactaattacgtgtacgaggccgtgggaaccgngacgacgcacgtcgcccgtacttacgtcgttacgtacggaacgtacgggaaccgtaacggtaccgtacccgtacgtaacgtccgaaccgacccg

SEQ ID NO: 381116 - DNA, 547 bp, Homo sapiens
  misc_feature: GZ8MTXP02GYDLU.13.76.G10.1.454.CMB.2.raw
  modified_base (395)..(395): a, c, t, g, unknown or other
  modified_base (419)..(419): a, c, t, g, unknown or other
  modified_base (422)..(423): a, c, t, g, unknown or other
  modified_base (427)..(427): a, c, t, g, unknown or other
  modified_base (430)..(430): a, c, t, g, unknown or other
  modified_base (442)..(442): a, c, t, g, unknown or other
  modified_base (466)..(466): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtctggaggaggcttgatccagcctgggggtccctgagactctcctgtgcagcctctgggttcaccgtcagtcacacctacatgagctgggtccgccaggctccgagggaaggggctgggagtgcgtctctttattatagtagtggtagtacatactccgcagactccgtgacgggggccattcaccatctccaganacattccaagacagctgttctaanaannaacngcngagacgacgtancgacgacggcgtagtaacttacgnggtgacgacgaggacgtacgggtaccgaaccgtaaccgtaacgtacgtacgtacgtacggtacggtacggtacgggaccgg

SEQ ID NO: 381117 - DNA, 583 bp, Homo sapiens
  misc_feature: GZ8MTXP02I8DL2.13.76.G10.1.454.CMB.2.raw
  modified_base (296)..(296): a, c, t, g, unknown or other
  modified_base (314)..(314): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcgtggtttcgtgtaggctattttaaaaggtgcccagtgtgaggtgcagctggtggagtctggaggaggcttgatccagcctgggggggtccctgagactctcctgtgcagctctggttcaccgtcagtcacacctacatgagctggtccgccagcnccagggaaggggctgggngtgcgtcttctttatttagtagtagtgtagtactatctcgcacgacgtcgtggacgggcgtactcacactctcagagactactacaacgacacgtcttcgttacttactaatacgaacacgacgtagagacgacgacgtacgacgaccggtacgtacgttacgttacgtgtcggtacggaggaggtacggtacgggacccggtaccgtaaccgtaaccgtacgtaacgtacgtacggtacggtacggtacggggaccggaacggaaccg

SEQ ID NO: 381118 - DNA, 568 bp, Homo sapiens
  misc_feature: GZ8MTXP02ILC09.13.76.G10.1.454.CMB.2.raw
  modified_base (372)..(372): a, c, t, g, unknown or other
tcagtcacgtactacacgaccggtgctcgatttagtcactcatacagggggggagaggagcccagcactgggattccgaggtgtttccattcggtgatcagcactgaacacagaggactaaccatggagttttggctgagctgggttttccttgttgctattttaaaggtgcccagtgtgaggtgcagctggtggagtctggaggaggcttgatccagcctgggggtccctgagactctcctgtgcagcctctgggttcaccgtcagtcacacctacatgagcgtgggtccgccaggctccgaggggaaggggctggagtgcgtcttcttttatttatagtagtggtagtacatactccgcagactccgtgngggggccattcaccatctccagagacaattcaaagacacgctgtttctacaaatgaacagcctgagagccgatgaccgacggccgtgtacttactggtgcgagagagtcgggggacccaaacggtaaccgttaacgtaccgacgtaacgtcggaacggttcggtacgggggacccaaacggggacccgtaaacggg

SEQ ID NO: 381119 - DNA, 538 bp, Homo sapiens
  misc_feature: GZ8MTXP02HWBR3.13.76.G10.1.454.CMB.2.raw
  modified_base (387)..(387): a, c, t, g, unknown or other
  modified_base (430)..(430): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagctgggtccgcaggctccgaggggaaggggctgggagtgcgtcttcttttatttagtagtagtgtagtacatactcgcagctcgtgacgggcctatcactnctcagagactaatccaaagacagcttgttctacaaatgaaacncgctgagacgccgatcgacacgggcctagtattacgtgtgacgagagacgtcggggaccccaggtaaacgttaacctacgacttagcggacgtcgtacgggggaaccg

SEQ ID NO: 381120 - DNA, 532 bp, Homo sapiens
  misc_feature: GZ8MTXP02GH4GV.13.76.G10.1.454.CMB.2.raw
  modified_base (368)..(368): a, c, t, g, unknown or other
  modified_base (432)..(432): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagctgggtccgccaggctccgagggaaggggctggagtgcgtctcttttattatagtgtggtatacatactccgcagctccgnggacggggccgattcacatctccagagacaattccaaagacacgctgtttctacaaatgaaacngcctgagagccgatgacacggctagtactacgtgtgcgagagacgtcgggggacccaggaacgttaacgacgctacgtggaccgtcggtacgggacccgg

SEQ ID NO: 381121 - DNA, 521 bp, Homo sapiens
  misc_feature: GZ8MTXP02IFYH4.13.76.G10.1.454.CMB.2.raw
  modified_base (244)..(244): a, c, t, g, unknown or other
  modified_base (249)..(249): a, c, t, g, unknown or other
  modified_base (430)..(430): a, c, t, g, unknown or other
  modified_base (441)..(441): a, c, t, g, unknown or other
  modified_base (461)..(461): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggcagataaatatacttccnggtancagcagaagtcaggccagtcccctgtgctggtcatctatcaagatgccaagccggccctgaggggactcccccgtagacgcgtattctctggcctccaaactcgtagggaaacctcgaagttccacttcacgaccatcgacgccgggacccaggctagtggatgaggctgtaactattacngtcgaggtcgnggacagcagcacgtcgccgntacgcgtcgttacggaatcgggaactacggcgtacccgtacgtaacgtccaacgaccccg

SEQ ID NO: 381122 - DNA, 505 bp, Homo sapiens
  misc_feature: GZ8MTXP02IL9E6.13.76.G10.1.454.CMB.2.raw
  modified_base (236)..(236): a, c, t, g, unknown or other
  modified_base (334)..(334): a, c, t, g, unknown or other
  modified_base (451)..(451): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataatggcagataaatntacttcctggtatcagcagaagtcaggccagtcccctgtgctggtcatctatcaagatgccaagccggccctgagggactcccccgtgacgcgattcnctggctccaactcgtgggaacctcgacgcccactctgaccatcagccgggacccaggctagtggatggaggctagacttattactgtcgaggcgtgggacagcagcactcgcccgtntatcgtcttacggacttgggaaccacggtcacccgtctaacggtcacgtacccg

SEQ ID NO: 381123 - DNA, 554 bp, Homo sapiens
  misc_feature: GZ8MTXP02FSNTI.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctggggttttccttgttgctattttaaaaggtgcccagtgtgaggtgcagctggtggagtctggaggaggcttgatccagcctggggggtcccctgagactctcctgtgcagcctctggggttcaccgtcagtcacacctacatgagctggggtcccgccaggctccgaggggaaggggctggagtgcgtctctttttatttatagtagtggtagtaccatactcgcagactccgtgaggggccattcaccatctccagagacaattccaagaacacgctgtttcttcaaatgaaacagcctgagagccgatcgaacacggccgtgtattacgtgtgcgagagacgtcgggggccccaacggaaacgttactaacggctaagtcggacgtcgtacgggggaccaaggggaacccg

SEQ ID NO: 381124 - DNA, 596 bp, Homo sapiens
  misc_feature: GZ8MTXP02G1XBD.13.76.G10.1.454.CMB.2.raw
  modified_base (376)..(376): a, c, t, g, unknown or other
  modified_base (410)..(410): a, c, t, g, unknown or other
  modified_base (457)..(457): a, c, t, g, unknown or other
  modified_base (502)..(502): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtctgggaggaggcttgatccagccgtgggggtccctgagactctcctgtgcagcctcgtcgggttcaccgtcagtcacacctacatgagcgtcgggtcccgccgaggcctccggaaggggaacggggctgggagtgtcgttcttcttttattatagtagtggtagtaccatactcgnacgctcgtggacgggctatcaccatctaccaganaactaataccaaagaaccacgtcttagtttactaacaaatcgaaacngacctagagacgaccgatcgaaccgcggtaccgtagttattacgngtcgacggagaggacggtccggggacccaacggtaaccttacgtacgtaacgtagttacgggacgttcgggacggggaaccgtaacgggacccg

SEQ ID NO: 381125 - DNA, 544 bp, Homo sapiens
  misc_feature: GZ8MTXP02GX9SG.13.76.G10.1.454.CMB.2.raw
  modified_base (434)..(434): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctggggttttccttgttgctattttaaaaggtgcccagtgtgaggtgcagctggtggagtctggaggaggcttgatccagcctggggggtccctgagactctcctgtgcagcctctggggttcaccgtcagtcacacctacatgagctgggtccgccaggctccgagggaggggctggagtgcgtctctttttattatagtagtggtagtaccatactccgcagactccgtggacggggccattcaccatctccagagacaattccaagtaacacgctgtttctcaaatgaaacngcctgagagccgatcgacacggcgtgtattacgtgtgacgagagacgtcggggacccacggaacgttctaacgctagtcggacgtcgtacgggggacctaacgggacccg

SEQ ID NO: 381126 - DNA, 570 bp, Homo sapiens
  misc_feature: GZ8MTXP02GGXTC.13.76.G10.1.454.CMB.2.raw
  modified_base (265)..(265): a, c, t, g, unknown or other
  modified_base (291)..(291): a, c, t, g, unknown or other
  modified_base (310)..(310): a, c, t, g, unknown or other
  modified_base (352)..(352): a, c, t, g, unknown or other
  modified_base (393)..(393): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcgtggtttcgtgtaggctatttaaaaggtgccagtgtgaggtgcagctggtggagtctggaggaggcttgatccagcctggggggtccctgagactctcctgtgcagctctggtcacgtcagtcncactacatgagctggtccgccaggcnccagggaaggggcgtgggngtgtcgtcttctttatttatagtagtagtagtactatactcncacgacgtcgtcggacgggcgtactacaccactctacaganaacaactaacaacgaacacgtacttcgttacttactaatagaacacgacgtagagacgacgacgacgacgacggtacgtacgtattacgtgtgacgagaggacggacggaccgaaccgtaaccgtaacgtacgtaacgtacgtacggtacggtacggtacggaccggaacggaaccg

SEQ ID NO: 381127 - DNA, 586 bp, Homo sapiens
  misc_feature: GZ8MTXP02GALR0.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggtcaccgtcagtcacacctacatgagctgggtccgccaggcctccgagggaaggggctggagtgcgtctcttttattatagtagtggtagtaccatacctcgcagactccgtggaggggccagttccaccatctccagagacaatccaaagaacacgctgttcttacaaaatgaaactagcctaggaagagtcccgatcggaaccgacggtcccgtagttaacttaacgtgtagcgaaggagtacggtcgggggacccaacgtaaaccgttactacgaacgttacgtcggggaaccgtcggtacgggggacccaaggggtaaccccgg

SEQ ID NO: 381128 - DNA, 572 bp, Homo sapiens
  misc_feature: GZ8MTXP02JT7EZ.13.76.G10.1.454.CMB.2.raw
  modified_base (313)..(313): a, c, t, g, unknown or other
tcagtcacgtactacacgaccggtgctcgatttagtcactcatacagggggggagaggagcccagcactgggattccgaggtatttccattcggtgatcagcactgaacacagaggactcaccatggagttttggctgagctgggttttccttattactattttaaaaggtgtccagtgtgaggtgcagttggtggagtctggaggaggcttggtccaggccgggggggtccctgagactctcatgtgcggcctctgggctcaccgtcaacaccaactacatgagctgggtcccgccaggctccgagggaagnggccggagtgggtctcagttatttatggtcgacggtgccacattcaccgcagactccgtgaggggccgttcaccatctccagacgacaattccaaagaacacgtgtatcttacaaatgaacgactagagagtcgaggacgacggcctcgtatacgtgtgacgaagatgcagacggacgggaccccgtaaggtcggggccgtgggtcgggtacgggttcgttcgtttggacttcggcgtcgggggccgacgggtacccgg

SEQ ID NO: 381129 - DNA, 591 bp, Homo sapiens
  misc_feature: GZ8MTXP02GX9AI.13.76.G10.1.454.CMB.2.raw
  modified_base (363)..(363): a, c, t, g, unknown or other
  modified_base (446)..(446): a, c, t, g, unknown or other
  modified_base (459)..(459): a, c, t, g, unknown or other
  modified_base (504)..(504): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgccaggcctccgaggggaggggctggagtgcgtcttcttttattatagtagtggtagtaccatactccgnagacctccgtggacggggctattccaccatcctacccaagagaacctaattacccaaagaaaccacgtccttgttttacctanaaaatgaaaaccncgtactagagacgaccgagtcgaccgacggtcgtagttactacgngtcgacggagacggtacggtccggggaacccaacggtaaccgttacacgtaagtacgtacggacgtcggacggggaccgaacgggcc

SEQ ID NO: 381130 - DNA, 556 bp, Homo sapiens
  misc_feature: GZ8MTXP02G6HBV.13.76.G10.1.454.CMB.2.raw
  modified_base (294)..(294): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggggttcaccgtcagtcacacctacatgagctgggtccnccaggcctccgagggaaggactggagtgcgtctcttttatttatagtagtggtagtacatactccgcagactccgtgacggggcattcaccatctccagagacaattccaagaacacgctgtttctacaaatgaaacagcctagagagaccgatcgaacgacggccgtagtattacgtgtgacgagagacgtcgggggacccacggaaccgttaacgacgaactagtcggacgtcgtacggggacccgaacgggaaccccgg

SEQ ID NO: 381131 - DNA, 534 bp, Homo sapiens
  misc_feature: GZ8MTXP02JP6PW.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggggttcaccgtcagtcacacctacatgagctgggtccgccaggctccagggaggggctggagtgcgtctcttttattatagtagtggtagtacatactcgcagactccgtgaggggccgattcaccatctccagagacaattccaagaacacgctgtttctcaaatgaaacagcctagagagccgaatgacacggcgtgtattactgtgcgagagagtcgggggcccacgaacgttacctacggctaagtcggacgtcgtcggggaccaaggggacccg

SEQ ID NO: 381132 - DNA, 585 bp, Homo sapiens
  misc_feature: GZ8MTXP02GVS5M.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgccaggcctccgaggggaaggggctggagtgcgtcttcttttatttatagtagtggtagtacatactccgcagactccgtggagggggccgattccaccatcctcccagagacaaattcccaaagaaccacgcttgtttaccttacaaaatcgaaacaggccctaggagacgaccgatcgaacgtacgggccgtagtattacgtgtcgacggagagacgtcgggggaccccaacgtaaccgttactacgcgtagtacgggacgtcggtacgggggccaaaacggggtccccg

SEQ ID NO: 381133 - DNA, 564 bp, Homo sapiens
  misc_feature: GZ8MTXP02IYGG0.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgaggggaaggggctggagtgcgtcttcttttatttatagtagtggtagtacatactcgcagactccgtggacggggccgattccaccatctccagagacaattaccaaagaacacgcttgtttctacaaatgaaacagcctagagacgccgatcgacgacggccgtagtacttaacgtgtagcgagaggacgtcgggggacccacggaaacgttactacgaacgtacgtcggacgtcgtacgggggaccgaaacgggacccg

SEQ ID NO: 381134 - DNA, 512 bp, Homo sapiens
  misc_feature: GZ8MTXP02HOHZ7.13.76.G10.1.454.CMB.2.raw
  modified_base (423)..(423): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataatggcagataaatatacttcctggtatcagcagaagtcaggccagtcccctgtgctggtcatctatcaagatgccaagccggccctcgagggactccccccgtgacgcgattctctggcctccaaactctagggaacctcgaagcccactctagaccatcacgcgggacccaggctagtcggatgaggctgtactattacngtcaggcgtgggacagcgagcactcgcccgcttatcgtcttacgggaactcgggaaccaggtccaccggtacctaagccacgaaccccg

SEQ ID NO: 381135 - DNA, 522 bp, Homo sapiens
  misc_feature: GZ8MTXP02JR5JQ.13.76.G10.1.454.CMB.2.raw
  modified_base (390)..(390): a, c, t, g, unknown or other
  modified_base (432)..(432): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagcgtgggtttccttgttagctatttaaaaggtgcccagtgtgaggtgcagctggtggagtctggaggaggcttgatccagcctgggggtccctgagactctcctgtgcagcctctgggttcaccgtcagtcacacctacatgagctggtccgccaggctccgagggaagggctggagtgcgtctctttattatagtagtggtagtacatactcgcagctccgtggaggggccattcaccatctcaganacaatccaaagacacgctgtttactacaaaatgaacacgacngagagaccgagacgacgacgcgtgtatacgtcgtgagagagacgcggaccgacgaacgtaacgtacgactacgtagacgtcggacggacg

SEQ ID NO: 381136 - DNA, 516 bp, Homo sapiens
  misc_feature: GZ8MTXP02G7LXJ.13.76.G10.1.454.CMB.2.raw
  modified_base (291)..(291): a, c, t, g, unknown or other
  modified_base (396)..(396): a, c, t, g, unknown or other
  modified_base (419)..(419): a, c, t, g, unknown or other
  modified_base (422)..(422): a, c, t, g, unknown or other
  modified_base (458)..(458): a, c, t, g, unknown or other
  modified_base (470)..(470): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggattcacctttagagctattggatgagctgggtccncaggctccgagggaggggctggagtgggtggccaacataaagcaagtggaagtgagaaatactatgtaggactcgtgtgaagggccgtattcaccatctccaganacaacgccaaagactcactgtanctnacaaatgaaacagcctgacgagccgaggactacggntgtactattacngtgcgagagacgttgggggacgaaggtatgcagtggacacggttac

SEQ ID NO: 381137 - DNA, 556 bp, Homo sapiens
  misc_feature: GZ8MTXP02HWL1P.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgaggggaaggggctggagtgcgtcttctttttatttatagttagtggttagtaccatactccgcagacctcgtgagggggccgattcaccatctcccagagacaattccaaagaacacgctgtttctcaaatgaaacagcctgagagccggatgacacggccgtgttattactgtgcgagagagtcgggggacccacggaacgttaccgtacgccgtagtcggacgtcgtacgggggaccgaacggggaacccg

SEQ ID NO: 381138 - DNA, 539 bp, Homo sapiens
  misc_feature: GZ8MTXP02GNJFR.13.76.G10.1.454.CMB.2.raw
  modified_base (288)..(288): a, c, t, g, unknown or other
  modified_base (356)..(356): a, c, t, g, unknown or other
  modified_base (388)..(388): a, c, t, g, unknown or other
  modified_base (415)..(415): a, c, t, g, unknown or other
  modified_base (423)..(423): a, c, t, g, unknown or other
  modified_base (439)..(439): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcgtggtttcctgttgctatttaaagtgccagtgtgaggtgcagctggtggagtctggaggaggcttgatccagccgtggggggtccctgagactctcctgtgcagcctctgggttcaccgtcagtcacacctacatgagctgggtccnccaggctccgaggggaggggctggagtgcgtcttcttttattagtagtagtggtataccatactccgnagactccgtggacgggcattcacatcacaganacataccaagtacacgctgttactaanaatgaacngcgtagagacgacganacgacgcggtacgtgtatacgtgtgacgaggagacggccgggacctacgtaaccgttacgacgtcgtacgtcggtacgtcggacgggaccgacgggaccg

SEQ ID NO: 381139 - DNA, 521 bp, Homo sapiens
  misc_feature: GZ8MTXP02HOIEO.13.76.G10.1.454.CMB.2.raw
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatactctggtatcagcagaagtcaggccagtcccctgtgctggtcatctatcaagatgaccaagccggccctgagggactccccccgtgagcgatttcacgtggcctccaaactcgtcgggaaactcaagcccactctcgaccatccgagacgggacccagggctaagtggatggagctagtactagttactgtacgaggtcgtagggcagcagcactcgccgtctatcgtcgttacggaactggggaaccagggtccaccggtcctaacgtccgacgaaccccg

SEQ ID NO: 381140 - DNA, 536 bp, Homo sapiens
  misc_feature: GZ8MTXP02H6PUT.13.76.G10.1.454.CMB.2.raw
  modified_base (254)..(254): a, c, t, g, unknown or other
  modified_base (291)..(291): a, c, t, g, unknown or other
  modified_base (355)..(355): a, c, t, g, unknown or other
  modified_base (375)..(375): a, c, t, g, unknown or other
  modified_base (381)..(381): a, c, t, g, unknown or other
  modified_base (399)..(399): a, c, t, g, unknown or other
  modified_base (410)..(410): a, c, t, g, unknown or other
  modified_base (412)..(412): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcgtgggttttctgttgctattttaaaaggtgcccagtgtgaggtgcagctggtggagtctgggaggaggcttgatccagccgtggggggtccctgagactctctgtgcagcctntgggttcaccgtcagtcacactacatgagctgggccnccaggctccgagggagggctggagtgcgtcttctttttattatagtagtggtatacatactcgnagctcgtgagggcatcacanctcagnacatccaagacacgcttnttctactaaananacacgcgagagacgacgagacgacgacgtcgtacgtagttacgtgtgacgagagacgacggaccgacgtaacgttacgtacgtaacgtacgtacggtacggtacggtacggacggaacggaccg

SEQ ID NO: 381141 - DNA, 513 bp, Homo sapiens
  misc_feature: GZ8MTXP02HMJZ5.13.76.G10.1.454.CMB.2.raw
  modified_base (235)..(235): a, c, t, g, unknown or other
  modified_base (292)..(292): a, c, t, g, unknown or other
  modified_base (368)..(368): a, c, t, g, unknown or other
  modified_base (449)..(449): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatntacttcctggtatcagcagaagtcaggccagtcccctgtgctggtcatctatcaagntgccaagcggccctcgagggactcccccgtgacgcgattctctggcctccaaactctgggaacctcagcccactcngaccatcagcgggaccctaggctagtggatgaggctgtactattacgtgtcgaggcgtagggacagcagcacgtcggcccnctagtcgtcgttacggaactcggggaacctaacgggtccaccgtacgtaacgccaacgaccccg

SEQ ID NO: 381142 - DNA, 567 bp, Homo sapiens
  misc_feature: GZ8MTXP02HO7IL.13.76.G10.1.454.CMB.2.raw
  modified_base (293)..(293): a, c, t, g, unknown or other
  modified_base (400)..(400): a, c, t, g, unknown or other
  modified_base (411)..(411): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccnccaggcctccgaggggaaggggctggagtgcgttcttcttttatttatagtagtggtagtacatacctccgcagacttccgtggaggggccattcaccatctcaganacaataccaanaacacgtctgtttctacaaatgaaactacgcctagagagccgatgacacggccgtgtattactgtgcgaggagacgtcggggacccaacggtaaacgttaccgtaacgtaaccgttaagtcggaccgtcggtacggggccgaaacggggaaccccg

SEQ ID NO: 381143 - DNA, 641 bp, Homo sapiens
  misc_feature: GZ8MTXP02FSHN3.13.76.G10.1.454.CMB.2.raw
  modified_base (248)..(248): a, c, t, g, unknown or other
  modified_base (332)..(332): a, c, t, g, unknown or other
  modified_base (462)..(462): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtncagcctctgggtcaccgtcagtcacacctacatgagcgtgggtcccgccaggctccggaggggaggggctggagtgcgttcttntttttatttatagtagtggtagtaccatacctcgcagacctcggtggacggggccgattccacctatcctccaagacaaacaattacccaaagaaccctacgtcttagtttacttacaaaatcgaaaacncgtacctaggacgacgaccgtatacggaccgtaccgggtaccgtttagttaacgttacgtggtacgaacggaggaggtacggtaccgggggaacccctaaacggttaaaccgttaacgtaaccgtaacgttaacggtacgggaccggttcggtaccgggggacccgaaacggggacccg

SEQ ID NO: 381144 - DNA, 488 bp, Homo sapiens
  misc_feature: GZ8MTXP02JDGI7.13.76.G10.1.454.CMB.2.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagccggccctcagggactccccctgagcgattctctggctccaactctgggaactcagccactctgaccatcagcgggacccaggctatggatgaggctgactattactgtcaggcgtgggacagcagcactgcccgctatcgtcgttacggaactgggaaccaaggtcaccggtctaacgcaggacccg

SEQ ID NO: 381145 - DNA, 550 bp, Homo sapiens
  misc_feature: GZ8MTXP02ID8TG.13.76.G10.1.454.CMB.2.raw
  modified_base (236)..(236): a, c, t, g, unknown or other
  modified_base (246)..(246): a, c, t, g, unknown or other
  modified_base (287)..(287): a, c, t, g, unknown or other
  modified_base (292)..(292): a, c, t, g, unknown or other
  modified_base (320)..(320): a, c, t, g, unknown or other
  modified_base (365)..(365): a, c, t, g, unknown or other
  modified_base (406)..(406): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtcgtccgtcgtccccaggacagacagccagcatcacctgctctaggaaatatggcagataaatntactctgtancagcagaagtcacggccacgtcccctgtgctggtcatctancaagntcgaccagccgccctgaggactccccgngacgcgtattctcgtcgtcctacccaatcgtacggacctcgaacnccctactcgacacacgacgacggaccggaccgagtactagngagtaggacgtctagtacttagtacgtagtacgaggtcggtaggacagacgtacgcgtaccgtcgccgtattacgtcgttaccgtacggtaacggtaccggtaaccgtacgtaccgtaccgtaccgtacgaccgacccgacccg

SEQ ID NO: 381146 - DNA, 604 bp, Homo sapiens
  misc_feature: GZ8MTXP02HXMNZ.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtggttcaccgtcagtcacacctacatgagcgtcgggtcccgccgaggcctccgaaggggaacggggctgggagtgcgttcttcttttatttatagtagtgtagtacatactcgcagctccgtgacgggccatcacatctccagacgacaattccaaagaaccacgcttgttttactacgaaaatgaaacacgtacctagaagacgacccgaagtacggaaccgaccggggtcccgttagttaactttacgtggttacggcgaaaggaggaacggtccgggggacccctaaacggtaaaccggttaacgtacgtacttagacggccgttacggtacgggggaacccg

SEQ ID NO: 381147 - DNA, 540 bp, Homo sapiens
  misc_feature: GZ8MTXP02FX6I6.13.76.G10.1.454.CMB.2.raw
  modified_base (293)..(293): a, c, t, g, unknown or other
  modified_base (386)..(386): a, c, t, g, unknown or other
  modified_base (432)..(432): a, c, t, g, unknown or other
  modified_base (512)..(512): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagcctggggggtccctgagactctcctgtgcagcctctgggtcaccgtcagtcacacctacatgagctgggtccnccaggctccgagggaggggctggagtgcgtctcttttattatagtagtgtagtacatactcgcagacctcgtgacggggccgattcaccatcnccagagacattacccaagaacacgtctgtttctacaaaatgaaacngcctagagagccgatcgacgacggccgtagtattacgtgtgcgagagagtcggggacccacgtaacgtctaacgcgtagnggtaccgtgtacggggaccaaggacccg

SEQ ID NO: 381148 - DNA, 571 bp, Homo sapiens
  misc_feature: GZ8MTXP02FX5ZT.13.76.G10.1.454.CMB.2.raw
  modified_base (202)..(202): a, c, t, g, unknown or other
  modified_base (239)..(239): a, c, t, g, unknown or other
  modified_base (251)..(251): a, c, t, g, unknown or other
  modified_base (269)..(269): a, c, t, g, unknown or other
  modified_base (294)..(294): a, c, t, g, unknown or other
  modified_base (296)..(296): a, c, t, g, unknown or other
  modified_base (298)..(298): a, c, t, g, unknown or other
  modified_base (309)..(309): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcgtggtttcgtgtaggctatttaaaagtgccagtgtgagtgcagctggtggagtctggaggngtctgatcagcgtcggggtccgtgagctctctgtgcngctcgtcggtcncgtcagtcacacacatgngcgtcggccgcgcgcgcgaggaggngngngtgtcgtcttntttattatagtagtagtagtactatactcgcacgtacgtcgtcggacgggtcgtactacactactctacacgaacgaactaactaacaacgaacgtacgtcttcgtttacttaactaacgtacgaacgacgtacgtacgagacgacgacgtacgacgacgtcgtagtagttacgtgtgtagtagtagtacggtacggaccggtaaccgtaacgtacgtacgtaacgtacgtacggtacggtacggtacggacggaacggacg

SEQ ID NO: 381149 - DNA, 578 bp, Homo sapiens
  misc_feature: GZ8MTXP02IJ6U6.13.76.G10.1.454.CMB.2.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttctggtatcagcagagtcaggccagtcccctgtgctggtcatctatcaagatgaccaagccggccctagagggactcccccgtgacgcgtacttctcgtggccttccaaacttcgtagggaacctcgaacgtcccaactcgtacgaccatcgaacgccgggacccaggctagtggataggacggtctacggtacttattacgtgtcgagggcgtagggacaggcacgacgtacgtcggacccgtcttaacgtcggttaccgttacgggtaacgtaccggggaaacccgtaacgggtacccgtaacccggtaccgttaacgtacccgaacggaacccccg

SEQ ID NO: 381150 - DNA, 547 bp, Homo sapiens
  misc_feature: GZ8MTXP02JRZIC.13.76.G10.1.454.CMB.2.raw
  modified_base (439)..(439): a, c, t, g, unknown or other
  modified_base (447)..(447): a, c, t, g, unknown or other
  modified_base (477)..(477): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgccaggctccgaggggaaggggctggagtgcgtcttcttttattatagtagtggtagtaccatactcgcagactccgtggacggggccgattccacactctcccagagacaattccaaagaacacgctgtttctacaaatgaaacngcctgagngaccgatcgacacggccgtgtattacgtgngtcgagagagtcgggacccacgaacgttacacgcgtatcgggacgtcggtcggggaccaacggggacccg

SEQ ID NO: 381151 - DNA, 626 bp, Homo sapiens
  misc_feature: GZ8MTXP02HG84W.13.76.G10.1.454.CMB.2.raw
  modified_base (194)..(194): a, c, t, g, unknown or other
  modified_base (207)..(207): a, c, t, g, unknown or other
  modified_base (243)..(243): a, c, t, g, unknown or other
  modified_base (319)..(319): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcggtggtttcgtgtaggcgtatttaaaagtgccagtgtgagtgcagctggtggngtgtggaggaggntgatcagcggtcggggtccgtgagactctctgtgcncgcctcgtcggttcgtaccgtcacgtcacacctacatgacgcgtcggtccgcgacgcgcggagggacggcggtggngtgtcgttctttcttttatttagttagtagtagtagtactactacgtcgacgacgacgtcggtcggacgggtacgtactactacctactctacacgacgaactaactacgaacgaacgtacgtacttacttacttactaactacgtaacgacgtacgtacgtagacgacgtacgtacgacgacggtacgtacgttacgttagtagtacggacggacggaggtacggtacgggacccgtaaccggtaaccgttaacgtacgtaacgtacgtacggtacggtacggtacgggtaccggaacggtaacgg

SEQ ID NO: 381152 - DNA, 566 bp, Homo sapiens
  misc_feature: GZ8MTXP02HN8AV.13.76.G10.1.454.CMB.2.raw
  modified_base (297)..(297): a, c, t, g, unknown or other
  modified_base (430)..(430): a, c, t, g, unknown or other
  modified_base (441)..(441): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagctgggtccnccaggctccgaggggaagggctgggagtgcgtcttctttatttatagtagtggtagtacatactccgcagctccgtgacgggggccattcactatctccagagaacaattccaaagacacgcttagtttctanaaaatgaaacngtcctagagacgccgaatcgacgcggaccgttgtaacttactggtagacgagaggaacgtcgggggacccaaggtaaccgttaacgtacgtacgtagtacggaccgttcggtacggggaacccgg

SEQ ID NO: 381153 - DNA, 536 bp, Homo sapiens
  misc_feature: GZ8MTXP02JOVPP.13.76.G10.1.454.CMB.2.raw
  modified_base (234)..(234): a, c, t, g, unknown or other
  modified_base (469)..(469): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataatggcagataaatntacttcctggtatcagcagaagtcaggccagtcccctgtgctggtcatctatcaagatcgaccaagccggccctcgagggactccccccgtgacgtcgattctcgtggcctaccaactcgtagggaactcgacgcccacgtctacgaccagtcacggccggacccaggcctagtggatggagtctagacttagttacgtgtcgaggcggtagggacagcagcacgtcggcccgtntacgtcgtcgttaccggaacgtcgggaaccgtaacggtccaccggtactaacgtccgaacgaccccg

SEQ ID NO: 381154 - DNA, 555 bp, Homo sapiens
  misc_feature: GZ8MTXP02I1MFU.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggtttccttgttgctatttaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgaggggaaggggctggagtgcgtcttcttttatttatagtagtggtagtacatactcgcagctccgtgaggggccattcaccatcctcagagaacaattacccaaagaccacgtcttgttctacaaatgaacagcctgagacgccgatcgacgacggccgttagtacttacgtcgtgacgaggagacgtcgggggacccacggtaaaccgttaacgtaaccggcttagtcggtacgttcggacggggaacccgg

SEQ ID NO: 381155 - DNA, 655 bp, Homo sapiens
  misc_feature: GZ8MTXP02HQTAK.13.76.G10.1.454.CMB.2.raw
  modified_base (296)..(296): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtggggttcaccgtcagtcacacctacatgagctgggtccnccgaggcctccgaggggaggggctggagtgcgtctttcttttatttatagtagtggtagtacatacctcgcagacctccggtggacgggggccgtattccgaacctatcctcccgaagacgaaacctaaattacccgaaaagtaacccacgtcttagttttccttacaaaagttcgaaactacgcccttaggaggacgcccggaatcggaaccgtaccgggtccgttagttactttaccgtggtcggacggaaggaggacggtccgggggaccccaaaccgggtaaccgtttaaccgacggtaaccgttaggtacggggtaccggttcggtcgggggaacccggtaaaggggtaacccg

SEQ ID NO: 381156 - DNA, 523 bp, Homo sapiens
  misc_feature: GZ8MTXP02FQI3J.13.76.G10.1.454.CMB.2.raw
  modified_base (235)..(235): a, c, t, g, unknown or other
  modified_base (334)..(334): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatntacttcctggtatcagcagaagtcaggccagtcccctgtgctggtcatctatcaagatgccaagccggccctcaggggactcccccgtgacgcgattcnctggcctccaactcgtagggaactcagccactctgaccatcagcggacccaggctatggatgaggctgactattactgtcaggcgtgggacaggcagcactcgcccgctagtcgtcgttaccgggaacttcgggggaacccaaacggggtcctaacccggtaccttaaaacgtccgaacgtaacccccg

SEQ ID NO: 381157 - DNA, 551 bp, Homo sapiens
  misc_feature: GZ8MTXP02IHRQC.13.76.G10.1.454.CMB.2.raw
  modified_base (298)..(298): a, c, t, g, unknown or other
  modified_base (391)..(391): a, c, t, g, unknown or other
  modified_base (407)..(407): a, c, t, g, unknown or other
  modified_base (432)..(432): a, c, t, g, unknown or other
  modified_base (453)..(453): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctatttttaaaaggtgcccagtgtgaggtgcagctggtggagtctggaggaggcttgatccagcctgggggggtcccctgagactctcctgtgcagcctctggggttcaccgtcagtcacacctacatgagctgggtcccnccaggctccgagggaagggctggagtgcgtcttctttttaattatagtagtggtataccatactcgcagactcgtggagggcgatcaccatcncagagacaatacaaanaaacacgctgtttcttactaaatanaaacaagacctgagagacgangacgacggcgtgtattactgtgcgagagagtacgggaccgaccgaaacgtaactaacgaacgtacgtacggtacgtacgtcgggacggaacggaaccg

SEQ ID NO: 381158 - DNA, 572 bp, Homo sapiens
  misc_feature: GZ8MTXP02J1KC3.13.76.G10.1.454.CMB.2.raw
  modified_base (445)..(445): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgccaggctccgagggaggggctggagtgcgtcttcttttattatagtagtggtagtacatactccgcagacctcgtggaggggccgattcaccatcctcccgagacgaacaacttcccaaagaacctacgtctgtttactacaaatgaaacngcctgagagccgatcgacgacggtccgtgtattacgtgtgacggaggagacggtacggggacccctaacgtaaaccgttacgtacgcgtacgtacggacggtcgtacgggggaccaagggggacccc

SEQ ID NO: 381159 - DNA, 607 bp, Homo sapiens
  misc_feature: GZ8MTXP02HFBBZ.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggttcaccgtcagtcacacctacatgagctgggtccgccaggctccgaagggaggggctggagtgcgtcttcttttattatagtagtggtagtaccatactccgcagacctccggtggacgggggccgtattccgacctatcctcccaagacgaacctaaattacccaaagaaccacgtcttgtttactacaaaatgaaacagcctaggagacgaccgatcgaaccgacgggtccgtagttaacttacgtggtcgacggaagaggacggtcgggggacccctaacggtaaaccgttacgaacgcttaaggtcgggtaccgttcggcgggggaaccaacgggggaacccg

SEQ ID NO: 381160 - DNA, 631 bp, Homo sapiens
  misc_feature: GZ8MTXP02JX6YR.13.76.G10.1.454.CMB.2.raw
  modified_base (227)..(227): a, c, t, g, unknown or other
  modified_base (239)..(240): a, c, t, g, unknown or other
  modified_base (253)..(253): a, c, t, g, unknown or other
tcagtcacgtactacacgaccggtgctcgatttagtcactcatacaggggggattccgaggtgtttccattcggtgatcagcactgaacacagaggactcaccatggagttttggctgagcgtggtttcgtgtagctatttaaagtgccagtgtgaggtgcagctggtggagtctggaggaggcttgatccagcctgggggtccctgagactctcctgtgcagcctntggttcaccgtnntcacactacatgngcgtcggtccgcgacgcgtcgagggagggcgtggtagtgtcgtcttctttattagtagtagtgtagtactactactcgcgacgcgtcgtcggacgggcgtactcacactctcacgaacgactaactaccaacgaacgacgtcttacgtttacttactaaactacgtaacgacgacgtacgacgacgacgacgacgaccgaccggtacgtacgttacgttacgtagtcggacggacggacggtacggtaccgggtacccgtaaccggtaaaccgttaccgtacgtacgtacggtacggtacggtaccggtacgggaccggaaccgggtaacccggtacccggtacccgtacccgtaccgtcccgtaccgaccgtacccg

SEQ ID NO: 381161 - DNA, 579 bp, Homo sapiens
  misc_feature: GZ8MTXP02HDJGM.13.76.G10.1.454.CMB.2.raw
  modified_base (447)..(447): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtgggtcccgccaggcctccgaggggaaggggctggagtgcgtcttcttttattatagtagtggtataccatactcgcagactcgtggacggggccagttccaccatcctaccagacgactaaacttccaaagacacgtctgtttactacaaatgaaacngcctgagacgccgatcgacgacggtccgtagttatacgtgtcgacgagagtacggtcgggggacccctaacggtaaccgttacaccggcttagtacgggacgttcggacgggggaccaaacgggggtccccg

SEQ ID NO: 381162 - DNA, 567 bp, Homo sapiens
  misc_feature: GZ8MTXP02F5CNU.13.76.G10.1.454.CMB.2.raw
  modified_base (293)..(293): a, c, t, g, unknown or other
  modified_base (401)..(401): a, c, t, g, unknown or other
  modified_base (430)..(430): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggtcaccgtcagtcacacctacatgagctgggtccnccaggctccgaggggaggggctggagtgcgtcttcttttatttatagtagtggtagtaccatactcgcagacctcgtggacggggcctattccaccatcctaccaganacaattccaaagaacacgcttgtttctanaaatgaaacagcctagagagaccgatcgacgacggccgtagtacttacgtgtgacggtagagacgtacggggacccaacgtaaacgttacctacgcttagtacggaccgtcggtacggggacccaacggggaacccg

SEQ ID NO: 381163 - DNA, 594 bp, Homo sapiens
  misc_feature: GZ8MTXP02FFQCF.13.76.G10.1.454.CMB.2.raw
  modified_base (241)..(241): a, c, t, g, unknown or other
  modified_base (262)..(262): a, c, t, g, unknown or other
  modified_base (274)..(274): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcggtggtttcgtgtaggctatttaaaagtgccagtgtgaggtgcagctggtggatctggaggaggcttgatccagcctggggggtccctgagctctcctgngcagctcgtggtcgaccgtcngcacacctacangagcgtcggtccgccgacggcgtccgagggaggggcgtggagtgtcgtcttctttatttatagtagtggtagtacatactcgcacgactcgtcggacgggacgtactcacactctacacgaacgaactaactacaacgaacacgtacttacgtttacttactaaactacgaaacacgacgtagagacgacgacgtacgaccgacggtaccggtacgttagttacgtgtgtagaggaggtacggtacgggacccgaaccgtaaacgtaacgtacgtaacgtacgtacggtacggtacggtacggggaccggaacggaaccg

SEQ ID NO: 381164 - DNA, 493 bp, Homo sapiens
  misc_feature: GZ8MTXP02IUMMR.13.76.G10.1.454.CMB.2.raw
  modified_base (261)..(261): a, c, t, g, unknown or other
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagcccaccctcagtgtccgtgtccccaggacagacagccagcatcacctgctctaggaaataatggcagataaatatacttctgtatcagcagaagtnaggccagtcccctgtgctggtcatctatcaagatgccaagccgccctgaggactccctgagcgattctctggctccaactctagggaactcacgccactctgaccatcgacgccgggaccaggctagtggatggagctgactatactgtcgaggcgtagggacagcacgcactcgcccgatactcgtacgttcggaactcgggacaaggtccgacgtacctaacgtcaaccg

SEQ ID NO: 381165 - DNA, 554 bp, Homo sapiens
  misc_feature: GZ8MTXP02F7D1C.13.76.G10.1.454.CMB.2.raw
  modified_base (397)..(397): a, c, t, g, unknown or other
  modified_base (413)..(413): a, c, t, g, unknown or other
tcagtcacgtactacacgaccggtgctcgatttagtcactcatacaggggggagaggagccccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggggttcaccgtcagtcacacctacatgagctgggtcccgccaggctccgagggaggggctggagtgcgtctcttttatttatagtagtggtagtaccagtactccgcagacctccgtgaggggccgattcacatctccagngacatccaagacacgntgttcttcaaatgaaacagccctaggagagccggatcgacacgggcctagtattactgtgcgaggtagagtcgggggccccaacggaacgttacctacgaacgtagtcggaccgtcgtacgggggaccaacgggggaaccc

SEQ ID NO: 381166 - DNA, 540 bp, Homo sapiens
  misc_feature: GZ8MTXP02IEUNA.13.76.G10.1.454.CMB.2.raw
  modified_base (352)..(352): a, c, t, g, unknown or other
  modified_base (392)..(392): a, c, t, g, unknown or other
  modified_base (398)..(398): a, c, t, g, unknown or other
  modified_base (416)..(416): a, c, t, g, unknown or other
  modified_base (446)..(446): a, c, t, g, unknown or other
  modified_base (473)..(473): a, c, t, g, unknown or other
  modified_base (483)..(483): a, c, t, g, unknown or other
  modified_base (502)..(502): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtttggaggaggcttgatccagccgtgggggtccctgagactctcctgtgcagcctctgggttcaccgtcagtcacacctacatgagcgtgggtccgccaggctccgaggggaagggctggagtgcgttcttcttttattatagtagtgtagtacntactccgcagactccggtgcgggggcctattccaccatcnccaganacaattcaagaacacgtnttgtttctacaaaatgaactagcctgacgngccatgaccgacggtctgtaacttcgngtgagagagngacggaccaacgtactacncgataagtcggacgtcggacgggaccgacggaccgacg

SEQ ID NO: 381167 - DNA, 553 bp, Homo sapiens
  misc_feature: GZ8MTXP02IIIH1.13.76.G10.1.454.CMB.2.raw
  modified_base (295)..(295): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctatttaaaaggtgcccagtgtgaggtgcagctggtggagtctggaggaggcttgatccagccgtgggggtccctgagactctcctgtgcagcctctgggttcaccgtcagtcacacctacatgagctgggtcccncaggctccgaggggaaggggctgggagtgcgtctctttattatagtagtggtagtacatactcgcagctccgtggacggggccattcacatctccagagacaattcccaaagaacacgtctgtttactacaaatgaaacagcctagacgagccgatcgaacgacggaccgtgtaattacgtgtagcggaagaggacgtcgggggaccctaacggaacgttaacgacgactacgtacggacgtcggtacggggaacccg

SEQ ID NO: 381168 - DNA, 482 bp, Homo sapiens
  misc_feature: GZ8MTXP02I3WJI.13.76.G10.1.454.CMB.2.raw
  modified_base (440)..(440): a, c, t, g, unknown or other
  modified_base (444)..(444): a, c, t, g, unknown or other
tcagtcacgtactacacgaccggtgctcgatttagtcactcatacagggagcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttcctggtatcagcagaagtcaggccagtccccctgtgctggtcatctatcaagatgccaagcgccctcacggggatcccctgagcgattcctctgggctccaaactctggggaactcagccactctgaccatcagccgggaccaggctagtcgatgaggctgactattactgtcaggcgtgggacagcagcactgcccntacncgtctcggactggccaaggtccacgtcctaagtcaacg

SEQ ID NO: 381169 - DNA, 544 bp, Homo sapiens
  misc_feature: GZ8MTXP02JMF20.13.76.G10.1.454.CMB.2.raw
  modified_base (385)..(385): a, c, t, g, unknown or other
  modified_base (457)..(457): a, c, t, g, unknown or other
tcagtcacgtactacacgaccggtgctcgatttagtcactcatacagggggcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctgggggtccctgagactctcctgtgcagcctctgggttcaccgtcagtcacacctacatgagctgggtccgccaggctccgaggggaagggctggagtgcgtctcttttattatagtagtggtagtacatactcccgcagactccgtgaggggccattcaccatcctccaganacaattccaaagaacacgctgtttctcaaatgaacagcctagagagccgatcgacgacggcctagtattacngtgcgagagacgtggggacccacgaaacgttactacggcctagtggaaccgtcgtacgggggaccaagggacccacgggtacacccg

SEQ ID NO: 381170 - DNA, 501 bp, Homo sapiens
  misc_feature: GZ8MTXP02JX07Y.13.76.G10.1.454.CMB.2.raw
  modified_base (309)..(309): a, c, t, g, unknown or other
  modified_base (331)..(331): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtcccccaggacagacagccagcatcacctgctctggaaataaattggcagataaatatacttcctggtatcagcagaagtcaggccagtcccctgtgctggtcatctatcaagatgccaagcggccctnaggactccccctgagcgattcnctggcctccaactcgtgggaacctcgagcccactctgaccatcagcgggacccaggctagtggatggaggctgactattactgtcgaggcggtgggacagcgagcacgtcgcccgtctatcgtcttacggactcgggaaccacggtcaccgtactacgtccacgaccccg

SEQ ID NO: 381171 - DNA, 586 bp, Homo sapiens
  misc_feature: GZ8MTXP02FSXKY.13.76.G10.1.454.CMB.2.raw
  modified_base (459)..(459): a, c, t, g, unknown or other
  modified_base (549)..(549): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttattttaaaaggtgcccagtgtgaggtgcagctggtggagtctggaggaggcttgatccagccgtggggggtccctgagactctcctgtgcagcctcgtgggtcaccgtcagtcacacctacatgagctgggtcccgccaggcctccgaggggagggctggagtgcgtcttcttttatttatagtagtggtagtaccatacctccgcagacctccgtggacggggccgtattccaccatcctccaagagactaaattcccaaagaaccacgctttgtttaccttacaaaagtgaaaacncgccctaggagacgacccgatcgaccgtaccgggcgttagttattacgtgtgcgaggagacgtcggggaccccaggtaaaccgtacacgngtagtcggacgtcgtacggggaccctaagggaccccg

SEQ ID NO: 381172 - DNA, 548 bp, Homo sapiens
  misc_feature: GZ8MTXP02IU2WE.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggggttcaccgtcagtcacacctacatgagctgggtccgccaggctccgagggaggggctggagtgcgtcttcttttattatagtagtggtagtaccatactccgcagacctccgtggaggggccattccaccatctccagagacattccaagacacgctgttctacaatgaacagcctgagagccgatcgacacggccgtgtattactgtgacgagagacgtcgggggacccacgtaaacgttacgtacgcgtagtacggtacgtcgtcgggggaccgaacggggtaacccg

SEQ ID NO: 381173 - DNA, 576 bp, Homo sapiens
  misc_feature: GZ8MTXP02HH4HH.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagctgggtccgccaggcctccgaggggaaggggctgggagtgcgttcttcttttatttatagtagtggtagtacatactcgcagccgtccgtggacggggccgtattcaccatcctccagacgacaacttaccaaagaaccacgtcttgtttactacaaatgaacacgtcctagacgacgccgatcgacgacggccgttagtacttacgtggtacgcggagagtacggtccgggggacccaacggtaacgttaacgacgtactacgtacggacgttcggacggggaacccgg

SEQ ID NO: 381174 - DNA, 548 bp, Homo sapiens
  misc_feature: GZ8MTXP02HP88T.13.76.G10.1.454.CMB.2.raw
  modified_base (331)..(331): a, c, t, g, unknown or other
  modified_base (361)..(361): a, c, t, g, unknown or other
  modified_base (387)..(387): a, c, t, g, unknown or other
  modified_base (430)..(430): a, c, t, g, unknown or other
tcagtcacgtactacacgaccggtgctcgatttagtcactcatacagggagggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtgggtccgccaggctccgaggggaaggggctggagtgcgttctnttttattatagtagtgtagtacatactcgnagactcgtgacggggcattcacatcnccagagacatccaaagacacgcttgtttctacaaatgaaaccngcctgagacgccgatcgacaccggcgttgtaatctggtagcggaggagacggtcgggaccccaacggtaactttacaacggtctaagtcggaacgttcgacgggggaccaaaccgggg

SEQ ID NO: 381175 - DNA, 554 bp, Homo sapiens
  misc_feature: GZ8MTXP02FRX3C.13.76.G10.1.454.CMB.2.raw
  modified_base (399)..(399): a, c, t, g, unknown or other
  modified_base (437)..(437): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtgggtcccgccaggcctccgaggggaggggctggagtgcgtcttcttttatttatagtagtggtagtacatacctcgcagactcgtggacgggccattcacatctccaganacaataccaaagacacgcttgtttctacaaatgaaacngcctgagagccgatcgacgacggccgttagtactacgtgtgacgagagacgtcgggggacccaacggtaacttacgtacgcgtagcgggacgtcgtcgggggacccaaggggacccg

SEQ ID NO: 381176 - DNA, 623 bp, Homo sapiens
  misc_feature: GZ8MTXP02GIJD1.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtctggaggaggcttgatccagccgtgggggtccctgagactctcctgtgcagcctcgtgggttcaccgtcagtcacacctacatgagctgggtcccgccgaggcctccgaggggaaggggctggagtgcgtcttcttttatttatagtagtggtagtaccatactcgcagactcggtgaggggcctattccaccatctaccaagacgaactaataccaaagaacacgtcttgtttactacaaaatcgaaacagacctagaagacgaccgaatacgacgaccgggtccgttagttaacttacgtgtacgacggaaggaaggtacggtaccgggggaaccccaaacgggtaaaaccgtttacgaacggccgttaaaggtcggggtaaccggtcggtacgggggaacccaaaacgggggtaaccccg

SEQ ID NO: 381177 - DNA, 524 bp, Homo sapiens
  misc_feature: GZ8MTXP02JZQM2.13.76.G10.1.454.CMB.2.raw
  modified_base (413)..(413): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggggttcaccgtcagtcacacctacatgagctgggtccgccaggctccgagggaggggctggagtgcgtctcttttattatagtagtggtagtacatactcgcagactcgtgacggggcatcacatctccagagacaatccaagacacgctgttctanaatgaacagctagagagccgatgacacggccgtgtattactgtcgcgagagacgtcggggaccacgaacgttactacgctagtcggacgtcgtcggggaccaagggacccg

SEQ ID NO: 381178 - DNA, 557 bp, Homo sapiens
  misc_feature: GZ8MTXP02H6VFG.13.76.G10.1.454.CMB.2.raw
  modified_base (438)..(438): a, c, t, g, unknown or other
  modified_base (478)..(478): a, c, t, g, unknown or other
  modified_base (484)..(484): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggggttcaccgtcagtcacacctacatgagctgggtccgccaggctccgagggaggggctggagtgcgtctctttttattatagtagtggtagtaccatactccgcagactccgtggacggggccgattcaccatctccagagacaattccaaagaacacgtctgtttactacaaatgaaacngcctgagacgccgatgacacggccgtgtatactgtgacgngaacgngtcgggggacccaacgaaccgtttacacgtcgtagtcgggaccgttggtcgggggaccgaaacggggaccccg

SEQ ID NO: 381179 - DNA, 560 bp, Homo sapiens
  misc_feature: GZ8MTXP02JDR7A.13.76.G10.1.454.CMB.2.raw
  modified_base (368)..(368): a, c, t, g, unknown or other
  modified_base (404)..(404): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtgggtccgccaggctccgaggggaaggggctggagtgcgttcttcttttatttatagttagtggtagtaccatacctccgnagacctcgtggaggggccattccaccatctccaganacataccaagacacgcttgtttactacaaatgaaacagcctgagcgaccgatcgacacgggccgtattacgttacgtgtgacgaggacgtaggtcggggacccacgtaaccgttacacgcgtagtcgggacgtcggtacgggaccgagggaccccg

SEQ ID NO: 381180 - DNA, 602 bp, Homo sapiens
  misc_feature: GZ8MTXP02G9RRL.13.76.G10.1.454.CMB.2.raw
  modified_base (296)..(296): a, c, t, g, unknown or other
  modified_base (448)..(448): a, c, t, g, unknown or other
  modified_base (461)..(461): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtggggttcaccgtcagtcacacctacatgagctgggtccnccaggctccgaggggaggggctggagtgcgtctcttttattatagtagtgtagtacatacctccgcagactccggtggacggggccgtattccgacctatcctcccagagaacctaattccaaagaaccacggtccttagtttacccttaanaaagtacgaaacncgaccgagagacgccgatacgaccgacggtcgttagtaacttacgtgacggacgaggaggacggtccggggaccctaacgtaaaccgtacctacggaacgtaggtacggtaccgtcgggaccggggaaccgaacgggcccg

SEQ ID NO: 381181 - DNA, 581 bp, Homo sapiens
  misc_feature: GZ8MTXP02JSX98.13.76.G10.1.454.CMB.2.raw
  modified_base (378)..(378): a, c, t, g, unknown or other
  modified_base (453)..(453): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctctgggttcaccgtcagtcacacctacatgagcgtgggtcccgccgaggcctccggaggggaaggggctggagtgcgtcttctttttattatagtgtggtagtaccatactccgcagacctcgngggacggggccagttccaccactcctccagacgaacaattaccaaagaacacgtcttgtttctacaaatgaaacngacctgagagccgatcgacgcggtcgtgtattcgtgtgacggagaggacgtcgggggaccctaacggtaaccgttactacgcgtagtcgggtacggtcggtacgggggacccgtaacggggaaccccg

SEQ ID NO: 381182 - DNA, 580 bp, Homo sapiens
  misc_feature: GZ8MTXP02HWG1H.13.76.G10.1.454.CMB.2.raw
  modified_base (443)..(443): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcgtgggttttccttgttgctattttaaaaggtgccagtgtgaggtgcagctggtggagtctgggaggaggcttgatccagccgtggggggtccctgagactctcctgtgcagcctcgtgggttcaccgtcagtcacacctacatgagcgtcgggtccgccaggcctccgaggggaaggggctggagtgcgtctctttttattatagtagtggtagtaccatactcgcagactcgtgaggggccattccacctatcctcccagagacaattaccaagaaccacgctgtttctacaaatcgaacancctagagagcccggatcgaccgacggtccgtagtaacttcgtgtcgcgagaggaacgtcgggggacccctaacggaaccgtttacaccggccttaagtcggggaactccggtacggggacccgaaacggggaccccg

SEQ ID NO: 381183 - DNA, 490 bp, Homo sapiens
  misc_feature: GZ8MTXP02F9B09.13.76.G10.1.454.CMB.2.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataatggcagataaatatacttcctggtatcagcagaagtcaggccagtcccctgtgctggtcatctatcaagatgccaagcggccctcaggggactcccccgtgacgcgattctctggctccaactctgggaactcagccactctgaccatcagcggacccaggctatggatgaggctggactattactgtcaggcgtgggacagcagcacgtgcccgctactgtcgttcggaacgtgggaaccaggtcaccgtacctaacgtcacgacccg

SEQ ID NO: 381184 - DNA, 559 bp, Homo sapiens
  misc_feature: GZ8MTXP02HDRMV.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggttcaccgtcagtcacacctacatgagcgtgggtccgccgaggctccgaggggaaggggctggagtgcgtcttcttttatttatagtagtggtagtaccatactcgcagactcgtggacggggcgacttcaccatctccagagaacaattcccaaagaaccacgtcttgtttactacaaatagaaacagcctagagagccgatgacgacggccgtagtatactgtgcgagaggacgcggggacccaacgtaacgttaccacgcgtagtacggacgtcgtacggggaccgaaacggacccg

SEQ ID NO: 381185 - DNA, 564 bp, Homo sapiens
  misc_feature: GZ8MTXP02HQ47B.13.76.G10.1.454.CMB.2.raw
  modified_base (292)..(292): a, c, t, g, unknown or other
  modified_base (454)..(454): a, c, t, g, unknown or other
tcagtcacgtactacacgaccggtgctcgatttagtcactcatacagggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactcccctgtgcagcctctgggttcaccgtcagtcacacctacatgagctgggtcccnccaggctccgaggggagggctggagtgcgtctctttttattatagtagtggtagtacatactccgcagactcccggtgcgggggccaattcgacccatctccagagacaattccaaagaacacgcttgttcttacaaatgaacagcctgagagccgatgacncggctgtacttactgtgcgagacggatcgggggacccaacgtaacggttaacctacggcctaagtcgggaacgttcggacggggtacccgaaacgggaccctaaccgggg

SEQ ID NO: 381186 - DNA, 559 bp, Homo sapiens
  misc_feature: GZ8MTXP02FUC37.13.76.G10.1.454.CMB.2.raw
  modified_base (295)..(295): a, c, t, g, unknown or other
  modified_base (420)..(420): a, c, t, g, unknown or other
  modified_base (448)..(448): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggttcaccgtcagtcacacctacatgagctgggtccnccaggctccgaggggaggggctggagtgcgtcttcttttatttatagtagtggtagtaccatacctcgcagacctcggtggacgggggccattccacctatcctaccagacgacaattaccaaanaacacgcttgtttactacaaatgaaacngcctgagagccgatacgacgacggcgtagtatactgtgcgagagacgtcggggacccaacgtaacgttacacgctagtcgggacgtcggacggggaccgaacgggaacccg

SEQ ID NO: 381187 - DNA, 535 bp, Homo sapiens
  misc_feature: GZ8MTXP02HW07Q.13.76.G10.1.454.CMB.2.raw
  modified_base (400)..(400): a, c, t, g, unknown or other
  modified_base (433)..(433): a, c, t, g, unknown or other
  modified_base (465)..(465): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctggggttttccttgttgctattttaaaaggtgcccagtgtgaggtgcagctggtggagtctggaggaggcttgatccagccgtggggggtccctgagactctcctgtgcagcctctggggttcaccgtcagtcacacctacatgagctgggtcccgccaggctccgagggaaggggctggagtggcgttctctttttatttatagtagtggtagtacatactccgcagactccgtgaggggccattcaccatctccaganacatcaagaacagcttgtttctcaaatgaaacngcctgagagccgatgacacggctgtattacgngtgcgagagagtggggaccccacggaactttacacgcttagcggtacgtcgtcggggacaaaggggaccc

SEQ ID NO: 381188 - DNA, 551 bp, Homo sapiens
  misc_feature: GZ8MTXP02HUVO5.13.76.G10.1.454.CMB.2.raw
  modified_base (293)..(293): a, c, t, g, unknown or other
  modified_base (338)..(338): a, c, t, g, unknown or other
  modified_base (362)..(362): a, c, t, g, unknown or other
  modified_base (386)..(386): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggttcacgtcagtcacacctacatgagctgggtccnccgaggctccgaggggaggggctggagtgcgtctctttttattanagtagtggtagtaccatactccgnagactcgtgacggggcattcacanctaccagagacaatccaaagaacacgctgtttctacaaatgaaacagcctagagagccgaatcgaacgaccggccgtaggtacttacgtgtgcgaggagacgtcggggacccacgaacgttacgtacgcgtaagtcggacgtcgcggggaccgaaacgggacccg

SEQ ID NO: 381189 - DNA, 487 bp, Homo sapiens
  misc_feature: GZ8MTXP02ICFF2.13.76.G10.1.454.CMB.2.raw
  modified_base (307)..(307): a, c, t, g, unknown or other
  modified_base (329)..(329): a, c, t, g, unknown or other
  modified_base (362)..(362): a, c, t, g, unknown or other
  modified_base (406)..(406): a, c, t, g, unknown or other
tcagtcacgtactacacgaccggtgctcgatttagtcactcatacagggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctnagggatccccctgagcgattcnctggctccaaactctgggaactcagcccactcngacccatcagcggacccaggctatggatgaggctgactattacngtcaggcgtgggacagcagcactgcccgctatcgtcttcggaactggggaaccaaggtcaccgtacctaagtcacgacccg

SEQ ID NO: 381190 - DNA, 556 bp, Homo sapiens
  misc_feature: GZ8MTXP02JUN22.13.76.G10.1.454.CMB.2.raw
  modified_base (446)..(446): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgccaggctccgaggggaaggggctggagtgcgtcttcttttatttatagtagtggtagtaccatactccgcagactccgtgacgggggccattccgaccatcctccaagagacaattaccaaagaacacgcttcgttacttacaaatgaaacngcctagagagccgatagaccacggccgtagtacttacgtgtgacgagagagtcggggacccacgaacgttacacgtctagtcggacgtcgtcgggaccgaacgggacccg

SEQ ID NO: 381191 - DNA, 528 bp, Homo sapiens
  misc_feature: GZ8MTXP02J0U3T.13.76.G10.1.454.CMB.2.raw
  modified_base (294)..(294): a, c, t, g, unknown or other
  modified_base (322)..(322): a, c, t, g, unknown or other
  modified_base (332)..(332): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataatggcagataaatatacttcctggtatcagcagaagtcaggccagtcccctgtgctggtcatctatcaagntgccaagcggccctgagggctcccccgngagcgattcnctcggcctccaactctagggaactcacgcccactctagacccatccgacgccgggacccaggcctagtggatggaggctgactattacgtgtaccgagggtcgtagggacagcgagcacgtcgcccgtctacgtcgtcgtaccggaacgtcgggaaccgtaacggtccacccgtaccgtacgtaccacgacccccg

SEQ ID NO: 381192 - DNA, 487 bp, Homo sapiens
  misc_feature: GZ8MTXP02IURQ6.13.76.G10.1.454.CMB.2.raw
  modified_base (252)..(252): a, c, t, g, unknown or other
  modified_base (440)..(440): a, c, t, g, unknown or other
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttcctggtatnagcagaagtcaggccagtccccctgtgctggtcatctatcaagatgccaagccggccctcagggactcccctgagcgattctctggctccaactctgggaactcagccactctgaccatcagccggaccaggctatcggatggagctgactattactgtcaggcgtgggacagcagcactcgcccggntatcgtcttcggaactcgggaccaaggtccacgtcctaagtcaaccg

SEQ ID NO: 381193 - DNA, 512 bp, Homo sapiens
  misc_feature: GZ8MTXP02JK8XU.13.76.G10.1.454.CMB.2.raw
  modified_base (214)..(214): a, c, t, g, unknown or other
  modified_base (235)..(235): a, c, t, g, unknown or other
  modified_base (340)..(340): a, c, t, g, unknown or other
  modified_base (460)..(460): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctnggaaataatggcagataaatntacttcctggtatcagcagaagtcaggccagtcccctgtgctggtcatctatcaagatgaccaagccggaccctgaaggggctccccccgtgaacgcgtatttcncttggcctccaaactcgtgggaactcacgcccactctcgaccatcagccggacccaggctaagtggatggaggctggacttatacgtgtcgaggcgtgggacaggcagcactcggccctntcgtcgtcgtacgacgcggaacgaggtacctacgtacgtacgcgacgacccg

SEQ ID NO: 381194 - DNA, 636 bp, Homo sapiens
  misc_feature: GZ8MTXP02FKRLG.13.76.G10.1.454.CMB.2.raw
  modified_base (261)..(262): a, c, t, g, unknown or other
  modified_base (271)..(271): a, c, t, g, unknown or other
  modified_base (273)..(273): a, c, t, g, unknown or other
  modified_base (285)..(285): a, c, t, g, unknown or other
  modified_base (297)..(297): a, c, t, g, unknown or other
  modified_base (299)..(299): a, c, t, g, unknown or other
  modified_base (301)..(301): a, c, t, g, unknown or other
  modified_base (312)..(312): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcgtggtttcgtgtaggctatttaaaagtgccagtgtgaggtgcagctggtggagtctggaggaggcttgatccagcctggggggtccctgagctctcctgtgcagctctggttcaccgtcnncacacacangngcgtcggtcgcngcgcgaggaggngngngtgtcgtcttntttattatagtagtgtagtactatactcgcacgacgtcgtggacggggcgtacgtacctacctactactaccgaacgaacgaaactaaactaacaaacgaaaccgacgtacttacgtttacttaactaaaactaacgaaacgacgtaccgtacgaagacggaccgtaacgtacgaaccgaccggtaccggttacgttaacgttacgtacgtaggtacggaaggaggtacgggtacggggaacccggtaaaccgtaaaccgttaaccgtaacgtaacgtacggtacggtacggtacgggtacggggaaccgggaacggtaaccgg

SEQ ID NO: 381195 - DNA, 543 bp, Homo sapiens
  misc_feature: GZ8MTXP02GORMZ.13.76.G10.1.454.CMB.2.raw
  modified_base (448)..(448): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagcagccagcatcacctgctctaggaaataatggacagataaatatactctggtatcagcagagtcaggccagtcccctgtgctggtcatctatcaaagatgaccaaggccggccctgagggactccccctgagcgattctctggcctccaaacttcgtagggaacctcacgcccactctacgaccatcaggccggacccaggctagtcggatggaggctagtaacttacttacgtcgtacgagggcggtggggaacncggacgacgctacgtcgaccgtacgttacgtcgttccgtacggacggtacgggaaccgtacggtaccgtaccgtacgtaacgtccgaacgacccg

SEQ ID NO: 381196 - DNA, 494 bp, Homo sapiens
  misc_feature: GZ8MTXP02IGYTI.13.76.G10.1.454.CMB.2.raw
  modified_base (432)..(432): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgttcaggaaataattggcagataaatatacttctggtatcagcagaagtcaggccagtcccctgtgctggtcatctatcaagatgaccaagcggccctcaggggatccctgacgcgattctctggctcaactctgggaactcagccactctgaccatcagcggaccaggctagtgatgagctgactattactgtcaggcgtggacagcagcacgtcgcccgntacgtgtcttacggaacttcggaccaaaggtccaccgtctaaagtcgacgacccgaaaccgg

SEQ ID NO: 381197 - DNA, 493 bp, Homo sapiens
  misc_feature: GZ8MTXP02G0KRY.13.76.G10.1.454.CMB.2.raw
  modified_base (418)..(418): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgtttactgcacatgatccgtggcctcctatgagctgactcagccaccctcagtgtccgtgtccccaggacagacagccagcatcacctgctctggaaataattggcagataaatatacttcctggtatcagcagaagtcaggccagtcccctgtgctggtcatctatcaagatgccaagccggccctcgagggactcccccgtgagcgattctctggctccaactcgtgggaactcgacgccactctgacccagtcagccgggaccccaggctaagtcggatgaggctgactattacngtcaggcgtggacagcagcacgtgcccgctatcgtcttacggactgggaacaggccacgtctaacgcacgacccg

SEQ ID NO: 381198 - DNA, 559 bp, Homo sapiens
  misc_feature: GZ8MTXP02JMN1O.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtgggtccgccgaggctccgaggggaggggctggagtgcgtctcttttatttatagtagtggtatacatactccgcagactccgtgacgggggcctattccaccactctaccagagacaaattccaaaggaaccacgcttagtttctacaaatcgaacagcctagagacgccgatcgacacgggccgtgtattacgtgtcgcgaggaggacgtcggggacccacggtaaacgttcacgctagtcgggacgtcgtcggggaccacgggaacccg

SEQ ID NO: 381199 - DNA, 539 bp, Homo sapiens
  misc_feature: GZ8MTXP02HY8ZD.13.76.G10.1.454.CMB.2.raw
  modified_base (396)..(396): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgccaggctccgaggggaaggggctggagtgcgtcttctttttattatagtagtggtagtaccatactcgcagactcgtgacggggcattcaccatctccaganacatcaagacacgctgtttactacaaatgaactagcctgagagccgatcgacacggcctgttatacgtgcgcgagagacgcgggccgacgtaacgtacgtacgtaacgtacgtaggtacgtcgtcgggacggaacggaaccgg

SEQ ID NO: 381200 - DNA, 556 bp, Homo sapiens
  misc_feature: GZ8MTXP02I14RC.13.76.G10.1.454.CMB.2.raw
  modified_base (425)..(425): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggttcaccgtcagtcacacctacatgagctgggtccgccaggctccgaggggagggctggagtgcgtcttcttttattatagtagtggtagtacatactcgcagactccgtgacggggcattcaccatctcagagacaatcaagaacacgctgttctacaaatgaacngcctgagacgccgatcgacgacggccgtagtattactgtgcgagagacgtcggggacccaacggtaaccgttacaaacggtcctaagtcggggtaccgtcggttacgggggaccccaaaaggggaccccgg

SEQ ID NO: 381201 - DNA, 545 bp, Homo sapiens
  misc_feature: GZ8MTXP02FTHX2.13.76.G10.1.454.CMB.2.raw
  modified_base (447)..(447): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttctggtatcagcagaagtcaggccagtcccctgtgctggtcatctatcaagatgaccaaggccggccctgaggggactccccccgtgacgcgtatttcctcttgggcctcccaaacttccgtacggggaaaccttcgacgcccactcctcgaacccatccgagccgggaccccagggctagtcggatggaggctaggacttattacgngtacgagggcgtggggacagcagcacgtcgcccgtctagtcgtcgttacggaacgtacgggaaccgtaaggtccaccgtacgtaacgtcacgaacccg

SEQ ID NO: 381202 - DNA, 549 bp, Homo sapiens
  misc_feature: GZ8MTXP02GG4Q6.13.76.G10.1.454.CMB.2.raw
  modified_base (291)..(291): a, c, t, g, unknown or other
  modified_base (369)..(369): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgtttactgcacaggatccgtggcctcctatgagctgactcagccaccctcagtgtccgtgtccccaggacagacagccagcatcacctgctcaggaaataattggcagataaatatacttctggtatcagcagaagtcaggccagtcccctgtgctggtcatctatcaagntgaccaagccggccctgagggactcccgtgagcgtattccactcggctccaactcgtagggaactcgagccactcgtnaaccatcgacggccggggacccagggactagtagggatggaggcctaggacttattacgtgtacgacgggtcgtagggacaggcaggccacgtcgcccgtactagtcggttacttacggaaacgtcggggaaccctaagggtcccaaccggtacctaagtaccacgaccccaaaacccgg

SEQ ID NO: 381203 - DNA, 576 bp, Homo sapiens
  misc_feature: GZ8MTXP02G929S.13.76.G10.1.454.CMB.2.raw
  modified_base (362)..(362): a, c, t, g, unknown or other
  modified_base (427)..(427): a, c, t, g, unknown or other
  modified_base (437)..(437): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggttcaccgtcagtcacacctacatgagctgggtccgccaggctccgaggggaggggctggagtgcgtcttcttttattatagtagtggtagtaccatactcgnagactccgtggacggggccattccaccatctccagagacaatccaaagacagtcctgtttctaanaaatagaacngcgagagacgacgatacgacgacggtctagttactagtgtcgacgagaggacggaccggggaaccctaacggtaaccgttacgtaccgtaagtacggtacggtaccggtacggtacggggaacccgaaacgggtacccg

SEQ ID NO: 381204 - DNA, 545 bp, Homo sapiens
  misc_feature: GZ8MTXP02IJF9Y.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtcccctgagactctcctgtgcagcctctgggttcaccgtcagtcacacctacatgagctgggtccgccaggctccgagggaggggctggagtgcgtctcttttattatagtagtggtagtaccatactccgcagactccgtggagggggccagttccaccatcctccagagacaatcaaagaacacgctgtttctacaaatgaaacagcctgagagccgaatgacacggccgtagtacttactgtgacgagagagtcggggacccacgaaccgttcacggctagtcggacgtcgtacggggacccaaggggacccg

SEQ ID NO: 381205 - DNA, 569 bp, Homo sapiens
  misc_feature: GZ8MTXP02FX2G0.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggtcaccgtcagtcacacctacatgagcgtgggtcccgccaggcctccgagggaggggctggagtgcgtcttcttttatttatagtagtggtagtacatactcgcagacctccgtggacggggccattccacctatcctccagacgacaattaccaaagaacacgcttgtttcttcaaatgaaacagcctaggagacgccgaatcgaccgacggccgttagtattacgtgtgacgagagacgtcggggacccacggtaaccgtacgtaacgcgtagtacggtacgtcggtacggggaccgaagggtaccccg

SEQ ID NO: 381206 - DNA, 572 bp, Homo sapiens
  misc_feature: GZ8MTXP02GXRF6.13.76.G10.1.454.CMB.2.raw
  modified_base (456)..(456): a, c, t, g, unknown or other
  modified_base (471)..(471): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtctggaggaggcttgatccagccgtgggggtccctgagactctcctgtgcagcctcgtgggttcaccgtcagtcacacctacatgagctgggtcccgccgaggctccgaggggagggctggagtgcgtcttcttttattatagtagtggtagtacatactccgcagtactccggtggacgggggcctattccacctatcctccaagacgacctaaattccaaagaaccacgtcttgtttactacaaaatcgaaaccncgctagagacgcgancgaccgacggtctagtacttcgtgcgacgagagcggtccgggaccctacgtaaccgttacgcgaagtacgtcgggacgtcggacggggaccaacgggaccc

SEQ ID NO: 381207 - DNA, 744 bp, Homo sapiens
  misc_feature: GZ8MTXP02GV82S.13.76.G10.1.454.CMB.2.raw
  modified_base (368)..(368): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcaccacctacatgagcgtcgggtccgccgaggcctccgaggggaaggggctggagtcgcgtcttcttttatttatagtagtggtagtacatactccgnacgactccgtggacggggcctagttccaccgtatcctacccgagaacgaacctaaattacccgaaagaaaccctacggtctttgttttacctaacaaaaagttcggaaaaccacgggtacccttaggggaaacgtaccggtacccgggaaagttaccgggaaacccgtacccgggggtcccggtttaaggttaaaaccttttaccgttggggtacggtaaccgggtaggggaaaggtaacgggttccggggggaacccccctaaaaccgggtaaaacccgggtttaccttaacggggaacctttaaacgggtcgggggttaaaacccggttccgggtaaccggggggtaaccccgaaaacgggggtaaacccccgg

SEQ ID NO: 381208 - DNA, 592 bp, Homo sapiens
  misc_feature: GZ8MTXP02HZ95Z.13.76.G10.1.454.CMB.2.raw
  modified_base (269)..(269): a, c, t, g, unknown or other
  modified_base (486)..(486): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctctgggttcaccctnagtcacacctacatgagcgtgggtccgccgaggcctccgaggggaggggctggagtgcgtcttcttttatttatgtagtggtatacatactcgcagactcgtgaggggcctattccacactctccagagacattaccaaagaacacgcttgtttctacaaatgaaactgcctagacgagtaccgatacgaccgacgggtccgttagttaacttacgnggttacgaccggagaggacgttcgggggacccctaaacggtaaccgttaccgtacgtaaccgttagtcgggaccgtacggtacgggggaccgtaacggggaccccg

SEQ ID NO: 381209 - DNA, 669 bp, Homo sapiens
  misc_feature: GZ8MTXP02HL9Z0.13.76.G10.1.454.CMB.2.raw
  modified_base (250)..(250): a, c, t, g, unknown or other
  modified_base (275)..(275): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcgtggtttcgtgtaggctatttaaaagtgccagtgtgaggtgcagctggtggagtctggaggaggcttgatccagccgtggggggtccctgagactctcctgtgcagcctntgggttcaccgtcagtcacacctanatgagcgtcggccgcgacggccgtaccggaaggggaggggcgtaggaggtcgtcgtttactttactttttaagttaagtaggttaggtacggtaagtaccctattacccgtccgacaacgtaccgttccgggtgggacggggtcctacttacccaacctactcctaccgaagacgaactaactaccgaaagaacctacgtcttacgtttactaacaaacgtaacgtaacgacgacgtacgagacgaccgacgtacgacgacggtaccgtacgttacgttacgtagtcggacggaggaggacggtaccggtacccggtaaccgtaaccgttaaccgtaccgtaacgtacgtacggtacggtaccggtaccggggtaccgggaaccgggaacccgg

SEQ ID NO: 381210 - DNA, 645 bp, Homo sapiens
  misc_feature: GZ8MTXP02IQOPF.13.76.G10.1.454.CMB.2.raw
  modified_base (363)..(363): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctctgggttcaccgtcagtcacacctacatgagctgggtccgccaggctccgagggaggggctggagtgcgttcttctttttattatagtagtggtagtacatactccgnagacctcgtggacggggccattccacccatcctaccaaggtacaactaaacttacccaaaggtaaacccacgtctttacgttttacttaaccaaattacgaaaccacgtacccgtaggaagacgacccggaatcggaaccgacgggtcccgttagttaacttacgtgtacgcggaaaggtacggacgtacgggggaccccctaacgggtaaaaccgtttaccgaacggccttaggtacggggtaaccgttcggtacgggggaccctaaaacgggggaccccg

SEQ ID NO: 381211 - DNA, 527 bp, Homo sapiens
  misc_feature: GZ8MTXP02GSLUT.13.76.G10.1.454.CMB.2.raw
  modified_base (380)..(380): a, c, t, g, unknown or other
  modified_base (385)..(385): a, c, t, g, unknown or other
  modified_base (409)..(409): a, c, t, g, unknown or other
  modified_base (418)..(418): a, c, t, g, unknown or other
  modified_base (431)..(431): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtctggaggaggcttgatccagccgtggggggtccctgagactctcctgtgcagcctctgggtcaccgtcagtcacacctacatgagctgggtccgcaggctccgaggggaaggggctggagtgcgtctcttttattatagtagtgtagtaccatactcgcagactcgtgagggcatcacatcncaganacatccaagaacacgctgttctanaaatgaacngctagagagcgancgacgacggtcgtagtatacgtgagacgagagtacgcgggacccaacgtaacgttacaacgtctagtcggacgtcgacggggaccaaacgggaccg

SEQ ID NO: 381212 - DNA, 575 bp, Homo sapiens
  misc_feature: GZ8MTXP02JL6W0.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgccaggctccgaggggaaggggctggagtgcgtcttcttttattatagtagtggtagtaccatactccgcagactccgtggacggggccgattccaccatctccagagacaattccaagaacacgctgtttactacaaatcgaaacagcctagagacgccgatcgacacggcgtgtattacgtgtgacgaggagtagtcgggggaccccacggtaaacgtttaccgaacggctaacggtacggaccggttccgtacgggggacccgaaacgggggtaccccg

SEQ ID NO: 381213 - DNA, 602 bp, Homo sapiens
  misc_feature: GZ8MTXP02HPI5L.13.76.G10.1.454.CMB.2.raw
  modified_base (242)..(242): a, c, t, g, unknown or other
  modified_base (266)..(266): a, c, t, g, unknown or other
  modified_base (286)..(286): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggcagataaatatactcngtatcagcagagtcagcagtcccngtgctggtcatctatcaagntgccaagccggacctcgagggactccccccgtagacgcgtatttctcgtcggccttacccaaacttccgtaggggaaaccttcgaaacgcccaacttcctacgacccatcgacggacccgggaaccccagggacctaagtggagtaggaggccttaggtaaccttaagttaccgtgttaccggaagggtccgtagggggaccagggtcccaaagggcctaacgtcggaccccgtacttacgtcgttaccgtacggtaaccgtacgggaacccgtaacggtacccgtacccgtacgtaacggaccgaaccgaccccg

SEQ ID NO: 381214 - DNA, 649 bp, Homo sapiens
  misc_feature: GZ8MTXP02HMAWW.13.76.G10.1.454.CMB.2.raw
  modified_base (236)..(236): a, c, t, g, unknown or other
  modified_base (243)..(243): a, c, t, g, unknown or other
  modified_base (293)..(293): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtcccgtgtccccaggacagacagccagcatcacctgctctaggaaataatggcagataaatntacttcnggtatcagcagaagtcaggccacgtcccctgtgctggtcatctatcaagntcgaccaagccggcctgagggactcccccgtgacgcgtattcgtacgtggcctaccaaactcgtcggggaaacctcgacgcccactctacgaccagtcgacggaccgggacccagggtacctagtacggagttacggacggtacttaggtaaccttagtttaccgtacggttcggaacggggtcggtacgggggaaccagggaccgacggaccgtaaccgtccggaccccgttacggttaacgttcggttacccggtttaccggggaaaccgttaccgggggaaacccgtaacggggttaaccccgtaacccgggttaacccgttaaacggtacccgtaaaccggaaaccccccgg

SEQ ID NO: 381215 - DNA, 587 bp, Homo sapiens
  misc_feature: GZ8MTXP02HFSQ6.13.76.G10.1.454.CMB.2.raw
  modified_base (396)..(396): a, c, t, g, unknown or other
  modified_base (433)..(433): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggttcaccgtcagtcacacctacatgagctgggtccgccaggctccgaggggaaggggctggagtgcgtcttcttttattatagtagtggtagtaccatactcgcagactccgtgaggggccattcaccatctcaganacaatccaagaacacgctgtttctacaaatgaaaccngctagagacgaccgatacgaccgacggtcgttagttaacttacgtgtacggacgaggaggtacggtcccggggaaccccgtaacgtaaccgttacgtaccgtaacgttacggtacggtaccggtcggtacgggggaacccgaaacggggacccg

SEQ ID NO: 381216 - DNA, 611 bp, Homo sapiens
  misc_feature: GZ8MTXP02IOUU0.13.76.G10.1.454.CMB.2.raw
  modified_base (254)..(254): a, c, t, g, unknown or other
  modified_base (279)..(280): a, c, t, g, unknown or other
  modified_base (305)..(305): a, c, t, g, unknown or other
  modified_base (307)..(307): a, c, t, g, unknown or other
  modified_base (309)..(309): a, c, t, g, unknown or other
  modified_base (319)..(319): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgtgctattttaaaaggtgcccagtgtgaggtgcagctggtggagtctgggaggaggcttgatccagcctggggggtccctgagactctcctgtgcagcctntgggttcaccgtcagtcacacctanngagcgcggcgcgagcgcgaggaggngngngtgcgtcttntttattatagtagtagtagtactatactcgacacgtaccgtacggtcgggacgggtaccgtacgttacctacctactactaccacgacgaactaaactaacctaaacgaaactaacgtaccgttacgtttacttaactaaactaacgaaacgaacgacgacgagacgacgacgacgacgacggtacgtacgttattacgtgtagacgaggaggacggtacgggaccgtaaccgtaacgttaacgtacgtaacgtacgtacggtacggtacggtacgggacggaacggaaccg

SEQ ID NO: 381217 - DNA, 564 bp, Homo sapiens
  misc_feature: GZ8MTXP02H3IYN.13.76.G10.1.454.CMB.2.raw
  modified_base (296)..(296): a, c, t, g, unknown or other
  modified_base (452)..(452): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtccctgagactctcctgtgcagcctctgggttcaccgtcagtcacacctacatgagcgtggggtcccnccgaggcctccgaggggaaggggctggagtgcgtcttcttttatttatagtagtggtatacatactcgcagactccgtggacggggccgacttccaccctatcctacccagacgactaacttccaaagaccacgtcttgtttctacaaatgaaacngcctgagacgccgatcgacacggtctagttatactgtgcgagagagtcggggaccctacggaacgtttacacggtctagtacggacgtcgtacggggaccaacggggacccg

SEQ ID NO: 381218 - DNA, 529 bp, Homo sapiens
  misc_feature: GZ8MTXP02GXEAM.13.76.G10.1.454.CMB.2.raw
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctgggggtccctgagactctcctgtgcagcctctgggttcaccgtcagtcacacctacatgagctgggtccgccaggctccgaggggaaggggctggagtgcgtctcttttattatagtagtggtagtacatactccgcagactccgtgaggggccattcacatctccagagacaattccaagaacacgcttgttctacaaatgaacagcctgagagccgatgacacggcgtgtatacgtgtgtgagagagtcgggggcccacgaacgttacaacgtctagtcggacgtcgtcggggaccaaacgggg

SEQ ID NO: 381219 - DNA, 574 bp, Homo sapiens
  misc_feature: GZ8MTXP02GOSII.13.76.G10.1.454.CMB.2.raw
  modified_base (442)..(442): a, c, t, g, unknown or other
  modified_base (481)..(481): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggggttcaccgtcagtcacacctacatgagctgggtccgcaggctccgagggaggggctggagtgcgtctcttttattatagtagtggtagtaccatactccgcagacctccgtggacggggccgattccaccatcctccaagagaacaattccaaagaaccacgcttgtttctacaaatgaaaccngtctgagacgccgagcgacgacggtcgtagtattcgtgngacggaggaggtacggtccgggaccctaacggtaaccgttacgacgtaacgtacggtacggtacgtcggtacgggggaccgaacggggtcccg

SEQ ID NO: 381220 - DNA, 582 bp, Homo sapiens
  misc_feature: GZ8MTXP02H20SL.13.76.G10.1.454.CMB.2.raw
  modified_base (295)..(295): a, c, t, g, unknown or other
  modified_base (339)..(339): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagctgggtccnccaggctccgaggggaggggctggagtgcgttctctttatttanagtagtggtagtacatactcgcagctccgtgaggggccattcacatctccagagacaattcccaaagtaaccacgtctagttctactaaatagaacacgtactcgaggagaccgagtagaccgacggtacccggtagtacgtttaacgtcggttgaccggacgaggacgtacgggggacccgtaccgaaacggtttaaccgtaccggtacgtacgtaggaccggttcgttacggggacccggg

SEQ ID NO: 381221 - DNA, 681 bp, Homo sapiens
  misc_feature: GZ8MTXP02GZETC.13.76.G10.1.454.CMB.2.raw
  modified_base (289)..(289): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcgtggtttctgtagctatttaaaaggtgccagtgtgaggtgcagctggtggagtctgggaggaggcttgatccagccgtggggggtccctgagactctctgtgcagcctgtgggttcaccgtcagtcacactacatgagcgtgggtccnccaggctccggaggggaggggctggagtgcgtcttcgttttattatagtagtggtataccatacctccgactagacgttccggtgggacggggcctaattccacctattccaccagacgtaaacctaacgttacccaaaaggaaacctacggtctttacggttttacccttaaaacgaaaacgtacgaaaccgtacggtaccgtaggaacggtaccgtaccgtaacgtaccggaccggtacccgggtacgttagtttaacgttacgtggtacggacggtaggtaacggtaccgggtacccgggaaccctaaacggttaaccgttaccgtacggtaacgtaacgggtacgggtaccggtaccggggaccggggaacccggtaaacgggtcccg

SEQ ID NO: 381222 - DNA, 644 bp, Homo sapiens
  misc_feature: GZ8MTXP02IOD2D.13.76.G10.1.454.CMB.2.raw
  modified_base (332)..(332): a, c, t, g, unknown or other
  modified_base (363)..(363): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtcgtggaggaggcttgatccagccgtggggggtccctgagactctcctgtgcagcctctgggttcaccgtcagtcacacctacatgagcgtcgggtccgccaggcctccgaggggagggcgtggagtgcgtcttntttattatagtagtgtagtaccatactccgnagactccgtggacgggccattccaccatcctaccaagacgaaacaacttacccaaagaaccacgtcttgtttacccttacgaaaatacgaaacacgacctaggaacgaacgcccggaaatcgaaaccgtaccgggcccgttaggttaactttaaccgtggtacggacggaaaggtaggaaacgttccgggggaaccccaaacgggttaaaccgttaaccgaacggtccttaaaggtcggggtaaccgtcggtaccgggggaacctaaacgggggaaccccg

SEQ ID NO: 381223 - DNA, 575 bp, Homo sapiens
  misc_feature: GZ8MTXP02G026M.13.76.G10.1.454.CMB.2.raw
  modified_base (446)..(446): a, c, t, g, unknown or other
  modified_base (482)..(482): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctggggttcaccgtcagtcacacctacatgagcgtgggtccgccgaggcctccgaggggaaggggctggagtgcgtcttctttttatttatagtagtggtagtaccatactccgcagactccgtggaggggccagttcaccatcctccagagacaattaccaaagaacacgtctgtttctacaaatcgaaacngcctgagacgccgaatgacacggccgtgtattacgngtgacgagagagtcgggggaccccaacggtaaccttaccgtacgaaccgttagtacgggtacgtcggtacgggggacccgaaaggggaccccg

SEQ ID NO: 381224 - DNA, 630 bp, Homo sapiens
  misc_feature: GZ8MTXP02GQFM5.13.76.G10.1.454.CMB.2.raw
  modified_base (401)..(401): a, c, t, g, unknown or other
  modified_base (406)..(406): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtgggtcccgccgaggcctccgaggggaaggggcgtggagtgcgtcttcttttatttatagtagtggtagtaccatactccgcagacctcgtggacggggcctagttcaccatcncaganacataccaaagacacgcttgtttactacaaaatgaaacagtcctaggacgacgacccgtaatcgaaaccgtacgggtcccgttaggtaactttaccgtggttacggacggaaggaacggtacgtccgggggaccccctaaacgggtaaaaccgtttaccgtacgtaaccgttagtacggggtaccggttccggtacgggggaacccaaaacgggggaacccccg

SEQ ID NO: 381225 - DNA, 621 bp, Homo sapiens
  misc_feature: GZ8MTXP02FXZLZ.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactaaccatggagttttggctgagctgggttttccttgttgcttaattttaaaaggtgcccagtgtgaggtgcagctgggtggagtcgtggggggaggcttggtcaaggccgggggatccctgagactctcctgtgaagcctcaacattctactttttgcttcgtgccgtgggtcgaccgtggggtcccgccaggcctccgaggggaaggggctgggaggtggattggccaataagttaaggacaagaacctaagtcggcgacgacacgccacctactaccttagaaacttccgtacaaagacagtacttcatcatctacgaggaggtgacttacccgaacaaccgtacggttcgtcctcctaccaattatggacgcacgacctaagaaaacgtcggaacggaacaacgacggtacctaaattacgttaacgtgtacgactaggtagacgtcggggacccaacgaaccgtacggttacgtttggacggtttcggcgccgtcccgg

SEQ ID NO: 381226 - DNA, 479 bp, Homo sapiens
  misc_feature: GZ8MTXP02FH2WS.13.76.G10.1.454.CMB.2.raw
  modified_base (234)..(234): a, c, t, g, unknown or other
  modified_base (351)..(351): a, c, t, g, unknown or other
  modified_base (375)..(375): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagaggtcaccatctcctgcactgggancagctcaacattgggcacatatgatgtacactggtaccagcagtttccaggagcaggtcccagactcctcatcaatacgtaacaacaatcggcccgcaggggtccctgaccgattcnctggctcagtctgcactcacgccnccctgtcatcactggctcagctgagatgagctgtattattctgccagtcctatcgacagcacgcctgaagtgtcgttcggtagttcgggcgggggtacccacgg

SEQ ID NO: 381227 - DNA, 579 bp, Homo sapiens
  misc_feature: GZ8MTXP02JT6C0.13.76.G10.1.454.CMB.2.raw
  modified_base (329)..(329): a, c, t, g, unknown or other
  modified_base (487)..(487): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggttcaccgtcagtcacacctacatgagctgggtccgccaggcctccgaggggaaggggctggagtgcgtntcttttattatagtagtggtagtaccatactcgcagactccgtggacggggccgattcacctatcctccaagagacaattcccaaagaccacgcttgtttctacaaatgaaacagcctagagacgccgaatcgaaccacggggcctaggtacttacgngtcgacggagagacggtcggggaccctaacgtaacgttacacgaacttagtacgggaccgttcggtacgggggaccgtaaacggggaccccg

SEQ ID NO: 381228 - DNA, 614 bp, Homo sapiens
  misc_feature: GZ8MTXP02G2NRB.13.76.G10.1.454.CMB.2.raw
  modified_base (414)..(414): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcaacctctggattcattttctctgacgctggtgagctgggtccgcaggcgtcccgggagggctggagtgggtggcgtagtaaaggtagaagacagtggtcggacaacagactacagtgtacccgtgaaggcagattacactatctacaaagagatgaacctaaaanaaaagtaatagtaataatatactagaaactaaataacgaaacctaaacgtaaaggaaaacggacgaaacggaacgaacgaacggtacgttagttaacgttacgtacgtaaccaacgaaggtacgtacggggaaccagtaacgtacgaaacgaaaggtcgggaccggtacggaacggtacgttaccggaaccggtacgggg

SEQ ID NO: 381229 - DNA, 525 bp, Homo sapiens
  misc_feature: GZ8MTXP02F11UP.13.76.G10.1.454.CMB.2.raw
  modified_base (233)..(233): a, c, t, g, unknown or other
  modified_base (340)..(340): a, c, t, g, unknown or other
  modified_base (350)..(350): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagaggtcacatctcctgcactgggancagctccaacattggggcacattatgatgtacactggtaccagcagtttccaggagcaggtcccagactctcatcaatagtaacaacatcggccgcgacgggtcccngaccgattcnctggctcgagtctggcacctcacgcctccctggtcactcacgtcggggcctccgaggccgtggacggagtcggaggcttaggtatttagtttcgtcgtccgtacgttcctagtcgactacgcacgcctgtaacgtgtccgttacggtacgttccggggccgggggtacctacggg

SEQ ID NO: 381230 - DNA, 613 bp, Homo sapiens
  misc_feature: GZ8MTXP02I2YP9.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcaccacctacatgagcgtcgggtcccgccgaggcctccggaaggggaaggggctgggagtcggcgttcttcttttatttatagtagtggtataccatactccgcagacctcgtggacggggccgattccaccatctccagacgaactaattaccaaagaacacgtcttgtttactacaaatcgaaacagccgtagagacgaccgatcgacgacggtccgttagtacttactggtgacgaggtagacggtacgggggacccctaaacggtaaaccgttacgtaaccgtcgtaacgttacgggaccgttcgggacgggggaccccgaaaaggggtaacccccg

SEQ ID NO: 381231 - DNA, 494 bp, Homo sapiens
  misc_feature: GZ8MTXP02FPG3J.13.76.G10.1.454.CMB.2.raw
  modified_base (399)..(399): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatcggtggcctcgaatggcctgactcagccacccgcaatgtccgtgtccccagggcagacagccaccataacctgctctggatatttgttgagggatagatatgcttgttggtatcaacagaagccggccagtcacctacattggttatctatgaagacacgaagcggccctcagggatccctgagcgattcctctggctccaactctgggacacagccactctgaccatcagcggaccagcctatggatgagctagactatacngtacatacatggacaacgatattggatggctgttcggcggagggaccaaaacgtgaccgtcaggtcaagcccaaggcctcgccccctggtctacc

SEQ ID NO: 381232 - DNA, 515 bp, Homo sapiens
  misc_feature: GZ8MTXP02GU3JG.13.76.G10.1.454.CMB.2.raw
  modified_base (289)..(289): a, c, t, g, unknown or other
  modified_base (294)..(294): a, c, t, g, unknown or other
  modified_base (411)..(411): a, c, t, g, unknown or other
  modified_base (444)..(444): a, c, t, g, unknown or other
  modified_base (450)..(450): a, c, t, g, unknown or other
  modified_base (457)..(457): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggaccagacagccagcatcacctgctctggaaataaattggcagataaatatacttcctggtatcagcagaagtcaggccagtcccctgtgctggtcatctancaagntgccaagccggccctgaggggtactccccccgtgacgcgattcgtcgtcggcctaccaactcgtacgggaacctcgacgcccactctcgaccactcacgccgggacccaggcctagngatcggaggctagacttatacgtgcgaggtcgngggacngcagccncgcgcgctcgtcgtcgtacgacgacgaacgacgacgtacgtacgtacgacgacgaccg

SEQ ID NO: 381233 - DNA, 528 bp, Homo sapiens
  misc_feature: GZ8MTXP02H6YE1.13.76.G10.1.454.CMB.2.raw
  modified_base (379)..(379): a, c, t, g, unknown or other
  modified_base (457)..(457): a, c, t, g, unknown or other
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggtttccttgttgctatttaaaaggtgcccagtgtgaggtgcagctggtggagtctggaggaggcttgatccagcctgggggtccctgagactctcctgtgcagcctctgggttcaccggtcagtcacacctacatgagctgggtcccgcaggctccgaggggaagggctggagtgcgtctctttattatagtagtgtagtacatactcgcagactcgtgagggccatcacatcnccagagacaatccaagacacgcttgttcttacaaatgaaacagcctagacgagccgatgacacggcgtagtattacgngtgcgagacgagcggggtcccaacggtaacgtactaacgctaagtcggacgtcggtggggacccaacgggg

SEQ ID NO: 381234 - DNA, 577 bp, Homo sapiens
  misc_feature: GZ8MTXP02GQSQ1.13.76.G10.1.454.CMB.2.raw
  modified_base (396)..(396): a, c, t, g, unknown or other
  modified_base (433)..(433): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcgtgggtttccttgttgctattttaaaaggtgccagtgtgaggtgcagctggtggagtctggaggaggcttgatccagcctggggggtccctgagactctcctgtgcagcctctgggttcaccgtcagtcacacctacatgagctgggtccgccgaggctccgaggggaaggggctggagtgcgtcttcttttatttatagtagtgtagtaccatactcgcagactcgtggacggggcattccaccatctccaganacaatccaagaacacgctgtttactacaaatgaaacngcgagagacgaccgatacgacgacggtcgttagtattacgtgacgacggaaggaggtacggtaccggggaccctaaacggtaaccgttacgacgtaacgttacggcggtaccggtcgggtacggggaaccgaacggggtacccg

SEQ ID NO: 381235 - DNA, 652 bp, Homo sapiens
  misc_feature: GZ8MTXP02HG8MJ.13.76.G10.1.454.CMB.2.raw
  modified_base (246)..(246): a, c, t, g, unknown or other
  modified_base (280)..(280): a, c, t, g, unknown or other
  modified_base (300)..(300): a, c, t, g, unknown or other
  modified_base (577)..(577): a, c, t, g, unknown or other
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataatggacagataaatatacttcngtatcagcagaagtcaggcccagtcccctggtcncgtggtcattctaatcaagntcgaccaaggccgccctcgagggaccctcccgtagacgtcgtatttccgcgtcggtacctacctaaccgtcgtacggggtaacctccgtacgaccctactcctacgaaccctataccgacgggaccccggggaaccctaggggtaccttaggacgggtaagttacggggaaacggttccgttaaggtaacctttaacggtttaccgttagggtaccgttaagggggcccggttaaggggaccaacgggcgaacggcctaaccgtcggtaaccccgtnttacggttcgttaccgttacggaaacgtcgggtacctaaccggtacggtaccgtacccggttacgtaaacgtccg

SEQ ID NO: 381236 - DNA, 613 bp, Homo sapiens
  misc_feature: GZ8MTXP02I9J4U.13.76.G10.1.454.CMB.2.raw
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggcagataaatatacttctgtatcagcagaagtcaggccacgtcccctgtgctggtcatctatcaagatcgaccaagccggaccctcgacgggtacctcccgtgacgcgtacttccgtcgtcgggaccttacccgaaacgttccgtacggggaaaccttcgacgtccctaactcctacgaaccctagccgaacggcccggggaaccctaggggacctaagtcggaaagttggaacgggtccttaggaacctttagttaaccgtgttcggaacggggtcggtaaggggaccaggcgaacgccgacgtcggcccgtattacgttcgtaccgttacggaacgtcggggaaacctacgggtaccaccggttactaacggtccaaacccgg

SEQ ID NO: 381237 - DNA, 553 bp, Homo sapiens
  misc_feature: GZ8MTXP02G68IH.13.76.G10.1.454.CMB.2.raw
  modified_base (294)..(294): a, c, t, g, unknown or other
tcagtcacgtactacacgaccggtgctcgatttagtcactcatacagggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggggttcaccgtcagtcacacctacatgagcgtgggtcccnccaggcctccgaggggaaggggctggagtgcgtcttcttttattatagtagtggtagtaccatactcgcagactcgtggacgggcctattcaccatctccagagacaatccaagaacacgctgtttctacaaatgaaacagcctgagagccgatcgacgacggccgttagtattacgtgtcgacggagagacgtcgggggaccccacggtaaccgttactaacgcgtaagtcggacgtcgtcggggaccaagggacccg

SEQ ID NO: 381238 - DNA, 533 bp, Homo sapiens
  misc_feature: GZ8MTXP02JDX59.13.76.G10.1.454.CMB.2.raw
  modified_base (358)..(358): a, c, t, g, unknown or other
  modified_base (464)..(464): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgagggaggggctggagtgcgtctcttttattatagtagtggtagtaccatactccgnagactccgtgagggccgattcaccatctccagagacaattccaaagaacacgctgtttctacaaatgaaacagcctagagacgccgatgacacggcgtgtattacngtgcgagagagtcggggacccagaacgttacacgaatagtcggacgtcgtcggggaccaaggggacccg

SEQ ID NO: 381239 - DNA, 575 bp, Homo sapiens
  misc_feature: GZ8MTXP02HFT49.13.76.G10.1.454.CMB.2.raw
  modified_base (441)..(441): a, c, t, g, unknown or other
tcagtcacgtactacacgaccggtgctcgatttagtcactcatacagggggggagaggagcccagcactgggattccgaggtgtttccattcggtgatcagcactgaacacagaggactaaccatggagttttggctgagctgggttttccttgttgctattttaaaaggtgcccagtgtgaggtgcagctggtggagtctggaggaggcttgatccagcctgggggtccctgagactctcctgtgcagcctcgtgggttcaccgtcagtcacacctacatgagctgggtccgccaggctccgaggggagggctggagtgcgtcttcttttattatagtagtggtagtacactactccgcagactccggtgcggggccattcgaccatcgtaccaggacacaacttaccaaagacacgtctgtttactacaaaatgaaacncgcctagacgagccgatcgacacgggctgtatacgtgtgacgtagacgacggtcggggaccctaacggtaaacgttacgtaccgactaagtcgggaaccgtcggtacgggggacccaacggggtacccgaccgg

SEQ ID NO: 381240 - DNA, 669 bp, Homo sapiens
  misc_feature: GZ8MTXP02G04IO.13.76.G10.1.454.CMB.2.raw
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggacagataaatatacttcctggtatcagcagaagtcaggccagtcccctgtgctggtcatctatcaagatgccaagccggccctcgagggtactcccccgtgagcgtattctcgtggcctaccaaactcgtacgggaacctcgaacgccctaactcctacgaacccagtaccgaacgggacccggggaaccccaggggtaccctaagtcgggaatacgggaacgggtccttaggtaacctttaacgtttaccgtacggttacccgaaggggtccggttacgggggaaactacgggaccgaaacgggccctaaccgttccggaccccggtacttaacggttccgttacccggtttaccgggaaaccgttacgggggaaacccgttaaacggggtaccctaaaccccggttaccttaaaacggtcccgaaaccggaaccccccg

SEQ ID NO: 381241 - DNA, 553 bp, Homo sapiens
  misc_feature: GZ8MTXP02HWI14.13.76.G10.1.454.CMB.2.raw
tcagtcacgtactacacgaccggtgctcgatttagtcactcatacagggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgaggggaaggggctggagtgcgtcttctttttatttatagtagtggtagtacatactcgcagactcgtggaggggccgattccaccatctccagagacaattccaaagaacacgctgtttctacaaatgaacagcctgagagccgatcgacacggccgtgtattacgtgtgcgagagacgtcgggggacccacgtaaaccggttacacgtcgtacgtacgggacgtcggtacgggggaccaaacggggacccg

SEQ ID NO: 381242 - DNA, 588 bp, Homo sapiens
  misc_feature: GZ8MTXP02IO15U.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctctggggttcaccgtcagtcacacctacatgagctggggtcccgccgaggctccgaggggaaggggctggagtgcgtcttctttttattatagtagtggtagtaccatactcgcagacctccgtggacgggccgattccaccatctccagagactaatccaaagaacacgcttgtttaccttacaaaatgaaacacgccctaggacgacgacccggaatggaccgacgggtccgttagtacttacgtgtacgacgaggagacggtcgggggacccacggtaaaccgttacacggtaactagtcggtacgtcgtacggggacccaaggggacccg

SEQ ID NO: 381243 - DNA, 573 bp, Homo sapiens
  misc_feature: GZ8MTXP02GQMAI.13.76.G10.1.454.CMB.2.raw
  modified_base (363)..(363): a, c, t, g, unknown or other
  modified_base (438)..(438): a, c, t, g, unknown or other
  modified_base (477)..(477): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtcccgccaggcctccgaggggaaggggctggagtgcgtctcttttatttatagtagtggtagtacatactccgnagactcgtgacggggccgattcaccatcctcagacgacaattccaaagaaccacgctgtttctacaaatgaaacngcctgagagccgatcgaccacgggccttagtacttacgngtgcgaggagacggtacggggaccctaacggtaaccgttactacgtccgttaagtcgggtaccgttcgacgggggacccgaaaggggtaacccccg

SEQ ID NO: 381244 - DNA, 557 bp, Homo sapiens
  misc_feature: GZ8MTXP02JKQD7.13.76.G10.1.454.CMB.2.raw
  modified_base (416)..(416): a, c, t, g, unknown or other
  modified_base (472)..(472): a, c, t, g, unknown or other
tcagtcacgtactacacgaccggtgctcgatttagtcactcatacagggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgccaggctccgaggggaggggctggagtgcgtcttcttttatttatagtagtggtagtaccatacctccgcagactccgtggacggggccgattcaccatcctccagagacaatccaagaacacnctgtttctacaaatgaaacagcctagagagaccgatcgacacggcgtgtattacgngtagcgagagacgtcgggggacccaacggtaacgttacctacgcgttaagtcggacggtcgtacgggggacccaagggggacccc

SEQ ID NO: 381245 - DNA, 534 bp, Homo sapiens
  misc_feature: GZ8MTXP02I5VY1.13.76.G10.1.454.CMB.2.raw
  modified_base (399)..(399): a, c, t, g, unknown or other
  modified_base (437)..(437): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggggaggcttggtccagcctggggggtccctgagactctcctgtgcagcctctggattcacctttagagctattggatgagctgggtcccgccaggctccgagggaggggctgggagtgggtgccaacataaagcaagttggaatgagaaatactatgtggactcgtgtgaagggccgattcacatctcaganacaacgccaaagactcactgtatctagacaaatgaacngcctagagagccgaaggacacggctgtactattacgtgtcgacgaagagtaagttgggggacgtaagggtatacggacagtcggacaacggtttaac

SEQ ID NO: 381246 - DNA, 545 bp, Homo sapiens
  misc_feature: GZ8MTXP02HYPDL.13.76.G10.1.454.CMB.2.raw
  modified_base (401)..(401): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctggggttttccttgttgctattttaaaaggtgcccagtgtgaggtgcagctggtggagtctgggaggaggcttgatccagccgtggggggtccctgagactctcctgtgcagcctctgggttcaccgtcagtcacacctacatgagctgggtcccgccaggcctccgaggggaaggggctggagtgcgtcttcttttatttatagtagtggtagtacatacctccgcagactcgtggagggccattccaccatctccaganacaatccaaagaacacgcttgtttctacaaatgaaacagcctagagagccgatgacacggcgtgtattactgtgcgagagacgtcggggacccacggaacgttacacgctagtcggacgtcgtacggggaccaacggggacccg

SEQ ID NO: 381247 - DNA, 628 bp, Homo sapiens
  misc_feature: GZ8MTXP02JROMP.13.76.G10.1.454.CMB.2.raw
  modified_base (296)..(296): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggtttccttgttgctattttaaaaggtgcccagtgtgaggtgcagctggtggagtctgggaggaggcttgatccagccgtggggggtccctgagactctcctgtgcagtcctcgtgggttcaccgtcagtcacacctacatgagctgggtccnccaggctccgaggggagggctggagtgcgttcttcttttattagtagtagtgggtaataccatactccgcaggacctcggtggacgggggcctattccaacctactcctacccgaagacgaacctaaattacccgaaaggaaaccctacgtcctttaggttttacctaacaaaagttcgaaaacctggtacccttaggaacgacggtacccgaagtcgaaccgtacgggtccgtagttacttacgtggcgacggagtaggacgtcgggggacccctaacggtaaccgttacacgctagtcgggacgtcggtcgggggaccaacggggacccg

SEQ ID NO: 381248 - DNA, 611 bp, Homo sapiens
  misc_feature: GZ8MTXP02H5VUP.13.76.G10.1.454.CMB.2.raw
  modified_base (439)..(439): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtccctgagactctcctgtgcagcctcgtgggttcaccgtcagtcacacctacatgagcgtcgggtccgccgaggcctccgaggggaaggggctggagtgcgttcttcttttattatagtagtggtagtacatactcgcagactccgtggacggggcattccacctagtctccagagactaatccaaagaacacgtctgtttacacaatanacagcctagagacgccgaagtcgaacgacggtccgtagttaacttacgtggtacgacggaaggaggacggtccgggggaacccctaacgggtaaaaccgtttacgaaccggtcgttaaacggtcgggtaacccggttcggtacgggggaacccgtaaacgggggaacccccg

SEQ ID NO: 381249 - DNA, 562 bp, Homo sapiens
  misc_feature: GZ8MTXP02GJDF0.13.76.G10.1.454.CMB.2.raw
  modified_base (295)..(295): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggttcaccgtcagtcacacctacatgagctgggtccnccaggctccgagggaggggctggagtgcgtctctttttattatagtagtggtatacatactccgcagactcgtggacggggccgattccaccatcctcagagacaatccaaagacacgcttgtttctacaaatgaacagcctagagacgccgatcgacacggccgtagtattacgtgtgcgagaggacgtcgggggaccctaacggaaccgttacctaacggcttaaggtcggtacggtcgtacgggggacccaaacggggaccccg

SEQ ID NO: 381250 - DNA, 481 bp, Homo sapiens
  misc_feature: GZ8MTXP02FKA2R.13.76.G10.1.454.CMB.2.raw
  modified_base (354)..(354): a, c, t, g, unknown or other
  modified_base (379)..(379): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggagcagctccaacattggggcacattatgatgtacactggtaccagcagtttccaggagcaggtcccagactcctcatcaatagtaacaacaatcggcccgcaggggtccctgaccgattcnctggctcagtctggcacctcagccnccctggtcatcactgggctcaggctgaggatgaggctgattattctgccagtcctatcgacagcagcctgaagtgcttcggtattcgggcgggggacccagg

SEQ ID NO: 381251 - DNA, 557 bp, Homo sapiens
  misc_feature: GZ8MTXP02HR701.13.76.G10.1.454.CMB.2.raw
  modified_base (294)..(294): a, c, t, g, unknown or other
  modified_base (403)..(403): a, c, t, g, unknown or other
  modified_base (487)..(487): a, c, t, g, unknown or other
  modified_base (517)..(517): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagtttttggctgagctgggttttccttgttgctattttaaaagtgcccagtgtgaggtgcagctggtggagtctggaggaggcttgatccagccgtggggggtccctgagactctcctgtgcagcctctgggttcaccgtcagtcacacctacatgagctgggtccnccaggcctccgaggggaaggggctgggagtggcgttctttcttttatttatagttaggtggtagtacctatacctccgcagacctcggtgacggggccattccacatcnccagagacattccaaagacacgcttagtttctacaaatgacagtcctagagatccgatgacacggcgtgtatcgtgtcgagagngacgtcggggacccaagtaccgtttaaccncgtaacgtagtacggtacgtcggacgggaccgacggaccg

SEQ ID NO: 381252 - DNA, 585 bp, Homo sapiens
  misc_feature: GZ8MTXP02H73DL.13.76.G10.1.454.CMB.2.raw
  modified_base (273)..(273): a, c, t, g, unknown or other
  modified_base (292)..(292): a, c, t, g, unknown or other
  modified_base (316)..(316): a, c, t, g, unknown or other
  modified_base (411)..(411): a, c, t, g, unknown or other
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagcccacctcagtgtccgtgtccccaggacagacagccagcatcacctgctctaggaataatggacagaataaatatactctggtatcagcagagtcaggccagtccccngtgcgtgcatctatcaagntcgacaagccggcctgacggtccnccgtgacgcgtattcgtcgtcgcctaccaacgtcgtacgggactcacgacccactcctacgacctacgcgacgggcccggacccgaggtctacgnggatggacggtctaggtacttacgttacgtggtacgacgggtcggtacgggacaggcgacgactcgtccggtcccgtactacgttccggttacgtttaccgggaaacggttccggggtaacccgaaaacgggttcccctaaaccggttacccgtaacggtacccgtaaccccgg

SEQ ID NO: 381253 - DNA, 569 bp, Homo sapiens
  misc_feature: GZ8MTXP02GO05V.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtggggttcaccgtcagtcacacctacatgagcgtgggtccgccaggctccgaggggaaggggctggagtgcgtctcttttatttatagtagtggtagtaccatactcgcagactcgtgagggccattcaccatctcagagacatccaagaacacgcttgttctacaaatgaaacagcctagagagccgatcgacacggcctagtactacgtgtgacgaggagacggtcggggacccctaacggtaaacgttaccgtacgaaccgttagtacgggaaccggttcggacgggggacccaaacggggtaacccccg

SEQ ID NO: 381254 - DNA, 530 bp, Homo sapiens
  misc_feature: GZ8MTXP02FQJWV.13.76.G10.1.454.CMB.2.raw
  modified_base (362)..(362): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagctgggtccgccaggcctccgagggaggtgctggagtgcgtctctttattatagtagtggtagtacatactccgcngacctccggtgacggggccgtattcaccatctccagacgacaattaccaagaacacgctgttcttacaaatgaacagcctagagagccgatcgacacggccgtgtattactgtgcgagagacgtcggggccacgaacgttactacgctagtacggacgtcgtacgggg

SEQ ID NO: 381255 - DNA, 552 bp, Homo sapiens
  misc_feature: GZ8MTXP02FL4YK.13.76.G10.1.454.CMB.2.raw
  modified_base (358)..(358): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggttcaccgtcagtcacacctacatgagctgggtccgccaggctccgagggaggggctggagtgcgtctcttttattatagtagtgtagtacatactcgnagactcgtggacgggcgatcacatctccagagacaataccaaagaacacgcttgtttctacaaaatgaaacagcctagagacgaccgatcgaacgacggccgtagtattacgtgtgacgagagacgtcgggggcccaacgtaacgttacacgtaacgtagtcgggacgtcgtacggggaccgaacgggaacccg

SEQ ID NO: 381256 - DNA, 590 bp, Homo sapiens
  misc_feature: GZ8MTXP02IFUB9.13.76.G10.1.454.CMB.2.raw
  modified_base (497)..(497): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagcctggggggtccctgagactctcctgtgcagcctctgggttcaccgtcagtcacacctacatgagctgggtccgccaggctccgagggaggggctggagtgcgtcttctttttattatagtagtggtagtaccatactccgcagacctccgtgggacggggccgattccaccatctccagagacaattccaaagaacacgtcttgtttacttacaaaatgaaacagcctggaagacggccgaagtcgaaccgacgggcccgttaggttactttacgngttggacgaaggaggacgtcgggggaccccacggtaaaccgtttacacgcgttagtacgggacgtcgtacgggggacccaaagggggaccccg

SEQ ID NO: 381257 - DNA, 516 bp, Homo sapiens
  misc_feature: GZ8MTXP02IQOQ0.13.76.G10.1.454.CMB.2.raw
  modified_base (237)..(237): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatntacttctggtatcagcagagtcaggccagtcccctgtgctggtcatctatcaagatgaccaagccggcctgacgggactcccccgtgacgcgattcgtctggcctcaactcgtagggaactcacgcccactctcgaccatcgagccggacccaggctagtggatgaggtctagtacttattacgtgtcaggcgtcgggacagcgagcacgtcgcccgctactcgttcgttaccggaacgtcgggaaccgtaggtccaccgtactaacgtcacgaacccg

SEQ ID NO: 381258 - DNA, 556 bp, Homo sapiens
  misc_feature: GZ8MTXP02JHXO1.13.76.G10.1.454.CMB.2.raw
  modified_base (396)..(396): a, c, t, g, unknown or other
  modified_base (440)..(440): a, c, t, g, unknown or other
  modified_base (479)..(479): a, c, t, g, unknown or other
tcagtcacgtactacacgaccggtgctcgatttagtcactcatacagggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctcgggtcccgccaggcctccgaggggaaggggctggagtgcgtcttcttttatttatagtagtggtagtaccatactcgcagacctcgtggaggggcctattccaccatccnccagagacaatccaaagaacacgcttgtttctacaaatgaaacngcctagagacgccgaatcgacgacgggcgtagtattacngtcgacgaggagacggtcgggacccaacgtaaaccgttcacgctagcggtacgtcggtacggggaccgaacgggacc

SEQ ID NO: 381259 - DNA, 498 bp, Homo sapiens
  misc_feature: GZ8MTXP02H3IBV.13.76.G10.1.454.CMB.2.raw
  modified_base (338)..(338): a, c, t, g, unknown or other
  modified_base (400)..(400): a, c, t, g, unknown or other
  modified_base (408)..(408): a, c, t, g, unknown or other
  modified_base (418)..(418): a, c, t, g, unknown or other
  modified_base (421)..(421): a, c, t, g, unknown or other
  modified_base (432)..(432): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataaattggacagataaatatacttcctggtatcagcagaagtcaggccagtcccctgtgctggtcatctatcaagatgaccaagcggccctacgagggactccccgtgacgcgacttcnctggcctccgaactcgtagggaactcgagcccactctcgaccatcgagcggaccaggctagngatggagntagattatangtnaggcgtggacngacagcactcggcccgatacgcgtcgtacggactgggaaccaggtccacgtctacgtcacgacccg

SEQ ID NO: 381260 - DNA, 515 bp, Homo sapiens
  misc_feature: GZ8MTXP02GP6WP.13.76.G10.1.454.CMB.2.raw
  modified_base (430)..(430): a, c, t, g, unknown or other
  modified_base (494)..(494): a, c, t, g, unknown or other
tcagtcacgtactacacgaccggtgctcgatttagtcactcatacagggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggattcacctttagtagctattggatgagctgggtccgccaggctccgagggaaggggctggagtgggtggcccaacataaagcaagtggaagtgagaaatactatgtggactctgtgaagggccgattcacatctccagagacaacgccaagactcactgatctgcaaaatcgaanagcctgagagccgagaccaggctgtctattactgtcgcgagagagttgggggacgaagggttanaggcagtcggacacggttaac

SEQ ID NO: 381261 - DNA, 535 bp, Homo sapiens
  misc_feature: GZ8MTXP02GJN4R.13.76.G10.1.454.CMB.2.raw
  modified_base (387)..(387): a, c, t, g, unknown or other
  modified_base (392)..(392): a, c, t, g, unknown or other
  modified_base (414)..(414): a, c, t, g, unknown or other
  modified_base (416)..(417): a, c, t, g, unknown or other
  modified_base (421)..(421): a, c, t, g, unknown or other
  modified_base (435)..(435): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcgtggtttctgttgctattttaaaaggtgccagtgtgaggtgcagctggtggagtctggaggaggcttgatccagccgtggggggtccctgagactctcctgtgcagcctctgggtcaccgtcagtcacacctacatgagctgggtccgccaggctccgaggggaaggggctggagtgcgtcttcttttatttagtagtagtggtataccatactcgcagacctcgtggacgggccattcaccatcncaganacatcaagacagctgttctaanannaacngcagagacgacganacgacgcggtcgtatatacgtgcgacgagagacggtacgggaccctaacgtaacgtacgacgtaagtacgtcggtacgtcggacgggaccgaacggaccg

SEQ ID NO: 381262 - DNA, 549 bp, Homo sapiens
  misc_feature: GZ8MTXP02G85BI.13.76.G10.1.454.CMB.2.raw
  modified_base (286)..(286): a, c, t, g, unknown or other
  modified_base (291)..(291): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctagaaataatggacagataaatatacttctggtatcagcagaagtcaggccagtcccctgtgctggtcatctancaagntgccaagcgccctgagggactccccccgtgacgtcgtattcgcgtggcctccaaacttcgtagggactcgacgccctactctacgaccatcgacgaccgggacccaggcctaagtgggattaggacggtactaggtaacttacgttacgtgttaccgagggtaccggtgggaacgagcgaggcacgtcgacccgtctagtcgtcgtacggacgcggggaaccgtaacggtccgacgtacctaagtccgaacgaccccg

SEQ ID NO: 381263 - DNA, 561 bp, Homo sapiens
  misc_feature: GZ8MTXP02FWX48.13.76.G10.1.454.CMB.2.raw
  modified_base (354)..(354): a, c, t, g, unknown or other
  modified_base (478)..(478): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggggttcaccgtcagtcacacctacatgagctgggtccgccaggctccgagggaggggctggagtgcgtctctttattatagtagtggtagtacatacncgacagactccgtggacggggcattccaccatcctccagagacaattaccaagaacacgcttagtttctacaaatgaaacagcctagagacgaccgatcgacacgggccgtagtattactggtncggtagagtacgtcgggggaccaacggtaaccgttacgtacggctaagtcggacgtcgtacgggggacccaagggggtacccg

SEQ ID NO: 381264 - DNA, 568 bp, Homo sapiens
  misc_feature: GZ8MTXP02FULZ2.13.76.G10.1.454.CMB.2.raw
  modified_base (502)..(502): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtgggtcccgccaggcctccgaggggaggggctggagtgcgtcttcttttatttatagtagtggtagtaccatacctccgcagacctccggtgacgggggccgtattccaccatctccagagacaattacccaaagaacacgcttgtttcttacaaaatgaaacagcctagagacgaccgatcgacgacggccgttagtattactgtagcgagagngtacggggcccaacgtaacgttacaacgctaagtcggaccgtcgtacggggaccaacggggacccg

SEQ ID NO: 381265 - DNA, 618 bp, Homo sapiens
  misc_feature: GZ8MTXP02HAFYC.13.76.G10.1.454.CMB.2.raw
  modified_base (371)..(371): a, c, t, g, unknown or other
  modified_base (436)..(436): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtctgggaggaggcttgatccagccgtggggggtccctgagactctcctgtgcagcctcgtgggttcaccgtcagtcacacctacatgagcgtcgggtccgccgaggcctccggaggggaaggggctggagtgcgttcttcttttatttagtagtagtggtagtacatactccgnagactcgtggacggggctatcaccatcctcagacaacataccaaagaccacgtcttgtttactanaaatcgaaacagcctaggacgacgaccgaatacgaccgaccgggtccgttagttaactttacgtggtacggacggaaggaggtacggtccgggggaaccccctaaacggtaaaccgtttaccgtacgtccgttaaggtacggggtaccgttcggtacgggggaacccgaaacggggaccccg

SEQ ID NO: 381266 - DNA, 552 bp, Homo sapiens
  misc_feature: GZ8MTXP02HDUYD.13.76.G10.1.454.CMB.2.raw
  modified_base (274)..(275): a, c, t, g, unknown or other
  modified_base (279)..(279): a, c, t, g, unknown or other
  modified_base (284)..(284): a, c, t, g, unknown or other
  modified_base (287)..(287): a, c, t, g, unknown or other
  modified_base (296)..(296): a, c, t, g, unknown or other
  modified_base (298)..(298): a, c, t, g, unknown or other
  modified_base (300)..(300): a, c, t, g, unknown or other
  modified_base (302)..(302): a, c, t, g, unknown or other
  modified_base (304)..(304): a, c, t, g, unknown or other
  modified_base (309)..(309): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctattttaaaaggtgcccagtgtgaggtgcagcgtggtggagtctggaggaggcttgatcagcctggaggtcctgagactctcctgtgcagctctggttcacgtcatcacacacanngcgngcgcngcncgaggaggngngngngntcttntttattatagtagtgtagtatatactcgcacgacgtcgtggacgggaccgtactacactactctacagaagaactaactaacaaacgaaacacgtacttacgttacttactaaactaacgaaacacgacgtagagacgacgagacgacgacgtacgtagtatacgtagtacgagagacgagacggaccgaacgtaacgtaacgtaacgtacgtacgtacggacgtacggtacggacggaacgg

SEQ ID NO: 381267 - DNA, 625 bp, Homo sapiens
  misc_feature: GZ8MTXP02HADKL.13.76.G10.1.454.CMB.2.raw
  modified_base (296)..(296): a, c, t, g, unknown or other
  modified_base (335)..(335): a, c, t, g, unknown or other
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagcccaccctcagtgtccgtgtccccaggacagacagccagcatcacctgctctggaaataattggcagataaatatacttcctggtatcagcagaagtcaggccagtcccctgtgctggtcatctatcaagntgccaagccggccctcgagggactccctgacgcgattcnctcgggcctaccaactcgtacgggaactcacgccctactcctacgacccatccgacggccgggaacccagggcctagtcggaatggaacggcgttagaaccttagttaccgtgttaccgagggtaccggttgggaacgaacgccgaacggaccgtaaccgttccggacccccggttacgttaacggttccggtttaccggttaaccgggtaaaccggttaaccggggtaaacccgtaaacggggttaccccgtaacccggttaaccgttaaaccggtacccgaaacccgg

SEQ ID NO: 381268 - DNA, 566 bp, Homo sapiens
  misc_feature: GZ8MTXP02HBOOT.13.76.G10.1.454.CMB.2.raw
  modified_base (467)..(467): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtccctgagactctcctgtgcagcctcgtgggttcaccgtcagtcacacctacatgagctgggtccgccgaggcctccgaggggaaggggctggagtgcgtcttcttttattagtggtagtggtagtacatacctccgcagaccttcgtgggacggggccgtattccaccatcctacagagacaactacaagaacacgtcttgtttttacaaatgaacagcctagagtagccgatgacncggccgtagtattactgtgcgagagagtcgggaccaacggtaccgttacgtacgactaagtcggaacgtcggtacgggaccgaacgggaccgtacccgg

SEQ ID NO: 381269 - DNA, 559 bp, Homo sapiens
  misc_feature: GZ8MTXP02HGIGC.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtgggtccgccgaggcctccgaggggaaggggctggagtgcgtcttcttttattatagtagtggtagtaccatactccgcagacctccgtggacggggccgattccaccatcctccagagacaattccaaagaacacgcttgtttctacaaatgaaacagcctgagacgccgatgaccgacggccgtagtatacgtgtgacgagagacgtcggggacccacggaaccgttacacgcgtagtcggacgtcggtacggggaccgaacgggacccg

SEQ ID NO: 381270 - DNA, 567 bp, Homo sapiens
  misc_feature: GZ8MTXP02JV59W.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagcgtgggtccgccaggctccgaggggaaggggctgggagtgcgtcttcttttattatagtagtggtagtacatactccgcagctccgtggacggggccgattcaccatcctccaagacgaactaattacccaaagaaccacgtcttgtttacttacaaaatgaaactagcctagaagacgtaccgagtcgacgacgggtccgttagtattacgtgtgacgagagacgtacggggaccccaaggtaacttaacgacgtactagtcggacgtcgcggggaaccg

SEQ ID NO: 381271 - DNA, 539 bp, Homo sapiens
  misc_feature: GZ8MTXP02JB3XR.13.76.G10.1.454.CMB.2.raw
  modified_base (364)..(364): a, c, t, g, unknown or other
  modified_base (386)..(386): a, c, t, g, unknown or other
  modified_base (389)..(389): a, c, t, g, unknown or other
  modified_base (412)..(412): a, c, t, g, unknown or other
  modified_base (470)..(470): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtgggtccgccaggcctccgaggggaaggggctggagtgcgtcttcttttattatagtagtggtatacatactcganagactcgtggagggcattcacntcncagagacacgacaagaacctccngtactctagacaaatcgaaacagcctagagagcaggacgacgacggtcgtgtatacgngtgacgagacgacgtcgggcccaagtacgttacaacgtctagtcggacgttcgacggggaccaacgggg

SEQ ID NO: 381272 - DNA, 731 bp, Homo sapiens
  misc_feature: GZ8MTXP02HYZ9Z.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgccagtgtgaggtgcagctggtggagtctgggaggaggcttgatccagccgtgggggtccctgagactctcctgtgcagcctcgtggggttcaccgtcagtcaccacctacatgagcgtcgggtccgccgaggcctaccggaggggaaggggcgtagggagtggcgttctttactttttaattagtaagttaggtaggtagtaccatacctccgacacgacgtcggtgggacgggggcctacttccaacctactcctccaaagaacaaactaaacttaccccgaaaaggaaccctacggtccttaggtttttacctaaactaaaagttacgaaaaccacggttaccctaggaaaggacgtacccggaatacggaaacccgtacggggtcccgttaggttaaacttccgttagggtacgaccgggaaaaggaggacgggttacccggggggaaccccctaaaacgggtaaaccgttttaaccggacccggtaagttaaacgggtacggggtacccggttacggggtaccgggggaacccgtaaaaacgggggtaccccccgg

SEQ ID NO: 381273 - DNA, 608 bp, Homo sapiens
  misc_feature: GZ8MTXP02JQKSQ.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtcgggtccgccgaggcctccgaggggaaggggctggagtgcgttcttctttttattatagtagtggtagtaccatactccgacagacctccgtggacggggcctattccaccatcctacccaagacgaactaacttaccaaagaacacgtccttgtttacctacaaatgaacagcctaggagacgccgatcggaccgaccgggtccgtagttacttacgtgtacggacggagaaggcggtaccgggggacccctaacggtaaccgtttacaacggtctaggtacggtacggtcggtccgggggaaccaacggggtaccccg

SEQ ID NO: 381274 - DNA, 563 bp, Homo sapiens
  misc_feature: GZ8MTXP02H02DE.13.76.G10.1.454.CMB.2.raw
  modified_base (459)..(459): a, c, t, g, unknown or other
  modified_base (479)..(479): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctctgggttcaccgtcagtcacacctacatgagcgtgggtccgccgaggcctccgaggggaaggggctggagtgcgtcttctttttatttatagtagtggtatacatactcgcagaccttccgtggacgggccacttccaccatctcagagacaatccaaagaacacgcttgtttactacaaatgaaacagcctagagacgccgancgacacggtcgtgtattacngtgacgagagacgtacggggaccctacgaacgttacgacgaacgtagtacgggacgttcggacggggacccaaaggggaccccg

SEQ ID NO: 381275 - DNA, 585 bp, Homo sapiens
  misc_feature: GZ8MTXP02HLYJV.13.76.G10.1.454.CMB.2.raw
  modified_base (357)..(357): a, c, t, g, unknown or other
  modified_base (367)..(367): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtggggttcaccgtcagtcacacctacatgagcgtgggtcccgccgaggcctaccgaggggaaggggctggagtgcgtcttcttttattatagtagtggtanacatactcgnagactcgtggacggggcattccaccatctccagacgaacaattacccaaagaaccacgtcttgtttacttacaaaatgaaacagcctaggagagccgatagaccacggccgtagtattacgtgtcgacgagagacggtcgggggaccccaacggtaaacgttaccgtaacgcttaagtcgggtaccgtcggtacgggggacccgaaacggggaccccg

SEQ ID NO: 381276 - DNA, 605 bp, Homo sapiens
  misc_feature: GZ8MTXP02FZKPC.13.76.G10.1.454.CMB.2.raw
  modified_base (438)..(438): a, c, t, g, unknown or other
  modified_base (474)..(474): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtggggggtccctgagactctcctgtgcagcctctggtcacgtcagtcacacctacatgagctgggtccgcaggctccgagggaggggctggagtgcgtcttcttttatttatagtagtggtataccatacctcgcagacctcggtggacggggcctagttccacctatcctacagacgactaactaccaaagaactacgctttagtttcctaaanaaactacgaaacgacgtacctaggacgacgacgtanaccgacgtacggtacgtatacgttacgtgacgacggagacggtacggtaccgggaaccctaacggtaaccgttacgtacgtaacgttacggtacggtaccggtcgggacggggaacccgtaacgggacccg

SEQ ID NO: 381277 - DNA, 634 bp, Homo sapiens
  misc_feature: GZ8MTXP02GYYKN.13.76.G10.1.454.CMB.2.raw
  modified_base (315)..(315): a, c, t, g, unknown or other
tcagtcacgtactacacgaccggtgctcgatttagtcactcatacagggggctgggcctcaggaagcagcatcggaggtgcctccagccatggcatgggatccctctcttcctcggcgtccgttgcttactgcacgaggatccgtggcctcctatgagctgactcacgccaccctcacgtgtccgtcgtccccgaggaccagaccagccagcatcacctgctctaggaaataatggacaagtaataaatataacttcgtggtatcagcagaagcacggccacggtcccctgtcgcctggtcatctatcgtaagtntcgaccaacggcccggaccctagagggtctcccccggtgacgtcgtattcgtcgtcggcctcccgaaacgttcgttacgggaaaccttacgaacgtcccaacgttcgacgaccctagccgaacggaccgggacccgagggtacttaggtaggtagtacggtagtacgtagtaacttacgttaacgtcgttaccggaggtcgggtcggaacgtacggcgacgacgtaacgcgtaccgtactagtacgtaccgttacggaaccgttacggggaacccgtaacggtacccgtaccgtaccgtaacgtccgtacgaacccccg

SEQ ID NO: 381278 - DNA, 541 bp, Homo sapiens
  misc_feature: GZ8MTXP02IYIXN.13.76.G10.1.454.CMB.2.raw
  modified_base (368)..(368): a, c, t, g, unknown or other
  modified_base (429)..(429): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggggttcaccgtcagtcacacctacatgagctgggtccgccaggcctccgagggaggggctggagtgcgtctcttttattatagtagtggtagtacatactccgcagactccgngaggggccgattccaccatctcagagacatccaagaacacgctgtttctacaaatgaaacngcctgagagccgatcgacacggcccgtgtattactgtgacgagagagtcggggcccacggaaacgttctacgccgtagtcggaccgtcgtacggggaccgaacgggtacccg

SEQ ID NO: 381279 - DNA, 617 bp, Homo sapiens
  misc_feature: GZ8MTXP02H3RRF.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgccagtgtgaggtgcagctggtggagtctggaggaggcttgatccagccgtggggggtcctgagactctcctgtgcagcctcgtgggttcaccgtcagtcacacctacatgagcgtgggtccgccaggcctccgaggggaaggggctggagtgcgttcttctttttattatagttagtggtagtaccatacctcgacagacctccggtggacgggggcctacttccaccatcctacccaagacgaacctaattcccaaaagaaccacgtcttcgtttactacaaatcgaaactagcctagaagacgccgagtacgaaccgacgggtccgttagtacttacgtggtacgcggaaggaggacgtccgggggacccctaaacggtaacgtttaccaaccggtcttaagtcggggacccgttcggacgggggaaccctaacgggggacccg

SEQ ID NO: 381280 - DNA, 595 bp, Homo sapiens
  misc_feature: GZ8MTXP02IFVWO.13.76.G10.1.454.CMB.2.raw
  modified_base (367)..(367): a, c, t, g, unknown or other
  modified_base (484)..(484): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagctcgggtccgccgaggcctccgaggggaaggggcgtggagtgcgttcttctttttattatagtagtggtagtacatactcgnagtactcgtggacgggtcgtttcaccgtatctacagagacaattccaaagacacgtctgtttctacaaatgaacagcctagacgtagccgatcgacgacggtcctagttacttacgngtacgcgagaggtacgtcgggggacccaaacggtaaccgtttacgtaacgtcgtaaagtcggggaaccgtttcgggacggggacccgaaaacgggggtaccctaacccggg

SEQ ID NO: 381281 - DNA, 535 bp, Homo sapiens
  misc_feature: GZ8MTXP02FIS3Q.13.76.G10.1.454.CMB.2.raw
  modified_base (426)..(426): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaaggtgcccagtgtgaggtgcagctggtggagtctggaggaggcttgatccagcctggggggtcccgtgagactctcctgtgcagcctctgggtcaccgtcagtcacacctacatgagctgggtccgccaggctccaggggaaggggctggagtgcgtctcttttatttatagtagtggtagtaccatacctcgcagactcgtgaggggccgattcaccatctccagagacaattcaagaacacgctgtttctcaaatnaacagctagagagccggatgacacggcgtcgtattactgtgcgagagacgtcgggggcccacgaacgttactacgctacgtggacgtcgtcggggaccacgggaacccg

SEQ ID NO: 381282 - DNA, 554 bp, Homo sapiens
  misc_feature: GZ8MTXP02GOZIX.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggcctccgaggggaagggctggagtgcgtcttcttttatttatagtagtggtagtacatactccgcagctccgtggacggggccgattcaccatctccagagacaaattccaaagaaccacgtcttgtttacttacaaaattgaaacagacctagacgagccgatgacacggccgtagtattacgtgtgcgagagacgtcgggggacccaaggtaaccgttaacgtacgctagtaggacgtcgtacggggaacccg

SEQ ID NO: 381283 - DNA, 556 bp, Homo sapiens
  misc_feature: GZ8MTXP02IR1N8.13.76.G10.1.454.CMB.2.raw
  modified_base (370)..(370): a, c, t, g, unknown or other
  modified_base (418)..(418): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggggttcaccgtcagtcacacctacatgagctgggtccgccaggctccgagggaggggccggagtgcgtctcttttattatagtagtggtagtacatactccgcagactccgtgngggggccattcaccatctcagagacaattccaagacacgctgtttctnaaatgaacagcctagacgagcccgatgaccgacggccgtgtacttacgtgtgcgagagagtcggggacccaacggtaacgttacgtaccgactaagtcgggacgtcgtcgggggacccgaacggggtacccaaccggg

SEQ ID NO: 381284 - DNA, 564 bp, Homo sapiens
  misc_feature: GZ8MTXP02HZQ0J.13.76.G10.1.454.CMB.2.raw
  modified_base (382)..(382): a, c, t, g, unknown or other
  modified_base (429)..(429): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctctggttcaccgtcagtcacacctacatgagcgtcgggtccgccaggctccgagggaggggctggagtgcgtcttcttttattatagtagtggtagtacatactcgcagactcgtggagggcatcacntctccagagacatacaagaacacgtctgtttactacaaatcgaaacngacctgacgacgaccgatacgacgacggtcgtagttacttacgtagtgacgaggacgtacgtcgggggaccccaacggtaaaccgttacacgtcgtaagtcggacggtccgtacgggggaccgaacggggacccg

SEQ ID NO: 381285 - DNA, 545 bp, Homo sapiens
  misc_feature: GZ8MTXP02F5GVM.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaatgtgcccagtgtgaggtgcagctggtggagtctggaggaggcttgatccagcctgggggtccctgagactctcctgtgcagcctctgggttcaccgtcagtcacacctacatgagctgggtccgccaggctccgagggaaggggctggagtgcgtctcttttattatagtagtggtagtacatactccgcagactccggtgaggggccgattcacatctccagagacaattccaagaacacgctgtttctacaaatgaaacagcctagagagaccgatgacacggtcgtgtattacgtgtcgcgaggacgagtcgggggacccaacggaaccgttacgaacgtctaagtcggacgtcggtacggggaccgaaacgggg

SEQ ID NO: 381286 - DNA, 597 bp, Homo sapiens
  misc_feature: GZ8MTXP02GPNAZ.13.76.G10.1.454.CMB.2.raw
  modified_base (448)..(448): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtgggtccgccaggcctccggaggggaaggggctggagtgcgtcttcttttattatagtagtgtatacatactcgcagactccgtggacgggccgtattccacctatctccaagacgaacaaatccaaagaaccacgtcttgtttctacaaaatcgaaacngacctgaagcgccgaatcgaacacgggtccgttagtattacgtgtacggcgaaggagacggtcgggggacccctaacggtaaaccgtttaacaccgtcgttaagtcgggtaccttcgggtacgggggacccgtaaacggggaacccccg

SEQ ID NO: 381287 - DNA, 490 bp, Homo sapiens
  misc_feature: GZ8MTXP02F7KFX.13.76.G10.1.454.CMB.2.raw
  modified_base (234)..(234): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagaggtcaccatctcctgcactgggancagctcaacattggggcacattatgatgtacactggtaccagcagtttccaggagcaggtcccagactcctcatcaatacgtaacaacaatccggcccgcacggggtccctgaccgattcctctggctccagtctggcactcagcctcctgtcatcactgggctccgagctgagatcgaggctgtattattctgccagtcctatcgacacgcacgcctgaagtcgtacgttcggtattcgggcgggggtacccagg

SEQ ID NO: 381288 - DNA, 569 bp, Homo sapiens
  misc_feature: GZ8MTXP02F3TY9.13.76.G10.1.454.CMB.2.raw
  modified_base (375)..(375): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtcccgccaggctccgaggggaggggctggagtgcgtcttcttttatttatagtagtggtagtaccatactccgcagaccttccgnggacggggccgattccaccatcctccagagacaatcccaaagaacacgtcttgtttacttacaaaatgaaacagcctaggagagacccgatcgacacgggccgttagtattacgtgtgacggagagacgtcggggacccaacgtaacgttacacgcgtagtcggacgtcggtacggggaccaacggggaacccg

SEQ ID NO: 381289 - DNA, 626 bp, Homo sapiens
  misc_feature: GZ8MTXP02G53RT.13.76.G10.1.454.CMB.2.raw
  modified_base (473)..(473): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctcgtgggttcaccgtcagtcaccacctacatgagcgtcgggtcccgccaggcctaccggaggggaaggggctggagtgcgtcttcttttatttatagtagtggtagtaccatactccgcagaccgtcgtggacggggtccgtattccaccactcctacccaagacgaaccaaattcccgaaaagaacccacgtccttgttttacctacaaatgaaaccncgacctagagacgcgagtcgaaccgacggtccgtagttacttacgtggtcgacggaggaggtacgggtccggggaacccctaacggtaaaccgttacgacggtcgttaaggtacgggtaccggtcggacgggggaacccgaacggggaccccg

SEQ ID NO: 381290 - DNA, 566 bp, Homo sapiens
  misc_feature: GZ8MTXP02JPFYY.13.76.G10.1.454.CMB.2.raw
  modified_base (350)..(350): a, c, t, g, unknown or other
  modified_base (368)..(368): a, c, t, g, unknown or other
tcagtcacgtactacacgaccggtgctcgatttagtcactcatacagggggcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctgggggtccctgagactctcctgtgcagcctctgggttcaccgtcagtcacacctacatgagctgggccgccaggctccgaggggagggctggagtgcgtcttcttttatttatagtagtggtagtacatactcccgnagactcgtgacggggccnttcacctatcctcagacgactaacttccgaaagaaccacgtcttgtttacttacaaatcgaacagcctagagacgccgatgaccgacggccttagtattacgtgtagcgtagagacgtcggggacccacggtaaccgttacacgccttagcggtccgttacggcggggaccgaacggggacccacggtacctacccgg

SEQ ID NO: 381291 - DNA, 596 bp, Homo sapiens
  misc_feature: GZ8MTXP02GN3RB.13.76.G10.1.454.CMB.2.raw
  modified_base (395)..(395): a, c, t, g, unknown or other
  modified_base (524)..(524): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgagctggtggagtctggaggaggcgttgtatccacgccgtcgggggtccggtcgagacgtctcctgtgcgagcctctcgggttcgtaccgtcagtcaccacctaccatgagcgtcgggtccggccgacggcgtcccgaggggaaggggcggtggaggtgcgtcttcttttatttattagtagtggtagtacactactcgcagactcgtggnggggccgatcaccatctccacgagacaaattcaaacgaacacgcttgtttcttacaaatcgaacacgcctagagacgccgaactgaacccacgggtccggttattaattaccgtgtgacggaggaacgngtccgggggacccaaacgtaacgtttacacgctaagtgggaccgtcggtggggacccgaagggtacccacgg

SEQ ID NO: 381292 - DNA, 593 bp, Homo sapiens
  misc_feature: GZ8MTXP02HSG9U.13.76.G10.1.454.CMB.2.raw
  modified_base (255)..(255): a, c, t, g, unknown or other
  modified_base (297)..(297): a, c, t, g, unknown or other
tcagtcacgtactacacgaccggtgctcgatttagtcactcatacaggggggagaggagcccagcactgggattcccaggtgtttccattcagtgatcagcactgaacacagaggactcaccatggagttgggactgagctggtattttccttttggcttattttaaaaggtgtccagtgtgaagtgcagctggtggagtcgtgggggagcttggtacagcctggcaggtccctgagactctcctgtgcagcctntggattcactttgatgattatgccatgcacgtggggtcccgnaagcctaccgaggggaacgggcctgggagttgggtctcgagggttatagatggaaatggtgtagcagtaggcttagtggcggtactcgtggtagaacgggccgtattcgaccatctaccagacgacaacgccaaagacctccctgtactctagacaaatgaacagcctaggagagcgtaggacggacgaccgggtcctttagttatttacttaggtacgtaaccgaaaagtaaccgtaaacccctaaacccccgttttacggtaattttttacggggaagtttacggtttaaacgg

SEQ ID NO: 381293 - DNA, 574 bp, Homo sapiens
  misc_feature: GZ8MTXP02I4IME.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctatttaaaaggtgcccagtgtgaggtgcagctggtggagtctggaggaggcttgatccagccgtgggggtccctgaggggactctcctgtgcagcctctgggttcaccgtcagtcacacctacatgagcgtcgggtccgccaggctccgaggggaagggctggagtgcgtcttctttattatagtagtgtagtacatactccgcagcgtccgtggacggggcctagttcaccatcctccaagacgaacaattcccaaaagaaccacgcctttgtttacctacaaaatcgaaacacggcctagagacgccgaagtgaccgacggtcgtagtattacgtcggtgacgaggagacgtcggggaccccacggtaaacgttcgaaccgtctacgtggaacgttcggacggggaacccg

SEQ ID NO: 381294 - DNA, 583 bp, Homo sapiens
  misc_feature: GZ8MTXP02H959T.13.76.G10.1.454.CMB.2.raw
  modified_base (295)..(295): a, c, t, g, unknown or other
  modified_base (368)..(368): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggttcaccgtcagtcacacctacatgagctgggtccnccaggcctccgaggggaaggggctggagtggcgtcgttctttttattatagtagtggtagtaccatactccgnagactccggtgagggggccattccacctatctccagagactaattccaaagaacacgcttgtttactacaaatgaaacagtcctgatagccgatgacacggcctgtactagtgtgcgagtaggactcgggggacccctaaaggtaacccgtttaacgacgtaaccgtaagttcggggacgttaccggtcgggggacccgaaaacgggggaccccg

SEQ ID NO: 381295 - DNA, 812 bp, Homo sapiens
  misc_feature: GZ8MTXP02GBEYZ.13.76.G10.1.454.CMB.2.raw
  modified_base (680)..(680): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtcgggtcccgccgaggcctaccggaaggggaacggggcgtagggagttcggtccggtttcctttctttttaagtttaagtaggttaaggttagggtttaacgttaaccctacgttaacccgttccccggacctaacggtaaccccgtttcccgggttcgggggaaccggggggtacccccgttaaacgtttaccccgaaaccccgtaaacttcccccgttacccgaaaaggggtaaacgtaaaccctaaaactttacccccgaaaaaggtaaaacccctaacccgggtcccttttaaggtttttacccttaaccgaaaaattcggaaaaacctcggaccctagggaacgacgtcccggaaagtcgaaccgtacgggtccgttagtacttaccgnggtaccggacgtaagaggtacggtaccgggggaccctaaaacggttaaaccgttaccgtaacggaaccgtttaaaggccggggttaaacccggtcgggtaccgggggaacccgaaaacgggggtaacccccg

SEQ ID NO: 381296 - DNA, 711 bp, Homo sapiens
  misc_feature: GZ8MTXP02ID1BM.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggaggaggcttgatccagccgtggggggtccctgagactctcctgtgcagcctcgtggggttcaccgtcagtcacacctacatgagcgtcgggtcccgccgaggcctccggaggggaacggggctgggagtgcgttcttctttttattatagttagtggtagtaccatacctcgcagacctccggtggacgggggcctactttccgaacctactcctacccgaagacgaaacctaaacgttcccaaaagaaaccctacgtactttagttttaccttaaccgaaaattcggaaaacctacgtcccgtaggaacgacgtcccggaatcggaaaccgtaccggggtcccgttagttaaacgtttaccgtagggttacggacggaagggacggtaacggttccggggggaccccctaaaacgggtaaaccggttttaaccgaccggtaaccgttacggtacgggtaccggttacgggtaccgggggaacccgtaaaacgggggaacccccgg

SEQ ID NO: 381297 - DNA, 592 bp, Homo sapiens
  misc_feature: GZ8MTXP02JM5CO.13.76.G10.1.454.CMB.2.raw
  modified_base (385)..(385): a, c, t, g, unknown or other
  modified_base (425)..(425): a, c, t, g, unknown or other
tcagtcacgtactacacgaccggtgctcgatttagtcactcatacagggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtgggtccgccaggctccgagggaggggctggagtgcgtctcttttattatagtagtggtatacatactcgcagactcgtgagggcatcacatctcaganacaatccaaagaacacgtcttgtttactacaaatgaaacngcctagagacgccgaatcgaccgacgggtccgttagtaactttacgtgtcggacggaaggaaggacggttacgggggacccctaaacgggtaaaccggtttacctaaccggcttaaaggtcggggaaccggttccggtacgggggacccgaaacgggggtaaccccg

SEQ ID NO: 381298 - DNA, 551 bp, Homo sapiens
  misc_feature: GZ8MTXP02JM6D0.13.76.G10.1.454.CMB.2.raw
  modified_base (437)..(437): a, c, t, g, unknown or other
  modified_base (472)..(472): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgccaggctccgaggggaggggctggagtgcgtcttctttttattatagtagtggtagtaccatactccgcagacctccgtggacggggccattcaccatctccagagacaatccaagaacacgtctgtttctacaaatgaaacngcctagagagccgatcgacacggcgtgtattacgngtgcgagaggacgtcgggggaccccacggtaacgttacacggctaagtcggacgtcgtcgggggaccaaggggaccccg

SEQ ID NO: 381299 - DNA, 550 bp, Homo sapiens
  misc_feature: GZ8MTXP02HXE4X.13.76.G10.1.454.CMB.2.raw
  modified_base (279)..(279): a, c, t, g, unknown or other
  modified_base (343)..(343): a, c, t, g, unknown or other
  modified_base (376)..(376): a, c, t, g, unknown or other
tcagtcacgtactacacgaccggtgctcgatttagtcactcatacagggggggagaggagcccagcactgggattccgaggtgtttccattcggtgatcagcactgaacacagaggactaaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctanatgagctggggtccgccaggctccgaaggggaagggctgggagtgcgttcttctttttatttanagtagtggtatacatactccgcagctccggtgngggggccattcaccatctcagagacaatccaaagaacacgctgtttctacaaatgaaacagcctgagagcccgatcgacacggccgtgtattactgtgcgagagagtcggggacccacggaacgttactacgactaacgtggacgtcgtaggggacccaaaggggaccaaccgg

SEQ ID NO: 381300 - DNA, 623 bp, Homo sapiens
  misc_feature: GZ8MTXP02I935S.13.76.G10.1.454.CMB.2.raw
  modified_base (448)..(448): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagcgtgggtcccgccaggctccgaggggaaggggctggagtgcgttcttcttttatttatagtagtggtagtaccatactcgcacgacctccgtgggacggggcctattccacctactcctccgaagacgaactaacttaccaaagaaccacgtcttgtttactanaaaactgaaacacgcctaggaacgacgacccgtaatacgaaccgtacgggtccgttagttacttacgtggtacgacggtaggaggacggtccgggggacccctaacggtaaaccgttcgtaacgccgttaaggacgggtaccgtcggtacgggggaccctaaacgggggaccccg

SEQ ID NO: 381301 - DNA, 556 bp, Homo sapiens
  misc_feature: GZ8MTXP02IK6I3.13.76.G10.1.454.CMB.2.raw
  modified_base (435)..(435): a, c, t, g, unknown or other
  modified_base (470)..(470): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagcctggggggtccctgagactctcctgtgcagcctctggggttcaccgtcagtcacacctacatgagctgggtcccgccaggctccgaggggaggggctggagtgcgtcttcttttatttatagtagtggtagtacatactccgcagactcgtggacgggccattccaccatctccagagacaatccaagaacacgcttgtttctacaaatgaaacngcctgagagccgatcgacacggccgtagtattacngtgacgagagacgtcgggggacccacgaaaccgtttcacggctacgtcgggaccgttcggtacgggggacccaaagggggaccccg

SEQ ID NO: 381302 - DNA, 610 bp, Homo sapiens
  misc_feature: GZ8MTXP02J2GG0.13.76.G10.1.454.CMB.2.raw
  modified_base (334)..(334): a, c, t, g, unknown or other
  modified_base (375)..(375): a, c, t, g, unknown or other
  modified_base (397)..(397): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcgtggttttccgttgtaggctattttaaaaggtgccagtgtgaggtgcagctggtggagtctggaggaggcttgatccagcctgggggggtccctgagactctcctgtgcagcctctggggttcaccgtcagtcacacctacatgagcgtgggccgccaggctccgaggggaaggggctggagtgcgtactttntttattagtagtagtgtataccatacgcgacagccgtcggnggacgggcgtactacacactcncacgacgaactaactaacaacgaacacgtacttacgtttacttaactaaacgtacgaacgacgacgagacgacgacgagtacgaccgaccggtcgttacgttacgttacgtgtacgacggaggacggacgggtaccgggacccgtaaccgtaaccgttaaccgtacgtaacgtacggtacggtacggtacggtacgggaccggaaccggaccg

SEQ ID NO: 381303 - DNA, 598 bp, Homo sapiens
  misc_feature: GZ8MTXP02I0QD2.13.76.G10.1.454.CMB.2.raw
  modified_base (245)..(245): a, c, t, g, unknown or other
  modified_base (258)..(258): a, c, t, g, unknown or other
  modified_base (265)..(265): a, c, t, g, unknown or other
  modified_base (275)..(275): a, c, t, g, unknown or other
  modified_base (305)..(305): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagcgtggtttcgtgtaggctattaaaggtgccagtgtgaggtgcagctggtggagtcgtggaggaggcttgatccagccgtgggggtcctgagctctctgtgcncgtctcgtcgtcncgtcacncacacacagngcgcgtcggtccgcgacgcgcggaggaggngtggtgtcgtcgttcttactttattagtagtagtacgtagtactactactacgacgacgtcgtcggtacggacggtacgtactactactactactacgagaacgaactaactaacgaacgaacgtacgtacttacttactaactaaagtacgaacgacgtacgtagacgacgacgtacgtacgtacgtacggtacgttacgtacgttacgtcgtagaggacggacggtacggtaccggaccgtaacgtaacgtaacgtacgtacgtacgtacggtacggtacggtacggacgg

SEQ ID NO: 381304 - DNA, 578 bp, Homo sapiens
  misc_feature: GZ8MTXP02I4KP2.13.76.G10.1.454.CMB.2.raw
  modified_base (238)..(238): a, c, t, g, unknown or other
  modified_base (295)..(295): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtcccgtgtccccaggacagacagccagcatcacctgctctaggaaataatggcagataaatntacttcctggtatcagcagaagtcaggccagtcccctgtgctggtcatctatcaagntcgcaagccggccctgagggactccccctgacgcgtattctcgtggccttcccaaacgtcgttacggggaaaccttcgaacgcccaactctacgacctatccgaaggccggacccagggtcctagagactggaggtctggtactattacgtgtaccgtagggcggttagggacgagacgaacggcaaccggtcgccccgtagttaacgtcgttacgttaccggaacgttacgggaaccgaagggtccgtaacccggtaccgttaacgtaccgaacgaaccccg

SEQ ID NO: 381305 - DNA, 548 bp, Homo sapiens
  misc_feature: GZ8MTXP02JZNMQ.13.76.G10.1.454.CMB.2.raw
  modified_base (381)..(381): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgagggaggggctggagtgcgtctcttttattatagtagtggtagtaccatactcgcagactcgtgacggggcgattcacnctctccagacgacattccaaagaacacgcttgtttctacaaatgaaacagcctgagacgccgatcgacacggccgtgtatacgtgtgacgagagacgtcggggacccaacggaaccgttacctacgcgttagacgggacgtcgtacgggggaccaacgggggacccg

SEQ ID NO: 381306 - DNA, 660 bp, Homo sapiens
  misc_feature: GZ8MTXP02HTF02.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtcgggtccgccgaggcctccgaggggaacggggcgtggagtgcgttctttcttttatttatagtagtggtagtacatactcgcagacctcgtggaggggcattccaccatctaccagacgactaacttaccaaagaaccacgtctttgtttactacaaaatcgaaactacgccctaggaacgacgacccgaatcggaacccgtaaccggggtcccgttaggttaactttaccgtggttacgggacgaagggtaaggaacggttccggggggaaccccctaaccgggtaaaaccgtttaacccgtaacggtaaccgttaaggtacggggtaaccggttcggtaccgggggaacccgaaacgggggtaaccccg

SEQ ID NO: 381307 - DNA, 574 bp, Homo sapiens
  misc_feature: GZ8MTXP02FP6ZF.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagcgtgggtttccttgttgctattttaaaaggtgccagtgtgaggtgcagctggtggagtctggaggaggcttgatccagccgtggggggtccctgagactctcctgtgcagcctctggggtcaccgtcagtcacacctacatgagctgggtccgccaggctccgaggggaggggctggagtgcgtctcttttattatagtagtggtatacatactcgcagactccggtggacggggccattcaccatctccagagacaatccaaagaacacgcttgtttctacaaatgaaacagcctagagagccgatcgacacggccgttagtattaccgtgtacgcgaaggagagtcgggggacccctaacggtaaaccgttacgtaaccggtcttaagtacggggaaccgtcggtacgggggacccgaaacggggtaccccg

SEQ ID NO: 381308 - DNA, 539 bp, Homo sapiens
  misc_feature: GZ8MTXP02JSKKS.13.76.G10.1.454.CMB.2.raw
  modified_base (293)..(293): a, c, t, g, unknown or other
  modified_base (336)..(336): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccnccaggctccgagggaaggggctggagtgcgtctcttttattanagtagtggtagtaccatactccgactagactccgtgacggggccgattcgaccatcctccagagacaattccaagacacgctgttctcaaatgaaacagcctgagagcccgatcgacacgggcctgtatactgtgcgagtagacgtgggcccacgaacgttctaacgcgtagtacggacgtcgtcggggaccaaggggacccg

SEQ ID NO: 381309 - DNA, 541 bp, Homo sapiens
  misc_feature: GZ8MTXP02IX8ZA.13.76.G10.1.454.CMB.2.raw
  modified_base (368)..(368): a, c, t, g, unknown or other
  modified_base (441)..(441): a, c, t, g, unknown or other
  modified_base (476)..(476): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggggttcaccgtcagtcacacctacatgagctgggtcccgccaggctccgagggaggggctggagtgcgtcttcttttattatagtagtggtagtacatactcgcagacctcgnggacggggccattccaccatctcccagagacaatacccaaagaaccacgtcttgtttactacaaaatgaaacngcctgagacgccgaatcgacacgggctgtattcgngtgcgagagcgtcggggacccagaacgttcacgctagtggactcgtcggggaccaaggggtaccc

SEQ ID NO: 381310 - DNA, 652 bp, Homo sapiens
  misc_feature: GZ8MTXP02IMU1I.13.76.G10.1.454.CMB.2.raw
  modified_base (367)..(367): a, c, t, g, unknown or other
  modified_base (452)..(452): a, c, t, g, unknown or other
  modified_base (501)..(501): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtcccgccaggctccgaggggaaggggcgtggagtgcgtcttctttttattatagtagtggtagtaccatacctccgnagacctccgtgggacggggccgtattccaccatcctacccagagactaataccaaagaacacgctttgtttctacaaatgaaacngcctgaagcgcccgaatcggaacgacgggtccgttagttaactttacgnggttcggacggtaagggaaggtacgggtaccggggggaaccccctaacggggttaaaacccgtttaccgtaaaccgaaccgttaaaggttccgggggtaacccggttccggttaccggggggaacccccgaaaaacggggggtaacccccg

SEQ ID NO: 381311 - DNA, 540 bp, Homo sapiens
  misc_feature: GZ8MTXP02G6AA6.13.76.G10.1.454.CMB.2.raw
  modified_base (213)..(213): a, c, t, g, unknown or other
  modified_base (304)..(304): a, c, t, g, unknown or other
  modified_base (332)..(332): a, c, t, g, unknown or other
  modified_base (355)..(355): a, c, t, g, unknown or other
  modified_base (405)..(405): a, c, t, g, unknown or other
  modified_base (473)..(473): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctcnggaaataaattggcagataaatatacttctggtatcagcagaagtcaggccagtcccctgtgctggtcatctatcaagatgccaagccgcnccaggacgcccctcgagcgctacttcgngcgtcctacctactcgacgtacncgcctacctctcaccgactcacgacggacccgacgacgtatacgagtagnggacgtcgtacgtacttagttacgtcgtaggacggtcggacggaagcgagtcgactccgccgaccgtntacgttcgtaccggtacgtacggtaacggaacgtaccgtaccgtaccgtaacgtacgacgaaccccg

SEQ ID NO: 381312 - DNA, 572 bp, Homo sapiens
  misc_feature: GZ8MTXP02ICYR0.13.76.G10.1.454.CMB.2.raw
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctgggggtccctgagactctcctgtgcagcctctgggtcaccgtcagtcacacctacatgagctgggtccgccaggctccgagggagggctggagtgcgtctctttattatagtagtggtagtacatactcgcagactccgtgagggccgattcacatctccagagacaattccaaagacacgctgttactacaaatgaaacagcctagagacgaccgagtcgaaccgacgggccgtgtacttaacgtggtagcggagagaacggttcgggggaccccaacggtaaaaccgttaccgtaacgaccgtaagtcgggaaccgtttcggtacgggggaacccgaaaaccggggg

SEQ ID NO: 381313 - DNA, 554 bp, Homo sapiens
  misc_feature: GZ8MTXP02JXZQT.13.76.G10.1.454.CMB.2.raw
  modified_base (444)..(444): a, c, t, g, unknown or other
  modified_base (483)..(483): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtgggtccgccgaggctccgaaggggaggggctggagtgcgtcttcttttattatagtagtggtagtaccatactccgcagacctccgtggacggggccgattcaccatctccagagaacaattaccaagaacacgtctgtttctacaaatgaaacncgcctagagagccgatcgacacggcgtgtaattcgagtnacggagagacgtcggggacccacgaacgttacacgtctagcggacgttcgacggaaccgaaggtaaccccg

SEQ ID NO: 381314 - DNA, 576 bp, Homo sapiens
  misc_feature: GZ8MTXP02J0XIM.13.76.G10.1.454.CMB.2.raw
  modified_base (358)..(358): a, c, t, g, unknown or other
  modified_base (406)..(406): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctcgtgggttcaccgtcagtcacacctacatgagctgggtccgccaggctccgaggggaggggctggagtgcgtcttctttttattatagtagtggtagtaccatacncgcagactccgtggaggggccattcaccatctccagagacattccaanaacacgcttgtttctacaaatcgaaacagcctagagacgccgatgataccggcgtgtattactggtcgcggaggagacggtacgggggaccccaacgtaaacccggtttaactaccggcgttacggtcgggtaccggtcggtacgggggaacccgaacggggaaccccgg

SEQ ID NO: 381315 - DNA, 601 bp, Homo sapiens
  misc_feature: GZ8MTXP02GRNIN.13.76.G10.1.454.CMB.2.raw
  modified_base (451)..(451): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtcgggtccgccaggcctccgaggggaaggggctggagtgcgtcttcttttatttatagtagtggtagtacatactcgcagactcgtgacgggccattcaccatcctccaagacgaacaattaccgaaagaaccacgtcttagtttacttacaaaatcgaaacngcctaggagacgaccgaatcggaaccaccgggccgttagttattaccgtggtacgacggaagaggacggtaccgggggaccctaacggtaaaccgttacctacggcttaggtcgggaacgttcggacggggacccgtaaacgggaccccg

SEQ ID NO: 381316 - DNA, 601 bp, Homo sapiens
  misc_feature: GZ8MTXP02HBFKB.13.76.G10.1.454.CMB.2.raw
  modified_base (251)..(251): a, c, t, g, unknown or other
  modified_base (472)..(472): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcngcctcgtggttcaccgtcagtcacacctacatgagcgtcggggtcccgccgacgggcctaccggaggggaaggggcgtgggagtgcgttcttctttttaattatagtagtggtagtactatactccgcagcctccggtggacggggcctattcaccatcctaccaagacaacctaattcccgaaagaaccacgtactttcgtttacctacaaaatgaaacngcctagacgagaccgatcgaacgacggtccgtagtacttaccgtggtcgaggagaggtacggtcgggggacccctaaggtaaccgttaacgaccgtactaggtcggtacggttcggacgggggaacccg

SEQ ID NO: 381317 - DNA, 546 bp, Homo sapiens
  misc_feature: GZ8MTXP02HCKZF.13.76.G10.1.454.CMB.2.raw
  modified_base (295)..(295): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctgggggtccctgagactctcctgtgcagcctctgggttcaccgtcagtcacacctacatgagctgggtccnccaggctccgaggggaagggctggagtgcgtctcttttattatagtagtggtagtacatactcgcagctcgtgagggccatcacatctcagagacattccaagacacgcttgttctacaaatcgaacagcctagagagccgatgacgacggccgtagtacttacgtgtgacgagaaggacgtacgggggacccaacggtaaacgttaaccgtacggtacctaaggtacggacggtcgtacgggggaacccg

SEQ ID NO: 381318 - DNA, 548 bp, Homo sapiens
  misc_feature: GZ8MTXP02F239F.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtcccgccaggctccgaggggaggggctggagtgcgtcttcttttatttatagtagtggtagtaccatactcgcagactcgtgacggggccattccacatcctcagagacaattaccaagaacacgcttgtttcttacaaatgaaactagcctgagacgccgatcgacacggccgtgtattacgtgtgcgagagacgtcgggggacccacggtaacgttactacgcttagcggacgttcgcgggaccgaacgggaacccg

SEQ ID NO: 381319 - DNA, 540 bp, Homo sapiens
  misc_feature: GZ8MTXP02GXPO7.13.76.G10.1.454.CMB.2.raw
  modified_base (295)..(295): a, c, t, g, unknown or other
  modified_base (341)..(341): a, c, t, g, unknown or other
  modified_base (383)..(383): a, c, t, g, unknown or other
  modified_base (436)..(436): a, c, t, g, unknown or other
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagcccaccctcagtgtccgtgtccccaggacagacagccagcatcacctgctctaggaaataatggcagataaatatacttctgtatcagcagaagtcaggccagtcccctgtcgctggtcatctatcaagntgaccaaagccggccctcgaggaccctcccgtgacgcgtatttccncgtcggcctaccaaactcgtagggaactcacgcccactctanacccatcgacgccgggacccagggtctagtgggatggaggctagactattacngtagaggtagcggacagcaacgcacgtcgaccctgtagtcgtacgtacggaaacgtcgggaacccgtaacgggttaccaccggttacctaaacggcaaacccgg

SEQ ID NO: 381320 - DNA, 617 bp, Homo sapiens
  misc_feature: GZ8MTXP02IE1B6.13.76.G10.1.454.CMB.2.raw
  modified_base (351)..(351): a, c, t, g, unknown or other
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctcagtgtccgtgtcccccgaggacagacagccagcatcacctgctctaggaaataattggcagaataaatatacttcctggtatcagcagaagtcaggccagtccccctgtcgcgttggtcagtctatcgaagatcgccaaagccggcccctagacgggctaccccgtgacgcgatttcncgtggcctaccaaacttcgtagggacctcgacgccctactctcgaaccataccgacggaccgggaacccagggcctagtgggaatcggaaggcttaggtaaccttagttaaccgtggttaccgagggtccggttaaggggaccgaggtaccgaacgccgaacgttcggacccgtacgtaacgttccgttacgttccggaaacgtcggggtaaaccctaacggttacccgtaacccggtaccgtttaaaacgacccgtaaaccccgg

SEQ ID NO: 381321 - DNA, 552 bp, Homo sapiens
  misc_feature: GZ8MTXP02G72CR.13.76.G10.1.454.CMB.2.raw
  modified_base (237)..(237): a, c, t, g, unknown or other
  modified_base (263)..(263): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcaggaggtcaccatctcctgcacgtggggancagctccaacagttggggcacattangatgtacactggtaccagcagttccaggagcagtcccagactcctcatcaatacgtaaacaacaatccggcccgacgacggggtccctgaccgtattctctggcctccagtctcggcacctcacgcctccctcggtcactccacgtcgggcctccgacggtctcggaggtagtggacggacgtggtatttacgtttcgtcgtcctaacgtcccttatcggacacggcacgtcctaggtaacgtcggtccgttacgggttacggtccggggtaccgggggtacccacggg

SEQ ID NO: 381322 - DNA, 541 bp, Homo sapiens
  misc_feature: GZ8MTXP02F8PY9.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggtttccttgttgctatttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgaggggaggggctgggagtgcgtcttcttttattatagtagtggtagtacatactcgcagctcgtgaggggccattcaccatctcagagacaatccaaagaccacgctgtttctacaaatgaaacagcctagacgagaccgatcgacgacggccgtagtacttactggtgcgaggtagacgtcgggggacccaagtaaccgttaacgtacgcgtagtcgggactcggtacggggacccg

SEQ ID NO: 381323 - DNA, 550 bp, Homo sapiens
  misc_feature: GZ8MTXP02HR6EO.13.76.G10.1.454.CMB.2.raw
  modified_base (357)..(357): a, c, t, g, unknown or other
  modified_base (368)..(368): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctgggggtccctgagactctcctgtgcagcctctgggttcaccgtcagtcacacctacatgagctcgggtccccaggctccaggggaagggctggagtgcgtctcttttatttatagtagtggtagtacatactccgnagactccgtgnggggccattcaccatctccagagaacaattccaaagtaacacgtcttacgtttcttacaaaatgaaacagccctgagagccgatcgacacggccgtgtattacgtgtgcgagagtagtcggggacccaacggaacgttacacgctaagtggacgttcgaggggaccaacggggaccaccggg

SEQ ID NO: 381324 - DNA, 616 bp, Homo sapiens
  misc_feature: GZ8MTXP02H02D1.13.76.G10.1.454.CMB.2.raw
  modified_base (268)..(268): a, c, t, g, unknown or other
  modified_base (368)..(368): a, c, t, g, unknown or other
  modified_base (431)..(431): a, c, t, g, unknown or other
tcagtcacgtactacacgaccggtgctcgatttagtcactcatacagggggggagaggagcccagcactgggattccgaggtgtttccattcggtgatcagcactgaacacagaggactaaccatggagttttggctgagctgggttttccttgttgcttattttaaaggtgcccagtgtgaggtgcagctggtggagtctgggaggaggcttgatccagccgtgggggtccctgagactctcctgtgcagcctcgtggttcaccgtnagtcacacctacatgagctcgggtccgccaggcctccgaggggaagggctggagtgcgttcttctttttatttagtagtagtggtagtacactactccgnacgactccgtgcggggcctattccacctatctccaagacgtaacaaacttaccaaagaaaccncgtactttgtttaccttacaaaagtcgaaacacgccctaggaacgacgcccgatacggaaccgacgggacccgttagtaactttaaccgtggtacgacgaggagtacgccgggggtacccaaacggtaaccgttacacgctaaggcggtaacgtcggtacgggacccgtaacgggtacccaccgg

SEQ ID NO: 381325 - DNA, 643 bp, Homo sapiens
  misc_feature: GZ8MTXP02GS0HV.13.76.G10.1.454.CMB.2.raw
  modified_base (472)..(472): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtccacacctacatgagcgtgggtcccgccgaggcctccggaggggaaggggctgggagtcgcgttcttctttttattatagttagtggtataccatactccgcagactccggtggacggggcctattccgacctagtcctcccaaggacaactaacttacccaaagtaaccacgtcttgttttacctacaaaatgaaaaccncgcctaggacgacgccgatacggaaccgcgggtaccgttagttaacttacgtggtacggacggagaggtacgggtaccggggaacccctaaacggtaaccgtttaccgaccggtaacgttaacggtacggggtaaccgttccggaacggggaacccggaacggggaccccg

SEQ ID NO: 381326 - DNA, 530 bp, Homo sapiens
  misc_feature: GZ8MTXP02JQ2S9.13.76.G10.1.454.CMB.2.raw
  modified_base (372)..(372): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaaagatgccaagcggccctcagggatcccccctgagcgattctctgggctccaaatctgggaactcagcccactctgacccancacgacggaccgacgactagtagagagaggcgtagtactattactgtacgaggcggtaggacgagacgacgacgacgtacgcccgcgtacgttacgttcgttacggtaacgtacggaaccgaacggtaccgtaccgtaccgtaacgtacgacgacccg

SEQ ID NO: 381327 - DNA, 485 bp, Homo sapiens
  misc_feature: GZ8MTXP02J2D9E.13.76.G10.1.454.CMB.2.raw
  modified_base (355)..(355): a, c, t, g, unknown or other
  modified_base (441)..(441): a, c, t, g, unknown or other
  modified_base (484)..(484): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggagcagctccaacattggggcacattatgatgtacactggtaccagcagtttccaggagcaggtcccagactcctcatcaatacgtaacaacaatcggcccgcaggggtccctgaccgattcnctggctccagtctggcacctcacgcctcctggtcatcactgggctcgaggctgaggatgaggctgattattctgcctacgtcctancgacagcagcctgaagtgcttcggtagttcggcgggggacccng

SEQ ID NO: 381328 - DNA, 562 bp, Homo sapiens
  misc_feature: GZ8MTXP02HWBWJ.13.76.G10.1.454.CMB.2.raw
  modified_base (275)..(276): a, c, t, g, unknown or other
  modified_base (287)..(287): a, c, t, g, unknown or other
  modified_base (325)..(325): a, c, t, g, unknown or other
  modified_base (375)..(375): a, c, t, g, unknown or other
  modified_base (402)..(402): a, c, t, g, unknown or other
  modified_base (427)..(427): a, c, t, g, unknown or other
  modified_base (434)..(434): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagcgtggtttctgtagctatttaaaggtgccagtgtgaggtgcagctggtggagtctggaggaggcttgatccagccgtgggggtccctgagctctcctgtgcagcctgtgggttcaccgtcagtcacacctanngagcgtggccncgaggccacggaggggaggcgtggagtgtcgttctttntttatttagtaggtaggtacgtatacactaccgtccgacagtccgtcggnggacggggtcctatcactctcacaganactaacgtaccaaagacacgtcttnttactanaaatacgaacacgtacgtacgagacgacgacgacgacgacgtacgtacgtagtacgtcgtgagacgagacgcggaccgaacgtaacgtaacgtacgtacgtacgtacggtacggtacggtacggacgg

SEQ ID NO: 381329 - DNA, 536 bp, Homo sapiens
  misc_feature: GZ8MTXP02JUMFP.13.76.G10.1.454.CMB.2.raw
  modified_base (446)..(446): a, c, t, g, unknown or other
  modified_base (469)..(469): a, c, t, g, unknown or other
  modified_base (472)..(472): a, c, t, g, unknown or other
  modified_base (477)..(477): a, c, t, g, unknown or other
tcagtcacgtactacacgaccggtgctcgatttagtcactcatacagggggagaggagcccagcactgggattccgaggtgtttccattcggtgatcagcactgaacacagaggactcaccatggagttttggctgagcgtgggttttccttgttgctattttaaaaggtgcccagtgtgaggtgcagctggtggagtctggaggaggcttgatccagcctggggggtccctgagactctcctgtgcagcctctggggttcaccgtcagtcacacctacatgagctggggtccgccaggctccgaggggaaggggcctggagtgcgtctctttttattatagtagtggtagtacatactccgcagactccggtgaggggccgattcaccatcctaccagagacaattccaagaacacgctgtttctacaaatgaaacagcctgagngccgatgacacggcctgtatacngtncgagngatcggggccacggtaacgtacctagcctagtcggacgttcgcggggccgaaggacccg

SEQ ID NO: 381330 - DNA, 650 bp, Homo sapiens
  misc_feature: GZ8MTXP02GYY8O.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttgggactgagctggattttccttttggctattttaaaaggtgtccagtgtgaagtgcagctggtggagtcgtgggggagcttggtacagcctggcaggtccctgagactctcctgtgcagcctctggattcacctttgatgattatgccatgcacgtcggggtccgcaagccgtccgaggggaacggccgtagggaggtgggtctcgtaggttattaggtaggaataggtggtagcagtaggcttagtcggcggtacttcgtggtaggaacggggtcctattaccgacctagtcctaccgaagacgaaccgaaccgaccaaacgtacctccctagtactctagaactaaatacgaaacgacgaccgtagagtacgcgtaggaacggacgtaccggtacctttagttaagtttagttaggttaacgaacgtaaaaacgtcccttaaaccccgtaaaaccccgttttacggtttaagtttttacgggaaggtttacggtttaacgtacccggttaacggggg

SEQ ID NO: 381331 - DNA, 596 bp, Homo sapiens
  misc_feature: GZ8MTXP02HJ8H3.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtgggtccgccgaggcctccgaggggaaggggctggagtgcgtcttcttttattatagtagtggtagtaccatactccgcagactcggtggacgggggccagttccaaccactcctacccagacgaacctaaacttccaaagaaccacgtcttacgtttctacaaatcgaaacagcctagagacgaccgatcgaaccgtacggccgttagtattacgtggtcgacgaggagacggtcgggggaccccaacggtaaccgtttacaacgtcgtaagtcgggacgtacggtcggggaccgtaacggggacccg

SEQ ID NO: 381332 - DNA, 653 bp, Homo sapiens
  misc_feature: GZ8MTXP02HGNR9.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtctggaggaggcttgatccagccgtgggggtccctgagactctcctgtgcagcctcgtgggttcaccgtcagtcacacctacatgagcgtcgggtcccgccgaggcctaccggaaggggaacggggcgtagggagtggcgttcgtttactttttaattatagttagtggtagtaaccactacctccgacacgtacctccggtggacgggggcctacgttccaacctactcctacccaagacgaaactaaacttaccaaagaaaccacgtcttagtttacctacaaaatacgaaacacgtaccgtagaagacgacccgaagtacgaaccgaccggtaccgttagttaacttacgtggtacgacggagaggacggtccgggggaaccctaacggtaaaccgttacgtacgtaacgtagtacggtacgtcggtacggggaccgaaacggggaccccg

SEQ ID NO: 381333 - DNA, 578 bp, Homo sapiens
  misc_feature: GZ8MTXP02IXPZZ.13.76.G10.1.454.CMB.2.raw
  modified_base (464)..(464): a, c, t, g, unknown or other
  modified_base (515)..(515): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagctcgggtccgccaggcctccgaggggaagggctggagtgcgtcttcttttatttatagtagtggtagtactatacctccgcacgctccgttggacgggggcctagttccacctactcctacccgagacgaactaattcccaaaagaccacgtcttgtttactacaaattcgaaaacngtacctaggaagacgcccgagtcgaacgaccgggtccttagtattactggngacgagagacgtcggggacccaaggtaacgtaacgcgactagcggacgtcggtacgggaaccg

SEQ ID NO: 381334 - DNA, 620 bp, Homo sapiens
  misc_feature: GZ8MTXP02I8W7B.13.76.G10.1.454.CMB.2.raw
  modified_base (457)..(457): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtccctgagactctcctgtgcagcctcgtgggtcaccgtcagtcacacctacatgagcgtcgggtccgccgaggctccgaggggaaggggctggatgcttcttcttttattatagtagtggtataccatactccgcagactccgtggacggggcctattccacctactcctaccaagacgactaaacttccaaaagaaccacgtcttagtttactacaaatcgaaaacngcctaggagacgaccgatcgaacgtaccggggtccttagttaactttacgtggtacggacggaaggaggtacggtaccgggggaccccctaaacgggtaaacccgtttactaccggcttaacggtcgggtacgtcggtacgggggaacccgaagggaaccccg

SEQ ID NO: 381335 - DNA, 533 bp, Homo sapiens
  misc_feature: GZ8MTXP02GF3JU.13.76.G10.1.454.CMB.2.raw
  modified_base (428)..(428): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctgggggtccctgagactctcctgtgcagcctctgggttcaccgtcagtcacacctacatgagctgggtccgccaggctccgaggggagggctggagtgcgtctctttattatagtagtggtagtacatactcgcagctccgtgaggggccgattcaccatctccagagacaattccaagaccacgctgttactcaaatgaaacnggcctgacgagccgatcgacaccggccgtagtattacgtgtgacgagtacgagtcgggggacccagaacgttaacgacgctagtcggacgtcgtacggggacccg

SEQ ID NO: 381336 - DNA, 559 bp, Homo sapiens
  misc_feature: GZ8MTXP02F169D.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagctgggtccgccaggctccgagggaaggggcgtggagtgcgtcttcttttattatagtagtggtagtacatactccgcagctcgtgaggggcagattcacatctccagagacaattaccaagaacacgtctagtttcttacaaatagaaacagcctagagacgccgatcgaacgaccggtccgtagtaacttacgtgtagcggagagacgtacggggaccccgaacggtaaacgttacgtaacgacgttacgtacggaccgtcggtaccggggg

SEQ ID NO: 381337 - DNA, 605 bp, Homo sapiens
  misc_feature: GZ8MTXP02HWEUN.13.76.G10.1.454.CMB.2.raw
  modified_base (350)..(350): a, c, t, g, unknown or other
  modified_base (387)..(387): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagctctcctgtgcagcctgtggttcaccgtcagtcacacctacatgagctgggtccgcaggctccgaggggagggctgggagtgcgttcttctttattatagtagtgtagtacntactcgcagctcgtgacggggccatcacatcacaganacaataccaaagaccacgtcttagtttactacaaaattcgaaacacgtacctaggaacgacgaccggatacggaccgaaccgggtccgttaggtactttaccgtaggtcggtacggaaggaaggtaacggtccgggggaacccccaaacgggttaaaccgttaaccgtacgtaccgttaacggtacgggtaaccggttcgggtaccgggggaacccgg

SEQ ID NO: 381338 - DNA, 679 bp, Homo sapiens
  misc_feature: GZ8MTXP02H0FJJ.13.76.G10.1.454.CMB.2.raw
  modified_base (367)..(367): a, c, t, g, unknown or other
  modified_base (610)..(610): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctctggggttcaccgtcagtcacacctacatgagcgtgggtccgccaggcctccgaggggaaggggctggagtgcgtcttctttttattatagtagtggtagtacatactccgnagactccgtggacggggccagttccacctatctcccagacgaactaaagttccaaagaacctacgtcttgttttaccttacaaaagttcgaaaccaggtacccgtaggaacgacgacccgggaattacggaaccgaccgggtacccgttagttaacgtttaccgtaggtacgaccggtaagggaacggacgttaccggggggccccctaaaacgggggtaacccttttaaaccgtaacccggngttaaaacggttcggggtaaaacccggttcgggtacccgggggacccgaaaaccgggggtaacccccgg

SEQ ID NO: 381339 - DNA, 568 bp, Homo sapiens
  misc_feature: GZ8MTXP02HE42A.13.76.G10.1.454.CMB.2.raw
  modified_base (294)..(294): a, c, t, g, unknown or other
  modified_base (454)..(454): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctggggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccnccaggctccgagggaggggctggagtgcgtctcttttattatagtagtggtataccatactccgcacactcgtggacggggccattcaccatctccgagagacaattccaagaacacgctgtttctacaaatcgaaacagtcctgagagaccgatcgacncggtcctgtattactgtcggacggagaggacgtcgggggacccaacggtaaccgttaactaccggtaactacggtacgggacggtacggtacggggacccgaaggggaaccccg

SEQ ID NO: 381340 - DNA, 570 bp, Homo sapiens
  misc_feature: GZ8MTXP02IHH6D.13.76.G10.1.454.CMB.2.raw
  modified_base (332)..(332): a, c, t, g, unknown or other
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggcagataaatatactcctggtatcagcagaagtcaggccagtcccctgtgctggtcatctatcaagatgccaaagcgccctcaggactccctgacgcgattccnctggctccgaaactctacggggactcacgaccactctacgaccaactcgacgccgggaacccaggaccgttaaggtggacgtaggaaggtcgtagtacttacgttacgtcgtacgagggtcggtacgggacgacgacgacgactacgtcgacccgtacgtacgtcgttaccgttacggtaacgtaacgggtaaaccgtaacggtacccgtaacccggttaccgtaacgtaccgaaccg

SEQ ID NO: 381341 - DNA, 579 bp, Homo sapiens
  misc_feature: GZ8MTXP02IA57Z.13.76.G10.1.454.CMB.2.raw
  modified_base (376)..(376): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtcctggagacgtctaccgtgtgcagcctcgtgggttcaccgtcagtcacacctacatgagctgggtccgccgaggcctccgagggaaggggctggagtgcgtcttctttttattatagtagtggtagtacatactcgcagacttcgngacggggcattcaccatcctcagagacaattaccaaagacacgcttcgtttcttacaaatcgaaaactcggcctagagacgccgaagtcgaacgacggtccgtagttattacgtggtgacgaggagaagtcgggggaccctaacggtaacgtttacgacgtcgtaagtcggtacggtcgtcgggggaccaaaacggggccccg

SEQ ID NO: 381342 - DNA, 637 bp, Homo sapiens
  misc_feature: GZ8MTXP02JCZET.13.76.G10.1.454.CMB.2.raw
  modified_base (173)..(173): a, c, t, g, unknown or other
  modified_base (239)..(239): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagcccaccctnagtgtccgtgtccccaggacagacagccagcatcacctgctctaggaaataatggacagataaatntacttctgtatcagacagaagtcaggccacgtcccctgtgctggtcatctatcaagatcgaccaagcgccctacgagggactccccgtagacgcgtattctcgtcggcctaccgtaactccgtacggggtaacctcgaccgtccctaactcctacgacctacgtaccgaacggacccggaccccgagggtaccgttaagacggggtaagttacgggaacggtccgtacggttaaccttaacgtttaaccgtcggtacggacgggtaccgggtagggaacgacggacgacgaccgtaccgtaccggcccgtacgttacgtcggttacgttaaccggaaccggtacgggaacccgtaacggtcccgacccggttactaaaccgtccgaaccgaacccccg

SEQ ID NO: 381343 - DNA, 570 bp, Homo sapiens
  misc_feature: GZ8MTXP02IDO6U.13.76.G10.1.454.CMB.2.raw
tcagtcacgtactacacgaccggtgctcgatttagtcactcatacagggggagaggagcccagcactgggattccgaggtgtttccattcggtgatcagcactgaacacagaggactcaccatggagttttggctgagctggggttttccttgttgctattttaaaaggtgcccagtgtgaggtgcagctggtggagtctggaggaggcttgatccagcctggggggtccctgagactctcctgtgcagcctctggggttcaccgtcagtcacacctacatgagctggggtcccgccaggcctccgaggggaaggggctggagtgcgtctctttttattatagtagtggtagtacatactccgcagactccgtgaggggccgattcaccatctcccagacgacaaattccaaagaacacgcttgtttctacaaaatgaaacagcctagagacgccgatcgacacggccgtgtattacgtgtgcgagagagtcgggggacccaacggtaaccgttacgtaaccgcgttaaagtcgggtacgtccgtacgggggaccaaaacggggaccccg

SEQ ID NO: 381344 - DNA, 604 bp, Homo sapiens
  misc_feature: GZ8MTXP02GLJUU.13.76.G10.1.454.CMB.2.raw
  modified_base (441)..(441): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtcgggtcccgccgaggcctccgaggggaaggggctggagtgcgtcttcttttatttatagtgtggtagtacatactcgcagactcgtggacgggcgattcaccatctcagagacaattccaaagaacacgtcttgtttactacaaatgaaacngcctagagagcccgatcgaccgacggtccgttaggtactttacgtggtcgacggaagacggtaggtaccgggggacccctaacggtaaaccgtttaacacggtccgttaaggtacgggtaaccggtttccgggacgggggaacccggaaaacgggggaccccg

SEQ ID NO: 381345 - DNA, 642 bp, Homo sapiens
  misc_feature: GZ8MTXP02HCT7N.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtctggaggaggcttgatccagccgtggggggtccctgagactctcctgtgcagcctctgggttcaccgtcagtcacacctacatgagcgtgggtccgccgaggcctccgaggggaggggctggagtgcgttcttcttttattatagtagtggtagtaccatacctccgcagactccggtggacggggtccgattccacctatcctaccgagacgaactaacttacccaaagaaccctacggtcttcgttttaccttaactaaatcgaaacacgtcccgtaggagacgacccgaagtacgaaccgaccggtaccgtaggttattaccgtggtacgacggaaggacgtacggtaccgggggaccccaacgggttaaaccgttaccgtacggtaacgttaaggtcggggtaaccgtccggtacgggggaacccgaacggggaccccgg

SEQ ID NO: 381346 - DNA, 650 bp, Homo sapiens
  misc_feature: GZ8MTXP02G35C8.13.76.G10.1.454.CMB.2.raw
  modified_base (237)..(237): a, c, t, g, unknown or other
  modified_base (293)..(293): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataatggcagataaatntacttctggtatcagcagaagtcaggccagtcccctgtgctggtcatctatcaagntgaccaagccgcctgacggtactcccccgtagacgcgtacttctcgtggcctaccaactcgtagggaacctcacgtccctactctacgacccacgtaccgacggacccgggaccccaaggggtaccttaaaggtacggggagttacgggaacgggtccgttacggtaaaccttaacgtttaaccggtcggttaaccggaacggggtccgggttaggggaaccgaggaccgacgacccgtaaccgtcggccccgtacgttaagttccggttaccgttaccgggtaacggtacggggtaacccgtaaacggggtaccctaacccgggttaccttaaacggtcccgaaccggaacccccg

SEQ ID NO: 381347 - DNA, 720 bp, Homo sapiens
  misc_feature: GZ8MTXP02HA2PZ.13.76.G10.1.454.CMB.2.raw
  modified_base (527)..(527): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtcgggtcccgccgagggcctccggaaggggaacggggcgtgggaggtcggcgtttcctttactttttaatttaagttaaggttaggtagggttaagtaaccctaagttaacctcccgacacggtaccgttcccgggttggggacgggggtccgtacttaccgacctaatccctaccaagaacgaaacctaaacttaccaaagaaccacgtccttgttttacctaacaaaagtcgaaaccngtacctagaacgacgcccgaatcgaaccgtaccgggtaccgttagttaactttacgtggtacggacggaaggacggtacggttccgggggaacccctaacgggttaaaccgtttaaccgaaccggtaacgttaacggtacggggtaacccggttcgggtaccgggggaaccccgtaaaacgggggacccccgg

SEQ ID NO: 381348 - DNA, 560 bp, Homo sapiens
  misc_feature: GZ8MTXP02GQER5.13.76.G10.1.454.CMB.2.raw
  modified_base (391)..(391): a, c, t, g, unknown or other
  modified_base (456)..(456): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtcctgagactctcctgtgcagcctcgtgggttcaccgtcagtcacacctacatgagcgtgggtccgccaggcctccgaaggggaagggctgggagtgcgtcgttcttttaattatagtagtgtatacatactcgacagctccgtgacggggccattcacntcacagacgacattacaaagacacgtctgttactacaaatgaaactacgcctgaagagacccganacgacgcggtcgtagtactacgtgacgacgagacggtacggtaccgggaccctaaacgtaacgtaaccgtacgacgtacgcggtacggtccggtacgggaaccg

SEQ ID NO: 381349 - DNA, 601 bp, Homo sapiens
  misc_feature: GZ8MTXP02FY8ES.13.76.G10.1.454.CMB.2.raw
  modified_base (452)..(452): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggtcaccgtcagtcacacctacatgagctgggtcccgccaggcctccgaggggaggggctggagtgcgtctcttttatttatagtagtggtagtaccatactcgcagactccggtggacggggccgtattccacctatcctccagacgaacaattacccaaagaaccacgcttagtttctacaaaattgaaacngccctaggagacgacccgaatcgacgacggtccgttagtaattaccgtggtacggacgaaggaggacggtcgggggacccctaaacggtaaccgttaccgtacgcgttagtcggaccggttcgacgggggacccaaacgggggtacccg

SEQ ID NO: 381350 - DNA, 528 bp, Homo sapiens
  misc_feature: GZ8MTXP02I9JWE.13.76.G10.1.454.CMB.2.raw
  modified_base (172)..(172): a, c, t, g, unknown or other
  modified_base (235)..(235): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcactgctctggaaataatggcagataaatntacttctgtatcagcagaagtcaggccagtcccctgtgctggtcatctatcaagatgccaagccggccctcgagggactcccccgtgacgcgattctcgtggcctccaaacgtctacggggaacctcacgcccactctcgaccatcacgcgggacccaggctagcgatggaggctagtacttattacgtgtcgagggtcggtgggacaggcacgcacgtcgcccgtctaagtcgtaccgttacggaacgtcggggaaccaacgggtccaaccggtctaacgtcacgaaccccg

SEQ ID NO: 381351 - DNA, 625 bp, Homo sapiens
  misc_feature: GZ8MTXP02GU520.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagctcgggtcccgccaggcctccgaggggaggggctggagtgcgtcttcttttattatagtagtggtagtacatactcgcagactcgtggacggggcattccaccatcctcccaagacgaactaacttacccaaaagaaccgaacgtcttacgtttacctacaaaattcgaaaacacgccctaggaggacgtacccgaatcggaaccgaccgggtaccgttagttaacgttacgtggtacggacgaaggagacggtcgggggacccctaaacggtaaaccgttaacgtacgcgttaacggtcgggtaccgtcggtacgggggaacccaaacgggggaaccccg

SEQ ID NO: 381352 - DNA, 603 bp, Homo sapiens
  misc_feature: GZ8MTXP02IAJFF.13.76.G10.1.454.CMB.2.raw
  modified_base (454)..(454): a, c, t, g, unknown or other
  modified_base (512)..(512): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctcgtggggttcaccgtcagtcacacctacatgagctgggtccgccgaggcctccgaggggaaggggcgtggagtgcgtctctttttattatagtagtggtagtacatactccgcagactccgtgacgggggccagttccaccactctccagtagaacaattcccaaaagaaccacgcttgtttactacgaaatcgaaacngtcctgacgagcccgatgaaccgacgggtccgtgttaacttacgtaggtgacggaagnggaacgtccgggggaccctaacggtaaccgtttacgtaacgccgttagtacgggtaccggttcggtacgggggacctaaacggggaccccg

SEQ ID NO: 381353 - DNA, 655 bp, Homo sapiens
  misc_feature: GZ8MTXP02JCY87.13.76.G10.1.454.CMB.2.raw
  modified_base (238)..(238): a, c, t, g, unknown or other
  modified_base (245)..(245): a, c, t, g, unknown or other
  modified_base (446)..(446): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctctatgagctgactcagccaccctcagtgtccgtgtccccaggacagacagccagcatcacctgctctaggaaataattggacagataaatntacttcngtatcagcagagtcaggccagtcccctgtgctggtcatctatacaagtatacgaccaaaggcccggaccctcgaacggggtactccccccgtagacgtcgtacgtttcgtcgttcggcccttaccaaacgttccggtacgggaacctcgacgccctaactctacgaccactccgacgggacccgacccgaaggtctaaggnggtacgtaggacggtacgtacgtaacgttagtttacgtcgtacggtacggggtacgggtacgggaacgacggacgacgaccgtaccgtccggtacccgtacgttacgttaccgggtttaccgttaaccggggtaaccggtaacgggaaacccgtaaccgggtacccgtaacccggttaaccgtaaccgtaccggaaacccgaaccccgg

SEQ ID NO: 381354 - DNA, 613 bp, Homo sapiens
  misc_feature: GZ8MTXP02HJEPU.13.76.G10.1.454.CMB.2.raw
  modified_base (298)..(298): a, c, t, g, unknown or other
  modified_base (342)..(342): a, c, t, g, unknown or other
  modified_base (365)..(365): a, c, t, g, unknown or other
  modified_base (395)..(395): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtggttcaccgtcagtcacacctacatgagctcgggtccnccaggctccgagggaaggggctggagtgcgtcttctttatttanagtagtgtagtacatactcgcancgtccgtgacggggccatcacatctcaganacaatccaagacacgcttgttactacaaatcgaaacagtcctagagacgaccgagtacgaacgacccgggtccgttaggtaaactttaccgtaggttcggaccggaaggaaggtaacggtccgggggaaccccctaaacggggtaaacccgtttaaaccgttaaccggaccgtttaacggtacgggtaaccgggttccggttacgggggaaaccccgg

SEQ ID NO: 381355 - DNA, 630 bp, Homo sapiens
  misc_feature: GZ8MTXP02FPR0T.13.76.G10.1.454.CMB.2.raw
  modified_base (302)..(302): a, c, t, g, unknown or other
  modified_base (382)..(382): a, c, t, g, unknown or other
  modified_base (503)..(503): a, c, t, g, unknown or other
tcagtcacgtactacacgaccggtgctcgatttagtcactcatacaggaggggagaggagcccagcactgggattccgaggtgtttccattcggtgatcagcactgaacacagaggactcaccatggagttttggctgagcgtgggttttccttgttgctaattttaaaaggtgcccagtgtgaggtgcagctggtggagtctggaggaggcttgatccagccgtgggggtccctgagactctcctgtgcagcctcgtgggttccaccgtcagtccacacctacatgagcgtcggggtcccnccgaggcctaccggaggggaacggggcgtgggagtcgcgttcttcgtttttattagtagtaggtgtagtacatactcganacgtaccgtccggtaggacggggtccattccactacttccaccagaacgactaaacgttaccaaagacacgtcttacgtttctaaacaaagttcgaaacacgcctagacggacgaccgtanacggaaccgaccgggttacgtagttaacttacgtggtacgcggtaagagtacggtccggggacccctaaacgtaacgtttaacaacggtctaggtacgggaccgtcggaggggaacccaaaccgggg

SEQ ID NO: 381356 - DNA, 497 bp, Homo sapiens
  misc_feature: GZ8MTXP02G9EKD.13.76.G10.1.454.CMB.2.raw
  modified_base (265)..(265): a, c, t, g, unknown or other
  modified_base (357)..(357): a, c, t, g, unknown or other
  modified_base (368)..(368): a, c, t, g, unknown or other
  modified_base (384)..(384): a, c, t, g, unknown or other
  modified_base (388)..(388): a, c, t, g, unknown or other
  modified_base (390)..(390): a, c, t, g, unknown or other
  modified_base (398)..(398): a, c, t, g, unknown or other
  modified_base (404)..(404): a, c, t, g, unknown or other
  modified_base (410)..(410): a, c, t, g, unknown or other
  modified_base (412)..(412): a, c, t, g, unknown or other
  modified_base (414)..(414): a, c, t, g, unknown or other
  modified_base (416)..(416): a, c, t, g, unknown or other
  modified_base (421)..(421): a, c, t, g, unknown or other
  modified_base (424)..(424): a, c, t, g, unknown or other
  modified_base (436)..(436): a, c, t, g, unknown or other
  modified_base (438)..(438): a, c, t, g, unknown or other
  modified_base (443)..(443): a, c, t, g, unknown or other
  modified_base (445)..(445): a, c, t, g, unknown or other
  modified_base (474)..(474): a, c, t, g, unknown or other
  modified_base (476)..(476): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccgtggagttttggctgagctgggttttccttgttgctattttaaaggtgcccagtgtgaggtgcagctggtggagtctggaggaggcttgatccagcctgggggtccctgagactctcctgtgcagcctctgggttcaccgtnagtcacacctacatgagctggtccgccaggctccaggggaaggggctggagtgcgtcttctttttattatagtagtgtagtacatactccgnagactccgtgnggggccatcaccatcncagnanatcaagangctgtntcatananancnagagnganagacgacgcgtntntatgngngagagagcggacgacgacgtacgtacacngngacgcgcggacgacgacgacg

SEQ ID NO: 381357 - DNA, 590 bp, Homo sapiens
  misc_feature: GZ8MTXP02I2I4Z.13.76.G10.1.454.CMB.2.raw
  modified_base (281)..(281): a, c, t, g, unknown or other
  modified_base (293)..(293): a, c, t, g, unknown or other
  modified_base (387)..(387): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctgggggtccctgagactctcctgtgcagcctctgggtcaccgtcagtcacacctacntgagctggtccncaggctccgagggagggctggagtgcgtcttcttttattatagtagtggtagtacatactcgacagcgtccgtggacggggccattcaccatcnccagagaacattccaaagaccacgtcttgtttactacaaaattcgaaactagccctaggacggacgcccggaattcggaccgaacgggtcccgttagtaacttacgtggtggacggtaagagacggttacgggggacccctaacggtaaaccgtttaacgaacggtcttaaacggtgggaaccggttcgtacgggggaacccg

SEQ ID NO: 381358 - DNA, 545 bp, Homo sapiens
  misc_feature: GZ8MTXP02HFO0H.13.76.G10.1.454.CMB.2.raw
  modified_base (293)..(293): a, c, t, g, unknown or other
  modified_base (394)..(394): a, c, t, g, unknown or other
  modified_base (425)..(425): a, c, t, g, unknown or other
  modified_base (479)..(479): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagtttggctgagctgggttttccttgttgctattttaaaaggtgccagtgtgaggtgcagctggtggagtctggaggagtcttgatccagccgtggggggtccctgagactctcctgtgcagcctctgggtcaccgtcagtcacacctacatgagctgggccncaggctccgaggggaagggctggagtgcgtcttcttttattatagtagtggtatacatactcgctagctcgtggacggggccattcacctatctccagaanacaattcccaaagaacacgctagttctaaanaaatgaaacacgacagagacgacgacgacgacgacgacgtagtatacgtcgtgngagagacgacggaccgaacgaacgtaacgtacgtacgtacgtacggtacggtacggtacgggacgg

SEQ ID NO: 381359 - DNA, 587 bp, Homo sapiens
  misc_feature: GZ8MTXP02JIK8H.13.76.G10.1.454.CMB.2.raw
  modified_base (422)..(422): a, c, t, g, unknown or other
  modified_base (433)..(433): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgcaggctccgagggagggctggagtgcgtctctttattatagtagtggtagtaccatactcgcagactccgtgacggggccattccactatctccagagacaatcaagaacacgcctagtttccctaanaactagaaacncgtaccgtagacgacgacgagtacgaccgtacggtcgttagttacttacgtgtacggacgaggaacggtacggtaccggggtaaccctaacggtaaccgttacgacgtcgtaggtacgggtaccgtcgggtacggggaccggaaccgggtaccg

SEQ ID NO: 381360 - DNA, 545 bp, Homo sapiens
  misc_feature: GZ8MTXP02JMB6E.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggggttcaccgtcagtcacacctacatgagctgggtccgccaggctccgagggaggggctggagtgcgtcttcttttattatagtagtggtagtacatactccgcagactccgtgacggggccgattcaccatctccagagacaattccaagaacacgctgtttactacaaatgaaacagcctgagagccgatcgacacggccgtgtattacgtgtcgcgagagacgtcgggggacccacgaacgttacacgcgtagtacggacgtcgtacggggacccaaggggacccg

SEQ ID NO: 381361 - DNA, 556 bp, Homo sapiens
  misc_feature: GZ8MTXP02JC41Q.13.76.G10.1.454.CMB.2.raw
  modified_base (353)..(353): a, c, t, g, unknown or other
  modified_base (386)..(386): a, c, t, g, unknown or other
tcagtcacgtactacacgaccggtgctcgatttagtcactcatacagggggcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgaggggaagggctggagtgcgtctcttttatttatagtagtggtagtacatactccccgnagactcgtgacggggccatcacatcctccaganacaattccaaagaacacgcttgtttctacaaatgaaacagcctagagagccgagtcgaacgacggccgtgtaattactggtgacgagagacgtcgggggaccccaaaggaaaccgtttacacggctaagtcggaacgtcgtcggggaccaagggacccacggtcaacccg

SEQ ID NO: 381362 - DNA, 623 bp, Homo sapiens
  misc_feature: GZ8MTXP02G8ZSR.13.76.G10.1.454.CMB.2.raw
  modified_base (252)..(252): a, c, t, g, unknown or other
  modified_base (276)..(276): a, c, t, g, unknown or other
  modified_base (290)..(290): a, c, t, g, unknown or other
  modified_base (314)..(314): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcgtggtttctgtagctattttaaaaggtgcccagtgtgaggtgcagctggtggagtctggaggaggcttgatccagccgtggggggtccctgagactctcctgtgcagcctntgggttcacgtcagtcacacctanatgagcgtcggccncgaggctcggaggggaggcgtggngtgtcgttctttacttttatttagttagttagtaggtagtacctactacgtcgacgacgtacgtcggtcgggacgggaccgtacgtacctacctactacctaccgacgaacgaactaactaacgaaacgaactacgtacgttacgtttacttaactaaactaacgaacgacgtacgtagacgacgacgacgtacgacgacggtacgtacgtagttacgtgtgtacgaggaggacggtacgggaccgtaaccgtaacgtaacgtacgtaacgtacgtacggtacggtacggtacgggaccggaacggacg

SEQ ID NO: 381363 - DNA, 545 bp, Homo sapiens
  misc_feature: GZ8MTXP02IOKX8.13.76.G10.1.454.CMB.2.raw
  modified_base (236)..(236): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcacgtgggancagctccaacattggggcacattatgatgtacactggtaccagcagtttccaggagcaggtcccagactcctcatcaatacgtaacaacaactcggcccgcgacggggtccctgaccgtattcctcgtcggctccgacgtctggcacctcacgtccctccctggtcactcacgtcggcctccgaggtctgaggacgtgacggtctgtatttagttctcgtcctacgtccctagtcgaaacgcgtaccgacgtccgtgtaacgtcgtaccgttcgggtacgtttccggggaccgggggtacctaccgggg

SEQ ID NO: 381364 - DNA, 700 bp, Homo sapiens
  misc_feature: GZ8MTXP02JN5IE.13.76.G10.1.454.CMB.2.raw
  modified_base (237)..(237): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataatggcagataaatntacttcctgtatcagcagaagtcaggccagtcccctgtgctggtcatctatcaagatcgccaaggccgccctcgaggggactcccccgtgacgcgtacttccgtcgtcggtcctaccgaaacgttccgtacggggaaccttcgaacgtcccactcgtacgaccctagtccgaacgggacccgggtaccccgagggtaccttaaggtacggggtaacgtagggtaacgggtccttacgggttaaacccttagtttacccggttaggttacccggaaggggtccggggttacggggaaccgtacggtacccgaacggcccgtaaccggttccggacccccggtcgttaaaggttccgggtttacccggtttaaccggggaacccggttacgggggaacccgtaacgggggttaccctaaccccggggttacctttaaaaccgggtcccgaaccggtaacccccgg

SEQ ID NO: 381365 - DNA, 562 bp, Homo sapiens
  misc_feature: GZ8MTXP02G1GA2.13.76.G10.1.454.CMB.2.raw
  modified_base (294)..(294): a, c, t, g, unknown or other
  modified_base (443)..(443): a, c, t, g, unknown or other
  modified_base (446)..(446): a, c, t, g, unknown or other
  modified_base (456)..(456): a, c, t, g, unknown or other
  modified_base (522)..(522): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccnccaggctccgaggggaggggctggagtgcgtcttcttttattatagtagtggtagtaccatactccgcagacctcggtggacgggggtccattcaccctatcctccagagacaattccaaagaacacgctgtttctacaaatgaaaccngcngagacgcgancgacgacggtcgtagtacttacgtgagacgaggagcggtacgggacccaacgtaaccgttacacgngtacgtacggtaccgtcggtacgggaccgaacgggacccg

SEQ ID NO: 381366 - DNA, 567 bp, Homo sapiens
  misc_feature: GZ8MTXP02IJW8G.13.76.G10.1.454.CMB.2.raw
  modified_base (360)..(360): a, c, t, g, unknown or other
  modified_base (387)..(387): a, c, t, g, unknown or other
  modified_base (402)..(402): a, c, t, g, unknown or other
  modified_base (406)..(406): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaatgtgcccagtgtgaggtgcagctggtggagtctggaggaggcttgatccagccgtgggggtccctgagactctcctgtgcagcctctggttcaccgtcagcacacctacatgagctgggtccgccaggcctccgaggggaaggggcgtggagtgcgtcttcttttattatagtagtggtagtacatactccgnagactccgtgagggccattccacatcncagagacaatacaanaacncgcttgttctacaaatgaacagcctagagacggacctagtacgacgaccgggccgttagtacttacgtggtcgacggtagaagaggtaccggggaccctaacggtaaacgttactaacggctaaggtcggaacggttcgtacgggggaccgaaaaccgggg

SEQ ID NO: 381367 - DNA, 535 bp, Homo sapiens
  misc_feature: GZ8MTXP02JFSAP.13.76.G10.1.454.CMB.2.raw
  modified_base (292)..(292): a, c, t, g, unknown or other
  modified_base (441)..(441): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttcctggtatcagcagaagtcaggccagtcccctgtgctggtcatctatcaagntgccaagcggccctgagggactccccctgagcgtattctcgtcggcctaccaactcgtagggaacctcgacgcccactctcgaccatcacggcggacccaggcctagtcggatggacgtctgacttattacgtgtcgaggcgtgggacngacgagcacgtcgacccgctacgtcgtaccgttacgggaacgtacgggaaccgtaacgggtcctacccggtactaaacgtccgacgaacccccg

SEQ ID NO: 381368 - DNA, 637 bp, Homo sapiens
  misc_feature: GZ8MTXP02G3LA1.13.76.G10.1.454.CMB.2.raw
  modified_base (481)..(481): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggaggaggcttgatccagccgtgggggtccctgagactctcctgtgcagcctcgtcgggttcaccgtcagtcacacctacatgagcgtcgggtcccgccgaggcctccggaggggaaggggcgtaggagtgtcgttcttcttttattatagtagtggtagtaccatacctccgacagactccggtggacggggcctattccacctatcctaccgaagaacgaactaattaccgaaaagtaaccacgtcttacgttttactaacaaaatacgaaaaccncgtaccctaggaacgacggacccgaagtcgaaacccgacgggtccgttaggttattacgtgtccggacgaagtagggacgtccgggggacccaacgtaaccggttacacgaacgttagcgggtacgtacggcgggggaacccgaaggggtaccccg

SEQ ID NO: 381369 - DNA, 594 bp, Homo sapiens
  misc_feature: GZ8MTXP02GRMY7.13.76.G10.1.454.CMB.2.raw
  modified_base (367)..(367): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagctgggtccgccaggctccgagggaaggggctggagtgcgtcttctttattatagtagtgtagtacatactcgcagctccgngaggggccattcaccatcctccagagaacattacccaaagaacaacgcttgtttactacaaaaattcgaaactacggaccctagaaggagaccccgaagtacgaaccgacgggacccgtagttaagttaaccgtgtggacgagaacggaagttcgggggaaccccaacggtaaaacgttaacgtaacggaccttaagtacggaacgttcggtacgggggaaccccgg

SEQ ID NO: 381370 - DNA, 578 bp, Homo sapiens
  misc_feature: GZ8MTXP02JG0LD.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctagaggaggcttgatccagccgtgggggtccctgagactctcctgtgcagcctcgtggttcaccgtcagtcacacctacatgagctggtccgccaggctccgaggggaagggctgggagtgcgtcttcttttattatagtagtggtatactatactccgcagctccgtggaggggccgatcacatctcagagacaacttccaaagaaccacgtcttgtttactacaaaatgaaactagcctagacggacgcccgatacggaacgaccggcccgttagtaactacgttggtacggcggaaaggagtacggtcgggggaccccctaaggtaacccgttaacgacgtctaacgtgggacttccgggaggggtaacccg

SEQ ID NO: 381371 - DNA, 495 bp, Homo sapiens
  misc_feature: GZ8MTXP02JZBRP.13.76.G10.1.454.CMB.2.raw
  modified_base (235)..(235): a, c, t, g, unknown or other
  modified_base (403)..(403): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggancagctccaacattggggcacattatgatgtacactggtaccagcagtttccaggagcaggtcccagactcctcatcaatagtaacaacaaatcggcccgcacggggtccctgaccgattctctggctcagtctggcacctcacgcctccctggtcatcactggctccnggctgaggagtgaggctggattatttctgcctacgtcctatcgacacgcacgcctgaagtgtcttcggtagttcgggcgggggtacccacgg

SEQ ID NO: 381372 - DNA, 625 bp, Homo sapiens
  misc_feature: GZ8MTXP02FUXQS.13.76.G10.1.454.CMB.2.raw
  modified_base (408)..(408): a, c, t, g, unknown or other
  modified_base (453)..(453): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtcccgcgaggcctccgaggggaaggggctgggagtgcgtcttcttttatttatagtagtggtagtacatactcgcagacctccgtggacggggcctattccacctatcctaccaaganaactaattaccaaagaaccacgcttgtttctacaaaatcgaaacncgacctaggagacgaccgatacggacaccgggtccgttagtattacgtggtacgacgaaggaggacggtaccgggggaacccctaacgggtaaaacccgttacgtaaccggtaacgttaacggtcggggtaacccggttcgggtacgggggacccgaaacgggggaaccccg

SEQ ID NO: 381373 - DNA, 542 bp, Homo sapiens
  misc_feature: GZ8MTXP02IBYBT.13.76.G10.1.454.CMB.2.raw
  modified_base (174)..(174): a, c, t, g, unknown or other
  modified_base (396)..(396): a, c, t, g, unknown or other
  modified_base (406)..(406): a, c, t, g, unknown or other
  modified_base (487)..(487): a, c, t, g, unknown or other
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagcccaccctnagtgtccgtgtccccaggacagacagccagcatcactgctctaggaaataatggacagaataaatatacttcctgtatcagcagaatcgaggccacgtcccctgtcgcgtggtcatctatacaagatcgaccaaggccggcccctacgaggggaccctccccgtagacgcgtacttctcgtcggccttaccaacgttcgtacgggaacctcacgaccctacnctcgacctanccgacggccggaccaggctagcgagtggagacgtgtactattactggacgtaggcgtcggacagcacgcacgtcgcccgtntacgtcgtacgttcggaacgtcggaccaggtccaccggtcctaacgtcgaacccg

SEQ ID NO: 381374 - DNA, 581 bp, Homo sapiens
  misc_feature: GZ8MTXP02I1A8U.13.76.G10.1.454.CMB.2.raw
  modified_base (398)..(398): a, c, t, g, unknown or other
  modified_base (437)..(437): a, c, t, g, unknown or other
  modified_base (470)..(470): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagctgggtccgccaggctccgaggggaggggcgtggagtgcgtcttcttttattagtagtagtggtagtacatactccgcagacctcgtggacgggcattcaccatctccaganactaactcaaagaacacgcttagttctacaaatgaaacngacctagagacgccgaatcgaacgtcggtcgtnttattacgtgtacgcgagaggacgttacgggggaccctaacggtaaaccgttacgaaccgtcgtaacggtcggtaccggtcggtacgggggacccgtaacggggaccccgg

SEQ ID NO: 381375 - DNA, 534 bp, Homo sapiens
  misc_feature: GZ8MTXP02IP4Y3.13.76.G10.1.454.CMB.2.raw
  modified_base (434)..(434): a, c, t, g, unknown or other
  modified_base (441)..(441): a, c, t, g, unknown or other
  modified_base (467)..(467): a, c, t, g, unknown or other
  modified_base (473)..(473): a, c, t, g, unknown or other
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtctggaggaggcttgatccagccgtgggggtccctgagactctcctgtgcagcctcgtggttcaccgtcagtcacacctacatgagctgggtcccgccaggcctccgaggggaaggggctggagtgcgttctcttttattatagtagtggtagtacatactccgcagactccgtgagggccgatccacatcaccagacgacaattccaaagacacgcttgttctacaaatgaaacngcctganagccagtcgacacggccgtgtatacnggtcgngagacgagtcggggacccacgaacgttcaacggctaagtcggactcgtagggacccaaggg

SEQ ID NO: 381376 - DNA, 598 bp, Homo sapiens
  misc_feature: GZ8MTXP02IJARL.13.76.G10.1.454.CMB.2.raw
  modified_base (370)..(370): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtggttcaccgtcagtcacacctacatgagcgtcggtccgccgaggctccgaggggaggggcgtggagtgcgtcttcttttattatagtagtggtagtacatactcgcagactcgnggagggccattccaccatctccagagactaatccaaagaacacgtcttgtttctaacaatagaacagcctggaagacgccgatcgaaccaccgggtccgtagttaacttacgtgtcgacgaggtaggacgttccgggggaacccctaaacggtaaaaccgtttaccgaaccgtaacgttacgtacgggtaccggtcggtaccgggggaacccgtaaacggggaccccg

SEQ ID NO: 381377 - DNA, 655 bp, Homo sapiens
  misc_feature: GZ8MTXP02JKC6P.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtggggttcaccgtcagtcacacctacatgagcgtgggtccgccaggctccgagggaggggctggagtgcgtctcttttattatagtagtggtagtacatactccgcagacttccgtggacgggggcctattccaaccgtatcctacccgaagagaacctaaagttcccaaaaggaaacccacgtctttagtttcttaaccaaaagttgaaaccaggtcccttaggacgacgcccgaagtcgaaccaccggggtaccgtagttaactttacgtggttacggacgtaaaagggtaaacgttacgggggaccccctaaacgggtaaacccgtttacgaaccggtactaagtacggggtaaccgtcggtacgggggaccggaaacggggtacccgtaaccggg

SEQ ID NO: 381378 - DNA, 589 bp, Homo sapiens
  misc_feature: GZ8MTXP02HP3QD.13.76.G10.1.454.CMB.2.raw
  modified_base (271)..(271): a, c, t, g, unknown or other
  modified_base (488)..(488): a, c, t, g, unknown or other
tcagtcacgtactacacgaccggtgctcgatttagtcactcatacaggtggggagaggagcccagcactgggattccgaggtgtttccattcggtgatcagcactgaacacagaggactaaccatggagttttggctgagctgggttttccttgttgctattttaaaaggtgtccagtgtgaggtgcaagtggtggagtcgtggggggggcttggttaagccgtggggggtccctcagactctcctgtgcaacctctggattctattttcnctgacgcctggttgagcgtgggtccgccaggccgtcccggggaagggctggaggtgggttggccgtattaaaggtagaagacagtgggtcggacaacagactacagtccgtccgtagaagcagattcactatctacaagagactgaactacaaaagaatgaatatatactgacaaatgaaacaactagaaagcgaagacacaggcgtagtacttacngtaccagagtagtcgggaccaaggatagacaaagtcgggaccgtacgaacgaacggttacgaacgttacgggacgggggaccccggaaacgtccgtaacgg

SEQ ID NO: 381379 - DNA, 551 bp, Homo sapiens
  misc_feature: GZ8MTXP02GWYLH.13.76.G10.1.454.CMB.2.raw
  modified_base (296)..(296): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagctgggtccnccaggcctccgaggggaagggctggagtgcgtcttcttttatttatagtagtggtagtacatactccgcagctccgtggacggggccattcaccatctccagagacaattcccaaagaaccacgtctgtttctacaaatgaaacagcctgagagccgatgacacggccgtgtattacgtgtgcgagagacgtcgggggacccctaacggtaaccgttaacgtacgacgtagtcggacgtcggtacggggaacccg

SEQ ID NO: 381380 - DNA, 578 bp, Homo sapiens
  misc_feature: GZ8MTXP02H81GD.13.76.G10.1.454.CMB.2.raw
  modified_base (503)..(503): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctcgtggggttcaccgtcagtcacacctacatgagcgtcgggtccgccaggcctccgaggggaaggggctgggagtggcgttcgtttctttttattagtagttagtggtagtaccataccgtccgcagacctccggtggacgggggccattccaccatcctaccagacgactaacttaccaaagaacacgtacttcgtttactacaaatgaaacagacctgagagacgatgacgacggcgtgtatactgngacgagtggactcgggggaaccacgtaacgtactacgtcgtacgcggacgtcggtcggggaccgaacggacccgg

SEQ ID NO: 381381 - DNA, 547 bp, Homo sapiens
  misc_feature: GZ8MTXP02I6SFL.13.76.G10.1.454.CMB.2.raw
  modified_base (372)..(372): a, c, t, g, unknown or other
  modified_base (463)..(463): a, c, t, g, unknown or other
  modified_base (469)..(469): a, c, t, g, unknown or other
tcagtcacgtactacacgaccggtgctcgatttagtcactcatacagggggcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctgggggtccctgagactctcctgtgcagccctctgggttcaccgtcagtcacacctacatgagctgggtccgccaggctccgagggaaggggctggagtgcgtctcttttatttatagtagtggtagtacatactccccgcagactccgtgacggggccnttcaccatcctccagacgacaattccaaagacacgcttgtttctacaaatgaaacagcctagagagccgatcgacacggcctgtatactgngcgagngacgtggggacccacgtaaacgttacaccgctaactgggaacgtcggtggggacccaagggacccacggtaccacccg

SEQ ID NO: 381382 - DNA, 570 bp, Homo sapiens
  misc_feature: GZ8MTXP02I5ZDR.13.76.G10.1.454.CMB.2.raw
  modified_base (399)..(399): a, c, t, g, unknown or other
  modified_base (486)..(486): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggtcaccgtcagtcacacctacatgagctgggtcccgccaggctccgaggggaggggctggagtgcgtcttctttatttatagtagtggtagtacatactccgcagaccttccgtggacggggccgattccaccatctccanagacaattaccaaagaacacgccttgtttaccttacaaaatcgaaactgcctagagacgccgaatcgacacgggcgttagtattacngtgcgaggagacgtcggggacccaacgaaaccgttctaacgcttaagtcgggaacgtcgtacgggggaccaaacgggggacccg

SEQ ID NO: 381383 - DNA, 558 bp, Homo sapiens
  misc_feature: GZ8MTXP02ID1TZ.13.76.G10.1.454.CMB.2.raw
  modified_base (293)..(293): a, c, t, g, unknown or other
  modified_base (477)..(477): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtcccnccgaggctccgaggggaaggggctggagtgcgtcttcttttatttatagtagtggtagtacatactccgcagactccgtgacggggcattcaccatctccagagactaattccaaagaacacgcttgtttctacaaatgaaacagcctagagacgccgatcgacacggtccgtagttattacgngtgacgagagagtacgggggcccaacggtaaccgtttacacgcgttaagcggtacgtcgtcgggggaccaacggggacccg

SEQ ID NO: 381384 - DNA, 750 bp, Homo sapiens
  misc_feature: GZ8MTXP02JCCFQ.13.76.G10.1.454.CMB.2.raw
  modified_base (369)..(369): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtggggttcaccgtcagtcacacctacatgacgctgggtcccgccaggctccgaaggggaaggggctgggagtgcgttcttcttttatttatagtagtggtatacgtatctccgnacgacgtccgtggacggggcctacgttccacctatcctacagaacgaacctaaacttaccgaaaagaacctaacggtctttacggttttaccttaacaaaacgttacgaaaaccgacgtacccgttaaggaacggtaaccgtacccgggtaagtacggaaacccgtacccgggggtacccgggtttaagtttaaccggtttaaccgtgggttacgggaccggtaaaacggggaaggtaaccggggttaacccgggggaaccccctaaacggggttaaaaacccgtttaaccgtaacccggtaacgttaacgggttaccggggtaacccggtttaccggggtaccggggggtaaccccgaaaaccgggggtaaacccccggg

SEQ ID NO: 381385 - DNA, 620 bp, Homo sapiens
  misc_feature: GZ8MTXP02FT8IK.13.76.G10.1.454.CMB.2.raw
  modified_base (502)..(502): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggtcaccgtcagtcacacctacatgagctcgggtccgccaggcctccgaggggagggctggagtgcgtcttcttttattatagtagtggtataccatactcgcacgactccgtggacggggcctattccaccatcctccaagacgactaattcccaaagaaccacgcttagtttcttacaaaattcgaaacagccctaggacgacgacccgatccgaacgaccgggccgttagtactttaacgnggtacgacggaggaaggacggtaccggggacccctaacggttaaaccgttacgtaaccggtcgttaacggtacggggtaccggttacgggtacgggggaacccgaaacggggtacccg

SEQ ID NO: 381386 - DNA, 652 bp, Homo sapiens
  misc_feature: GZ8MTXP02F9D1L.13.76.G10.1.454.CMB.2.raw
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggcagataaatatacttctggtatcagcagaagtcaggccagtcccctgtgctggtcatctatcaaagatgaccaaggccggacccctcgaacggggtactcccccccgtagacgcgtactttccgtcttcgggtccttcccaaacgttcgtacggggtaaaccttcgacgtacccctaactccgtacggaacccaagtccgaacggacccgggaccccgaacgggtcctaagtagggacttagggaacggcttaggtaaccttatttaaccgtgttaccgaagggtccggtaggggaaccgaggacgacggccgaacgttcggacccgtcgtaacgttcggtaccgtttaccgggaaaccgttacggggaacccgtaacggtacctaaccccggttacgtaaacgtaccgaaccgtaacccccgg

SEQ ID NO: 381387 - DNA, 720 bp, Homo sapiens
  misc_feature: GZ8MTXP02JUZ51.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagcttgggttttccttgttgcttaattttaaaaggtgcccagtgtgaggtgcagcgtggtggagtcgtgggaggaggcttgactccgacggccggtcgggggtccctggacgacctctcctgtgcacgtcctcgtcggttccaccgtcacgtcacacctacatgacgtcgtcggtccgcgacggccgtaccggaggggagggcgtgggagtcgtcgttctttcttttaagtttagtaggttagtacggtagtactactaccgtccgacgacgtaccgtcggtagggtaccggggtaccgtacttaccgaacctacttcccgaccgaaaggacgtaaacctaacgttaacccgaaaaggaaaccctacggttcttttacggttttacctaaacgtaaaagttacgaaaccgtacgtacccgtaggaacggacccgacccgtagttaaccggaacccggttacggggtaccctttaggttaaccttaacggtcggtagaccggaaggacgtacgggtacccgggaccctaaacggtaccgttaacgacgtcgtacggtggacccggttcggacggaacccgg

SEQ ID NO: 381388 - DNA, 537 bp, Homo sapiens
  misc_feature: GZ8MTXP02I14DE.13.76.G10.1.454.CMB.2.raw
  modified_base (420)..(420): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctgggggtccctgagactctcctgtgcagcctctgggttcaccgtcagtcacacctacatgagctgggtccgccaggctccgagggaaggggctggagtgcgtcttcttttatttatagtagtgtagtacatactcgcacgctccgtggaggggccgattcaccatctccagagacaattcaaagacacgctgttctnaaatgaaacacgtcctgagagccgatgacgacggccgtagtattacgtgtgcgagagacgtcgggggacccacggtaaaccgtaacgtacgctagtaggacgtcgtcggggaacccg

SEQ ID NO: 381389 - DNA, 622 bp, Homo sapiens
  misc_feature: GZ8MTXP02HEB3U.13.76.G10.1.454.CMB.2.raw
  modified_base (236)..(236): a, c, t, g, unknown or other
  modified_base (242)..(242): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggcagataaatntactcngtatcagcagagtcaggccagtcccctgtgctggtcatctatcaagctgccaagccggccctcgaacgggctccccccgtagacgcgtatttcctcgtcgggtcctaccaaactccgttacgggaacctcgacgccctaacgtcgtacgaccctagtaccgacgggacccgggacccagggtcctaagtacggactagggacggtcctaggtacttaattaccgtagtacgtacggggtcggtacgggaacctaggaccgaggaccctacgtccggacccgtacgtaacgtcggttaccgttaccgggaaaccgttaccgggggaaacctaacggtacccgtacccggtaacccgtacggtacccgaacggaacccccgg

SEQ ID NO: 381390 - DNA, 584 bp, Homo sapiens
  misc_feature: GZ8MTXP02IW5O8.13.76.G10.1.454.CMB.2.raw
  modified_base (359)..(359): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagctggtccgccaggctccgagggaagggctggagtgcgtcttctttattatagtagtggtagtacatactccgnagctccgtgagtcgggccgtattccaccctaatcctacccagacgaactaaattacccaaagaacacgtcttagtttcttacaaaatgaaacagccctagagaagccgaatgaaccgaccgggcctagtaacttaacgtggtacgcggaaaggaggacgtcgggggacccccaacggtaaacgttacctaaccgacgtaagtcggaaccggttcggaaccggggg

SEQ ID NO: 381391 - DNA, 673 bp, Homo sapiens
  misc_feature: GZ8MTXP02GGM38.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtcgggtccgccaggcctccgaggggaaggggctggagtgcgttcttcttttattatagtagtggtataccatactccgcagaccttcggtggacggggccattccaccatcctaccagacgtaacaacttacccaaagaaccacgtctttacgttttaccttaacaaaacgttgaaaacctacggtcccttagggaacggacggacccgggaataccggaaccgtaccggggtacccgttagttaactttacggtgtacggacggaaggacggtacgggttaccgggggaccccctaaaccgggttaaaacctttacccggtacgtaaccgttaagtcggggtaaccggttccggtacgggggacccgaaaacggggtacccccg

SEQ ID NO: 381392 - DNA, 556 bp, Homo sapiens
  misc_feature: GZ8MTXP02JE8PM.13.76.G10.1.454.CMB.2.raw
  modified_base (170)..(170): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcactgctctaggaaataatggacagataaatatacttctggtatcagcagaagtcaggccagtcccctgtcgctggtcatctatcaagatgaccaagccggaccctcgagggtactcccccgtgacgcgtacttctcgtggcctaccaaacgtcgtacgggaacctcgacgcccactctacgacccatcgacggccggacccagggctagtggactggacggtctacggtacttagttacgtgtacgagggcggtagggacgacgacgacgcgacgtcgcccgtatacgtcgtccgttacggaacgtcgggaacctaacggtccaccgtaccgtaacgtccgaacgaaccccg

SEQ ID NO: 381393 - DNA, 560 bp, Homo sapiens
  misc_feature: GZ8MTXP02I6KK5.13.76.G10.1.454.CMB.2.raw
  modified_base (405)..(405): a, c, t, g, unknown or other
  modified_base (526)..(526): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtgggtcccgccaggcctccgaggggaggggctggagtgcgtcttcttttattatagtagtggtagtaccatactccgcagactccgtggacggggccgattccaccatcctccaganaacaattccaaagaccacgtcttgtttctacaaatcgaaacagcctagagacgccgatcgacacgggccgttagtattacgtgtgcgagagacgtcggggacccacggtaacgttacacgntacgtcggacgtcgtcggggacccaagggacccg

SEQ ID NO: 381394 - DNA, 613 bp, Homo sapiens
  misc_feature: GZ8MTXP02GZUUK.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtggttcaccgtcagtcacacctacatgagcgtgggtccgccaggcctccgaggggaaggggctgggagtggtcgtcttcttttatttataggttgtggtagtacatactccgacacgccgtccggtggacggggccgtacttcacctactcctaccgaagacgaactaacttacccaaagaccacgtcttgtttactacaaaatcgaaactcgtacctaggacgacgacccgaagtcggaccgaccgggtccgttagtaacgttacgtggtacggacgaggtacgacggtccgggggaccctaacggtaaacgttcgtaaccgtgtacgtcgggacgtccggtacgggggacccg

SEQ ID NO: 381395 - DNA, 584 bp, Homo sapiens
  misc_feature: GZ8MTXP02HQ5UU.13.76.G10.1.454.CMB.2.raw
  modified_base (368)..(368): a, c, t, g, unknown or other
  modified_base (551)..(551): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtcgggtccgccgaggcctccgaggggaaggggctggagtgcgtcttcttttatttatagtagtggtagtaccatactccgnagacctcggtgacggggccattccaccatcctccagagaactaaacttcccaaagaacccacgtcttagttttaccttacaaaattcgaaacctagtcctaggagacgccgaatcgaaccgacgggccgttgtattacgtgtcgcgtagaggctacggggccaccgaacgttactacgcgtanacggtacgacgtcggggtacgacggtaacccgg

SEQ ID NO: 381396 - DNA, 492 bp, Homo sapiens
  misc_feature: GZ8MTXP02IQWSC.13.76.G10.1.454.CMB.2.raw
  modified_base (324)..(324): a, c, t, g, unknown or other
  modified_base (331)..(331): a, c, t, g, unknown or other
  modified_base (419)..(419): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtcccgtgtccccaggacagacagccagcatcacctgctctggaaataattggcagataaatatacttctggtatcagcagaagtcaggccagtcccctgtgctggtcatcatcaagatgccaagccggccctcagggatccccctgancgattcnctggctccaaactcgtgggaacctcagccactctgaccatcagcggacccaggctatgatgagctgactatatgtcaggcgtgggacngcagcactgcccgctaatcgtcttacggaacttgggaacctaaggtcaaccgtcctaaacgtcgacgaccccg

SEQ ID NO: 381397 - DNA, 572 bp, Homo sapiens
  misc_feature: GZ8MTXP02F3SFU.13.76.G10.1.454.CMB.2.raw
  modified_base (295)..(295): a, c, t, g, unknown or other
  modified_base (460)..(460): a, c, t, g, unknown or other
  modified_base (495)..(495): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggttcaccgtcagtcacacctacatgagctgggtccnccaggctccgaggggaaggggctggagtgcgtcttcttttatttatagtagtggtagtaccatacctcgcagacctccgtgacggggccattccaccatcctccagagaacaattaccaaagaacacgcttgtttcttacaaaatcgaaacacgcctaggaacgngacccgatacgacgacgggtcctaggtacttacgngtgacggagagacgtcggggacccaacgtaacgttaccacgctagtcggacgttcgacggggaccaacggggacccg

SEQ ID NO: 381398 - DNA, 602 bp, Homo sapiens
  misc_feature: GZ8MTXP02ILU7U.13.76.G10.1.454.CMB.2.raw
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagcccaccctcagtgtccgtgtcccccaggacagacagccagcatcacctgctctggaaataattggcagataaatatactcctgtatcagcagagtcaggccagtcccctgtgctggtcatctatcaagatgaccaagccggccctcgacgggacctccccgtgacgcgattcctctcggcctaccaactcgtacggggaactcgacgccctactcctagaccataccgacgacccggggacccaggggcctagtcgggaattcggaggtacttaggacttagttaccgtagtactaatacgaacgtacgggaaactaaacgtaattagtagggtaacgttcggggtaccgttcgggtttaccgggacgggttaaacggggaaccctaaaacggtcggacccgttaccggtaggtacccaacgggtacccgaaacggg

SEQ ID NO: 381399 - DNA, 753 bp, Homo sapiens
  misc_feature: GZ8MTXP02GSDXW.13.76.G10.1.454.CMB.2.raw
  modified_base (246)..(246): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagcgtggtttctgtagctatttaaagtgccagtgtgaggtgcagctggtggagtctggaggaggcttggatccagccgtgggggtccctgagactctcctgtgcncgtctcgtcggtcacgtcagtcacacctacagtgacgtcgtcggtccgccgaggccgtacggaggggacggtcgtaggtaggtcgtcgttctttacttttaattagtaggttaggtacggtaacgtactacgtaccgtccgacgaacgtccgtccgggtagggaccggggtacctacttaccaacctactacccgtacgaaacggtaacgtaaactaaaccgttaacccgaaaacgtaaacccgtacgttacgtttcgttttacttaaacgtaaaacgttacgtaaaccgtaacgtaccgtacggtaacggaacgaccgtaacgtacggtaaccggtaccgggtaccggttacgttaacgttacgttacggtacggtacgggtaacggtaacgggtaacgggtaccggggtaacccggtaaaccggttaaaccggttaaaccggttaaccggtaaccggttacggttaccgggtaccgggttaccggggttaccgggggtaaccggg

SEQ ID NO: 381400 - DNA, 684 bp, Homo sapiens
  misc_feature: GZ8MTXP02JF1XV.13.76.G10.1.454.CMB.2.raw
  modified_base (338)..(338): a, c, t, g, unknown or other
  modified_base (521)..(521): a, c, t, g, unknown or other
  modified_base (573)..(573): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgtcttattttaaaaggtgccagtgtgaggtgcagcgtggtggagtcgtgggaggaggtcttgactccgacggtcccggttcggggggtcccgtggacgtaccttccttccgtgtgcacgtcccttcgtcgggttccaccgtcacgtcacacctacatgacgcgtcggtccgccgacggccnccggaggggagggcgtggagtcgcgttctttcttttattagtagtagtggtagtacctatacctcgcacgacgttcggtgggacgggccgtacttaccacctactcctaccgaaagacgtaaaccctaacgttaaccgaaaagaccctacgtctttagtttaccttaacaaaattcgaaaacncggtacctaggaacgacgaccgatacggaccgaccggtcttagttaacttgnggtacgcggaaggaggtacggtaccggggaaccctaacggtaaaccgtttacgacgtaacgtaacggtcgggtaccggtacggtaccgggggaaccgaacgggggtacccg

SEQ ID NO: 381401 - DNA, 543 bp, Homo sapiens
  misc_feature: GZ8MTXP02FOO16.13.76.G10.1.454.CMB.2.raw
  modified_base (409)..(409): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagctgggtccgccaggctccgagggaaggggctggagtgcgtcttcttttattatagtagtggtagtacatactccgcagactccgtggaggggccattcaccatcctccagagacaattccaanacacgcttgttactacaaatgaaacaggcctgagagcccgatcgacacggccgtagtacttactgtgacgagagacgtcggggacccacgtaaacgttcgaacgctaagtcggacggtcgtacggggaacccgg

SEQ ID NO: 381402 - DNA, 611 bp, Homo sapiens
  misc_feature: GZ8MTXP02HIS74.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagctgggtccgccgaggctccgagggaggggctggagtgcgtctcttttattatagtagtggtagtaccatactcgcagactcgtgagggctatcaccatcctccagacgactaatccaaagaacacgtacttgtttacctacgaaaatcgaaacacgtccctaggaacgacggacccgatacggaaccgaccgggtcccgttaggtaacttacgtgtcgacggaggtacggaacgtccgggggacccccaacgggtaaaccgtttacctaacggaaccgttagtacggggtaccgttcggtaccgggggacccaaaacgggggaccccg

SEQ ID NO: 381403 - DNA, 543 bp, Homo sapiens
  misc_feature: GZ8MTXP02ITRXB.13.76.G10.1.454.CMB.2.raw
  modified_base (393)..(393): a, c, t, g, unknown or other
  modified_base (469)..(469): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggggttcaccgtcagtcacacctacatgagctgggtccgccaggctccgagggaggggctggagtgcgtctcttttattatagtagtggtagtaccatactcgcagactccgtggaggggccattccaccatctcagngacaatccaagacacgcttgtttctcaaatgaaacagtcctagagacgcgatgacacgggccgtagtattacgtgngtcgagagagtcgggggacccacgtaacgttacacggtctagtcggtacgtcgtcgggggaccaacgggacccg

SEQ ID NO: 381404 - DNA, 522 bp, Homo sapiens
  misc_feature: GZ8MTXP02JULSV.13.76.G10.1.454.CMB.2.raw
  modified_base (295)..(295): a, c, t, g, unknown or other
  modified_base (429)..(429): a, c, t, g, unknown or other
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttcctggtatcagcagaagtcaggccagtcccctgtgctggtcatctatcaagntgccaagccggccctcgaggactcccgtgacgcgattcgtctggcctccaactctgggaacctcgacgccctacgtctacgaccaagtccgaggccgggacccagggctagtggatggagcttgactagttacngttcgagggcgtaggggacacgcgagcactcggcccgtctacgtcgtccgttacggaacgtcggacacggtccaccgtcgtaacgtcaaccgg

SEQ ID NO: 381405 - DNA, 516 bp, Homo sapiens
  misc_feature: GZ8MTXP02JZCWP.13.76.G10.1.454.CMB.2.raw
  modified_base (294)..(294): a, c, t, g, unknown or other
  modified_base (391)..(391): a, c, t, g, unknown or other
  modified_base (433)..(433): a, c, t, g, unknown or other
  modified_base (459)..(459): a, c, t, g, unknown or other
  modified_base (502)..(502): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggggttcaccgtcagtcacacctacatgagctgggtccnccaggctccgagggaaggggctggagtgcgtctctttttattatagtagtggtatacatactccgcagactcgtgaggggccatcaccatctcaganacatccaagacacgctgttctacaaatgaaacagcctgaganccgatgacacggccgtgtattactgngcgagagacgtggggacccacgacgtacacgctagcgacgtcnggggccaagggccc

SEQ ID NO: 381406 - DNA, 585 bp, Homo sapiens
  misc_feature: GZ8MTXP02I4HEO.13.76.G10.1.454.CMB.2.raw
  modified_base (485)..(485): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggggtcaccgtcagtcacacctacatgagctgggtcccgccaggctccgagggagggctggagtgcgtctcttttattatagtagtggtagtacatactccgacagacctccgtggacggggccgtattccaaccatcctccagagacaattaccaaagacacgtcttagtttcttacaaatgaaacacgacctgagacgaccgatagaccgacggccgtagtattacgngtcgacgagagcgtacggggaccctaacggtaaaccgttacgtaccgcgttaacggtacggtacggtccggtacgggggacccgaaaggggtacccccgg

SEQ ID NO: 381407 - DNA, 597 bp, Homo sapiens
  misc_feature: GZ8MTXP02HK6JY.13.76.G10.1.454.CMB.2.raw
  modified_base (372)..(372): a, c, t, g, unknown or other
  modified_base (396)..(396): a, c, t, g, unknown or other
  modified_base (439)..(439): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggtcaccgtcagtcacacctacatgagcgtgggtcccgccaggcctccgaggggaaggggctggagtgcgtcttcttttatttatagtagtggtagtaccatactcgcagactcgngacgggccatcaccatctccaganactattaccaaagaaccacgcttagtttactacaaatgaaacngcctagagagccgatcgaccgacggtccgttggtaacttacgtggtacgaccgaggacggtacggttacgggggaccccctaaggtaaaccgtttaccaccgggtaacttaggtcgggtaccgtcggtaccggggggaacccaaacgggggtaccccg

SEQ ID NO: 381408 - DNA, 556 bp, Homo sapiens
  misc_feature: GZ8MTXP02IPPLJ.13.76.G10.1.454.CMB.2.raw
  modified_base (366)..(366): a, c, t, g, unknown or other
  modified_base (401)..(401): a, c, t, g, unknown or other
  modified_base (473)..(473): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagctgggtcccgccaggctccgaggggaaggggctggagtgcgtcttcttttatttatagtagtggtagtaccatactccgnagcctcgtggacggggccattccaccatctcaganacaatccaaagaacacgcttagttctacaaatgaaacagcctagagagccgatcgacacggctgtatactgngacgagagacgtcgggggacccaacgtaaccgttacaacggcttaagtcgggtacgtcgtacggggaccgaaacggggacccg

SEQ ID NO: 381409 - DNA, 640 bp, Homo sapiens
  misc_feature: GZ8MTXP02JR6KW.13.76.G10.1.454.CMB.2.raw
  modified_base (234)..(234): a, c, t, g, unknown or other
  modified_base (245)..(245): a, c, t, g, unknown or other
  modified_base (271)..(271): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacgagggtcctgggcccagtctgtactgacgcacgcccgcctcgagtcgtccgtaccgggggccccagggcaggaggtccacatctcngcacgtggacncacgctacagtagtcggacactatanagtatacgtactacgtacgtacagtacgtacgtacgaggacgacgtacgtaccactactactacactaactaacgtaaccgaaccgaacgtaccgtccggaccgaccggtaccgggtccgtacgtaccgtcttcgtcgtcgtacgtaccgtcgtccgtacgaccctaccgtccgtcccgtcccgtccgtaccgtacgtaccgtacgccggtccggtccgtacggacggtacgtacggacggtagtacggtacgttacgtacgttacgttacgttcgtacgtacgttacgtacgtacgtacgacgtacgtcgtacgtcgtacggtcgtcggtacggttacgggtacgggtaccggggaccggtacgtcgg

SEQ ID NO: 381410 - DNA, 764 bp, Homo sapiens
  misc_feature: GZ8MTXP02IS08N.13.76.G10.1.454.CMB.2.raw
  modified_base (169)..(169): a, c, t, g, unknown or other
  modified_base (230)..(230): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccacctnagtgtccgtgtccccaggacagacagccagcatcactgctctgaaataatggcagataatntactctgtatcagcagagtcaggccagtcccctgtgctggtcatctatcaagatgaccaaggccggcccctcgaggggactccccccgtaggacgcgtaatttccgtacgttcgggcctccctaaacgttccgtacggggaaaccttcgaaacggtcccctaaaccttccgtacggaaccctaaacgtcccgaaacgggtcccgggggaaacccccaaggggtacccgttaacggttacggggaagtttacggggaaacggggttcccgttaagggtaaaccctttaaagtttaaccccggttagggttaacccggaagggggttcccggggttaacggggggaaacctacgggtacccgtaaacgggacccgaaaccgtttccggggacccccctagttaaacggtcggttttaccccgttaccggggtaaaacccggttaccgggggaaaaccccgttaaaacgggggttaccccgtaaaacccccggttacccgttaaaaacggttcccgaaaacccggaaaccccccggg

SEQ ID NO: 381411 - DNA, 623 bp, Homo sapiens
  misc_feature: GZ8MTXP02F04Z9.13.76.G10.1.454.CMB.2.raw
  modified_base (242)..(242): a, c, t, g, unknown or other
  modified_base (290)..(290): a, c, t, g, unknown or other
  modified_base (458)..(458): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctggtttccttgtgctatttaaaggtgccagtgtgaggtgcagcgtggtggagtcgtggaggaggcttgatccagccgtgggggtcctgagactctcctgtncagcctcgtgggtcaccgtcagtcacacctacatgagcgtcgggtccncgaggcctacggaggggacgggcgtggagtgtcgtcttatttattatagtgtggtataccgatacctcgacacgtaccgtccgtggggacgggtaccgtaacttccaacctatcctaccgaagtacaactaacgtaccaaagacctacgtcctttagttaccctaaanaaagtcgaaacgcgtaccgaggacgacgaccgtagtacgaccgtcggtacgttagtacttcgtggacggacgaaggacgtaccgggaccgggaaccctaaacgttaacgtccgaacgcgtaacggtcgggtaccggtacgggaccgggaaccggaacggtacccg

SEQ ID NO: 381412 - DNA, 556 bp, Homo sapiens
  misc_feature: GZ8MTXP02JFOJG.13.76.G10.1.454.CMB.2.raw
  modified_base (250)..(250): a, c, t, g, unknown or other
  modified_base (297)..(297): a, c, t, g, unknown or other
  modified_base (330)..(330): a, c, t, g, unknown or other
  modified_base (370)..(370): a, c, t, g, unknown or other
  modified_base (385)..(385): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcngcctctgggttcaccgtcagtcacacctacatgagcgtcggggtccnccgaggctccgagggaaggggctggagtgcgtntctttattatagtagtggtagtacatactcgcagactcgngagggcatcacatcncagacacaacttacaagaacacgtcttacgttcttacaaattgaaactgacctaggagacgccgaatcgaccgacgggccgttagtacttacgtgtacgcggtagagtacgtggggacccacgtaacgttacacgcgtagacggacgtcgtcggggaccgaacggaacccg

SEQ ID NO: 381413 - DNA, 599 bp, Homo sapiens
  misc_feature: GZ8MTXP02GWS2B.13.76.G10.1.454.CMB.2.raw
  modified_base (235)..(235): a, c, t, g, unknown or other
  modified_base (307)..(307): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggancagctccaacagttggggcacattatgatgtacactggtaccagcagtttccaggagcaggtcccagctccncatacaatacgtaacaacaatccggcccgacgacggggtcccctgacccgtattctcgtggcctccgaggtctcggcctaccgtcacgtccctacccgtcggtacacgtccacgtcgggcctccgaacgggtcgtagggtacgggagttacgggaacggtccgttaggttaactttacgtttaccgtcgtacccgtacggttacccttagtacggtacacggtaccgacgtcccgttaggaacgttcgtacgtttacggggtacgttcgggggcccgggggtaacctacggg

SEQ ID NO: 381414 - DNA, 607 bp, Homo sapiens
  misc_feature: GZ8MTXP02JQKW7.13.76.G10.1.454.CMB.2.raw
  modified_base (406)..(406): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtcgggtccgccgaggctccgaggggaaggggctggagtgcgtcttcttttattatagtagtggtagtaccatactccgcagactcgtggacggggcctagttccaccatcctccaganacaattccaaagaacacgtcttgtttactacaaatgaaacaggcctaggacgacgaccgatacgaaccgaccgggtaccgtagttaacttacgtgtacggacgaggaaggacggtacgggggacccctaacggtaaaccgttaccgaacggtccgtaaggtcgggtacgtccggtacgggggacccgaacggggaaccccg

SEQ ID NO: 381415 - DNA, 561 bp, Homo sapiens
  misc_feature: GZ8MTXP02I2IJ6.13.76.G10.1.454.CMB.2.raw
  modified_base (172)..(172): a, c, t, g, unknown or other
  modified_base (237)..(237): a, c, t, g, unknown or other
  modified_base (288)..(288): a, c, t, g, unknown or other
  modified_base (293)..(293): a, c, t, g, unknown or other
  modified_base (337)..(337): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctctaggaaataatggcagataaatntacttctggtatcagcagaagtcaggccagtcccctgtgctggtcatctancaagntgaccaagccggccctgagggactcccccgtgacgcgactttcncgtggcctaccaactcgtacggacctcacgcccacgtcacgtaccactcgacggacccggacccaggtcctagaggactaggacggtctacggtacttaattcgagttacgagggcggtacgggacaggacgacgcgacgtcgacccgtctacgttcgttacgttaccggacgtacgggaacctacggtcccgaacgtaccgtaaacgtccgaacgaaccccgg

SEQ ID NO: 381416 - DNA, 457 bp, Homo sapiens
  misc_feature: GZ8MTXP02ITX2N.13.76.G10.1.454.CMB.2.raw
  modified_base (450)..(457): a, c, t, g, unknown or other
tcagtcacgtactacacgaccggtgctcgatttagtcactcatacagggtgtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctggggccaagggaccacggtcaccgtctcctcagccctccaccaaggggccccatcggtccttccccctggccgcccctgcctcccaggagccacctccccgagagcacagccggccctggggctgcctggtcaaggactacttcctagtacgtgactgagcgggctggcaggcgcatagnnnnnnnn

SEQ ID NO: 381417 - DNA, 577 bp, Homo sapiens
  misc_feature: GZ8MTXP02JDKNG.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagcgtgggttttccttgttgctatttaaaaggtgcccagtgtgaggtgcagctggtggagtctggaggaggcttgatccagccgtggggggtccctgagactctcctgtgcagcctcgtggggttcaccgtcagtcacacctacatgagcgtgggtccgccaggctccgaggggaggggctggagtgcgtctcttttattagtagtagtggtagtacatactcgcagactccgtggacggggccgtatccaccatcctccagagactaacttaccaaagaaccacgcttacgtttacttacaaaatcgaaacacgtcctaggagacgcccgaagtcgaacgtacgggccgtagtacttactgtgacgaggagacggtcggggaccaacgtaacgttcctaacgctagcggtacggtcgtcgggggaccaagggtacccg

SEQ ID NO: 381418 - DNA, 706 bp, Homo sapiens
  misc_feature: GZ8MTXP02G6HA7.13.76.G10.1.454.CMB.2.raw
  modified_base (437)..(437): a, c, t, g, unknown or other
  modified_base (489)..(489): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtctggaggaggcttgatccagccgtggggggtccctgagactctcctgtgcagcctcgtggttcaccgtcagtcacacctacatgagcgtcgggtccgccgaggcctccggaaggggaacggggccgtagggagtcggtcgttctttacgttttatttagtagtagtaggtagtacctactaccgtccgacagtaccgtccggtggacggggccgtacttccacctatcctaccgaaganaaacctaataccaaaggaacctcgtacttcgtttacttacaaaatcgaaacncgtacctaggagacgtaccggatacggaaccgtacgggtcccgttaggttactttaaccgggtaggtacggacggtaaagggtacgggtaccgggtacccgggggtaaacccgtaaaccggttaaaaccgtttaaccgtaaccggtaacggttacggtaccggggtaccggttaccgggggtaaccgggggaacccggtaaaaccgggggtaccccg

SEQ ID NO: 381419 - DNA, 575 bp, Homo sapiens
  misc_feature: GZ8MTXP02JT9OC.13.76.G10.1.454.CMB.2.raw
  modified_base (448)..(448): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgccaggctccgaggggaggggctggagtgcgtcttctttttattatagtagtggtagtaccatactccgcagacctcggtggacgggggcctattccactatcctaccagacgacaattcccaaagaaccacgcttgtttcttacaaatgaaacngcctggagacgccgaatcgaaccaccgggccgttgtattaccgtgtcgacggagaggacggtcggggacccaacggtaaccgttacacgctaagtcggacgtcggtcggggaccgaacgggtacccg

SEQ ID NO: 381420 - DNA, 603 bp, Homo sapiens
  misc_feature: GZ8MTXP02IWDIX.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggtcaccgtcagtcacacctacatgagcgtgggtccgccaggcctccgaggggaaggggctggagtgcgtcttcttttattatagtagtggtagtacatactcgcagacctcgtggacggggcctattccacctatcctaccaagacgaactaaattacccaaagaaccacgtcttagtttctaacaaatgaaacagccctagagacgccgatacgaccgacggcccgttagtaacttacgtgtggacgaggaagacgtcgggggaccccctaaggtaaaccgttaccgtaacggcttaacggtcgggaccgtacggtacgggggacccgaaacggggtaaccccg

SEQ ID NO: 381421 - DNA, 509 bp, Homo sapiens
  misc_feature: GZ8MTXP02JZADN.13.76.G10.1.454.CMB.2.raw
  modified_base (395)..(395): a, c, t, g, unknown or other
  modified_base (430)..(430): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggcagataaatatacttctggtatcagcagaagtcaggccagtcccctgtgctggtcatctatcaagatgccaagcggccctgagggactcccccgtgagcgtacttctctggcctccaaactcgtagggaacctcacgcccactctgaccatcagcggacccagctanggatgagctagactatacgtgtcgaggcgtggacngcagcacgtcgccgctagtcgtacgttacggaacgtcgggaaccgacggtaccaccgtaccgtaacgtcgacgaccccg

SEQ ID NO: 381422 - DNA, 519 bp, Homo sapiens
  misc_feature: GZ8MTXP02GHVXB.13.76.G10.1.454.CMB.2.raw
  modified_base (335)..(335): a, c, t, g, unknown or other
  modified_base (404)..(404): a, c, t, g, unknown or other
  modified_base (462)..(462): a, c, t, g, unknown or other
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttctggtatcagcagaagtcaggccagtcccctgtgctggtcatctatcaagatgccaagccggccctcgagggactcccctgagcgattcctntcggcctaccaactccgtggggaactcacgcccactctcgaaccatccgagccgggacccagggctagngatggagctgacttattactgtcgaggcggtagggacagcaggccacgtcgccccgtntacgtcgtacgtacggaacgtaacggaacctacggtaccaccgtacgtacgtcaccg

SEQ ID NO: 381423 - DNA, 549 bp, Homo sapiens
  misc_feature: GZ8MTXP02JR3SH.13.76.G10.1.454.CMB.2.raw
  modified_base (294)..(294): a, c, t, g, unknown or other
  modified_base (434)..(434): a, c, t, g, unknown or other
  modified_base (468)..(468): a, c, t, g, unknown or other
  modified_base (516)..(516): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggggttcaccgtcagtcacacctacatgagctgggtccnccaggctccgagggaggggctggagtgcgtctcttttattatagtagtggtataccatactcgcagctcgtgacggggcattcacatctccagagactaatcccaaagtaaccacgctgtttacctacaaaatgaaaccnggaccctggaagagccgatgaaccgcggtccgtntaattactgtcgacgagaggacgtcgggcccaacgtaacgttacacgntacgtcggacgtcgaggggacccaaggggaccc

SEQ ID NO: 381424 - DNA, 597 bp, Homo sapiens
  misc_feature: GZ8MTXP02G7DF7.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctcggggttcaccgtcagtcacacctacatgagcgtcgggtccgccgaggctccgaggggaaggggcgtggagtgcgttcttcttttattatagtagtggtagtacatactccgcagactccgtggacggggcacttcaccatctaccagagaactaatacccaaagaaccacgtcttagtttactacaaaatcgaaacagcctagagacgaccgatacggaccacggaccgtgttacgtacgtgtggacgtaggacgtacggtcgggggacccctaacggtaaaccgtttacgtaacgtcgtagtacgggtacgttcgacgggggaccgaaacggggacccgg

SEQ ID NO: 381425 - DNA, 556 bp, Homo sapiens
  misc_feature: GZ8MTXP02HYQH7.13.76.G10.1.454.CMB.2.raw
  modified_base (437)..(437): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgagggaggggctggagtgcgtcttctttttattatagtagtggtagtacatactcgcagactccgtggacggggccgattccaccatcctccagagacaattccaaagaacacgcttgtttctacaaatgaaacngcctgagacgccgatcgacacgggtcctggttaattacgtggtacgcggagaggagtcgggggaccctacggaaacgttacagcctagtcggacgtcgtcggggaccaaacggggaccc

SEQ ID NO: 381426 - DNA, 617 bp, Homo sapiens
  misc_feature: GZ8MTXP02GWFBM.13.76.G10.1.454.CMB.2.raw
  modified_base (360)..(360): a, c, t, g, unknown or other
  modified_base (374)..(374): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctggttcaccgtcagtcacacctacatgaactcgggtccgccgaggcctccgaggggaaggggctggagtgcgtcttcttttatttatagtagtggtagtacatacnccgcagactcgtgnggggccattcaccgactctcacgagactaacgttccaaagaaccacgtcttgtttaccctagaaattacgaaacgacgcctagacgtacgaccgagtacgaccgtacggtccgttagttaacttacgtgtacgacggtaagaggtacggtaccgggggacccctaacggtaaaccgttaccgtacggtacgtaacgtcggggaaccgttcggtcgggggaccaaacggggacccgtaacccgg

SEQ ID NO: 381427 - DNA, 543 bp, Homo sapiens
  misc_feature: GZ8MTXP02H7U0P.13.76.G10.1.454.CMB.2.raw
  modified_base (375)..(375): a, c, t, g, unknown or other
  modified_base (437)..(437): a, c, t, g, unknown or other
  modified_base (444)..(444): a, c, t, g, unknown or other
  modified_base (455)..(455): a, c, t, g, unknown or other
  modified_base (470)..(470): a, c, t, g, unknown or other
  modified_base (509)..(509): a, c, t, g, unknown or other
  modified_base (514)..(514): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggggttcaccgtcagtcacacctacatgagctgggtccgccgaggctccgaggggaggggctggagtgcgtctcttttatttatagtagtggtagtaccatactccgcagactccgtggnggggccgattcaccatctccagagacaaatccaaagaacacgcttgttctacaaatgaaacngcctganacgccatgacncgtcgtgtattacgngtgcgagagacgtcggggacccacgaacgtttacaccgntaagnggacttcgcggggaccaaacggggacccg

SEQ ID NO: 381428 - DNA, 615 bp, Homo sapiens
  misc_feature: GZ8MTXP02FR65M.13.76.G10.1.454.CMB.2.raw
  modified_base (364)..(364): a, c, t, g, unknown or other
  modified_base (456)..(456): a, c, t, g, unknown or other
  modified_base (518)..(518): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggtcaccgtcagtcacacctacatgagcgtgggtcccgccagggcctccgaggggaaggggcgtgggagtgcgttcttcttttatttatagtagtggtagtacatcncgcagactcgtgagggccatccaccatctcgagacaactaactaccaaagaaccctacgtctttagttttacctaacaaaagtcgaaaaccncgtccgtaggacgtacgaccgggataccggaacgaccgggtccgttagttaacttacgtggngacgaggaagtacgggtccgggggaaccccaacggtaaacgttcctacgcgttaagtacggggacgttcggacgggggacccgaacgggtaaccccg

SEQ ID NO: 381429 - DNA, 535 bp, Homo sapiens
  misc_feature: GZ8MTXP02FNMZQ.13.76.G10.1.454.CMB.2.raw
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttctggtatcagcagaagtcaggccagtcccctgtcgctggtcatctatcaagatgccaagccggccctcgagggacctccccgtgacgcgattcctctggcctccaactcgtacgggaactcacgccactctcgaccatcgacgccgggaccaggcctaagtcggagtggaggctagtaccttaagttacgtggtacgagggtcggtagggacagcgagcacgtcgcccgctacgtcgtacgtacggaacgtcgggaacctaacggtccaccggtaccgtaacgccgaaccgg

SEQ ID NO: 381430 - DNA, 520 bp, Homo sapiens
  misc_feature: GZ8MTXP02FTLAF.13.76.G10.1.454.CMB.2.raw
  modified_base (424)..(424): a, c, t, g, unknown or other
  modified_base (439)..(439): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaatagtgcagataaatatacttctggtatcagcagaagtcaggccagtcccctgtgctggtcatctatcaagatgccaagccggccctcgagggactccccctgacgcgtattctctcgggctacccaaactcgtacggggaacctcgaacgccaactctcgacccatcagcgggacccaggctagtgatgaggctgactattacngtcaggcgtaggacngacagcacgtcgccgctactcgtacgttacggaacttacggggaacctaaggtccaccggtacctaacgtcacgaaccccg

SEQ ID NO: 381431 - DNA, 589 bp, Homo sapiens
  misc_feature: GZ8MTXP02IRL6G.13.76.G10.1.454.CMB.2.raw
  modified_base (250)..(250): a, c, t, g, unknown or other
  modified_base (457)..(457): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctctgtgcngcctctgggttcaccgtcagtcacacctacatgagcgtgggtcccgccaggcctccggaggggaaggggctggagtgcgttcttcttttatttatagtagtggtataccatactccgacacgtacctccgtgggacggggccctattccaccatcctccagagaacctaataccaaagaaccacgcttagtttctacaaatgaaacngcctagagacgcatcgacacggcgtgtatacgtgtgacgaggagcggtacgggggaccctaacggtaaaccgtttcgaaccgtcgttaagtcgggaaccgttcggtacggggacccgaaacggggtaccccg

SEQ ID NO: 381432 - DNA, 596 bp, Homo sapiens
  misc_feature: GZ8MTXP02GOEL6.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtcgggtcccgccaggcctccgaggggaaggggctggagtgcgtcttcttttatttatagtagtggtagtaccatacctcgcagactcgtggacggggccattccaccatcctaccaagacgaactaaattacccaaaagaaccacgtcttagtttactacaaaatcgaaacacgcctagagacgaccgatacgaccgacggccgtagtattacgtgtcgacgagagacgtcgggggaccccaacggtaaaccgttactaccgcgtaagtcgggtaccgtcggtaccgggggaccgaaacgggaaccccg

SEQ ID NO: 381433 - DNA, 850 bp, Homo sapiens
  misc_feature: GZ8MTXP02HMQLB.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggaggaggcttgatccagccgtgggggtcctgagactctcctgtgcagcctcgtgggttcaccgtcagtcaccacctacatgagcgtcgggtcccgccgacggccgtaccggaaggggaacggggcgtagggaggtcggtccgtttctttacttttttaatttaagttagtttaggttagggttaacgttaacctacttaaccgttcccgacctaaggtaacccgttccgggttcggggaacgggggtaccctaacgtttacccgaaccctactacccttacccgaaaggtaaacgaaacccttaaaacgtttaacccccgaaaaaggtaaaaccctaaacccggttccttttaacggttttttacccttaaacaaaaaacgttacggaaaaaccgtacggtaccccgtttaggaaaacgggtaccgaccccgggtaaagttaccgggtaaaacccgacccgggggttacccgtttaggtttaaacctttaaccgtgggttaacgggtaccggaaagggtacggtaaccggttccggggggaaaccccctaaaacggggttaaaacccgtttaacgtaaccggtaaccgttaagtacggggtaacccggtcgggtaccgggggaacccgtaaaacgggggaacccccg

SEQ ID NO: 381434 - DNA, 609 bp, Homo sapiens
  misc_feature: GZ8MTXP02GUDOL.13.76.G10.1.454.CMB.2.raw
  modified_base (398)..(398): a, c, t, g, unknown or other
  modified_base (411)..(411): a, c, t, g, unknown or other
  modified_base (441)..(441): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttattttaaaaggtgcccagtgtgaggtgcagctggtggagtctggaggaggcttgatccagccgtgggggtccctgagactctcctgtgcagcctctgggttcaccgtcagtcacacctacatgagcgtgggtccgccgaggctccgaggggaggggcgtggagtgcgtcttcttttattatagtagtggtataccatactcgcagactcgtggacgggcattccaccatctccaganaacaataccaaanaacacgtcttgtttactacaaatcgaaacngacctgagacgacccgatacggaaccgaccgggtccgttagttaacttacgtggtacgacggaggaaggtacggtaccgggggacccctaaacgggttaaaccgttaccgaacgtaaccgttaagtcggggaccgtcggtacgggggaacccgaaacggggaaccccg

SEQ ID NO: 381435 - DNA, 706 bp, Homo sapiens
  misc_feature: GZ8MTXP02HSID3.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgccagtgtgaggtgcagcgtggtggagtcgtgggaggaggcttgatccagccggtgggggtcctgagactctccgtgtgcacgcctcgtcgggttccaccgtcagtccaccacctacatgagcgtcgggtccgccgaggcctaccggaaggggaacggggcgtagggagtggtcggttctttactttttaattagttaggttaaggtggttaagtaacctataccgttcccgacgtaacgtacccgtcggttggggaacgggggtccggactttacccgaacctactcctacccgaagacgaaactaaacttacccgaaagaaacccacgttctttacgtttacctaacctaaagtacgaaaacgcgtacctaggaaagaccgaccgaatacggaacccgacgggtaccgttagttacttaaccgtggtacgacgaaggagtacggtccggggaacccctaaaccgtaaacgttacccgttaccgaattaaacggcggtacggttcggacggggaacccgaaaggggaacccccgg

SEQ ID NO: 381436 - DNA, 600 bp, Homo sapiens
  misc_feature: GZ8MTXP02IYNHM.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtctggaggaggcttgatccagccgtggggggtccctgagactctcctgtgcagcctcgtgggtcaccgtcagtcacacctacatgagctgggtccgcaggctccgagggagggctggagtgcgtcttctttattatagtagtggtagtacatactcgcagctccgtggacggggccattcatcatctaccagacgactaattaccaaagaaccacgtcttagttacttacaaattagaaactgcctaggaagacgaccgagtcgaaccgaccgggtaccgtagttaactttaaccgtggtacggacggaggaaggtacggtaccgggggaccccctaaacggtaaccggtttaaccgaacggtaccttaaggtacgggtacccggttcggtaaccggggg

SEQ ID NO: 381437 - DNA, 667 bp, Homo sapiens
  misc_feature: GZ8MTXP02FI6BZ.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtggggggtccctgagactctcctgtgcagcctcgtgggtcaccgtcagtcacacctacatgagcgtgggtccgccaggcctccgaggggaggggctggagtgtcgttcttacttttatttatagtagtggtagtaccatacctcgcagaccgtcggtggacgggggcctagttccacctatcctaccaagtacgaacctaaacttacccgaaagtaaacctaccgtctttacgttttaccttaacaaaaacttcggaaaaccacggtacccgtaggaacgacggacccggtaaagttccggaaccgtacggggtcccgtttagttaactttaccgtgtacggacgtaggacggacggtaccgggggacccctaacggtaaaccgttacgtaccgaacgttacgttacggggaccgtcggtacggggacccaacggggaaccccg

SEQ ID NO: 381438 - DNA, 536 bp, Homo sapiens
  misc_feature: GZ8MTXP02G7U0G.13.76.G10.1.454.CMB.2.raw
  modified_base (233)..(233): a, c, t, g, unknown or other
  modified_base (490)..(490): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgcctcagtgtctggggccccagggcagaggtcaccatctcctgcactgggancagctccaacattggggcacattatgatgtacactggtaccagctagtttccaggacgcaggtcccagacctcctcatcaatacgtaaacaacaatccggcccgacgacggggtcccctagaccgtattctctggcctccgagtctcggcctacctcgacgcctcccgtgtcatcacgtgggcctcgaggtctggacggatggaggtctagtatttattcgtgtcctaagtccctatcggacacgctacgccttagngttcgtcgtttcggtacgttccgggggaccgggggtaccctacggg

SEQ ID NO: 381439 - DNA, 576 bp, Homo sapiens
  misc_feature: GZ8MTXP02I3BWR.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagctgggtcccgccaggctccgagggaggggctggagtgcgtcttcttttatttatagtagtggtagtacatactcgcagactccgtggacgggccagttccaccatctccagagacaattccaaagaacacgtctgtttacttacaaatgaaacagcctagagacgccgatcgaccgacggtccgtagtattacgtgtcgacgagagacgtcgggggaccctaacggtaaaccgttacaccggaactaaggtcggaaccggttcgtacgggggaccaaacggggaaccccg

SEQ ID NO: 381440 - DNA, 612 bp, Homo sapiens
  misc_feature: GZ8MTXP02IVHVL.13.76.G10.1.454.CMB.2.raw
  modified_base (464)..(464): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtcgggtcccgccaggcctccggaggggaaggggcgtggagtgccgttcttcttttatttatagtagtggtataccatactccgcagactcgtggacggggctagttccaccacgtcctccgaagacgaactaacttaccaaagaacctacgtcttagtttcctacaaagtcgaaacncgtccgtaggacgacgtaccgatacggaccgacgggtccgtagtaattacgtgtacggacgtagaggtcggtacggggaccctaacgtaaaccgttacgtacgcgtacggtcggggtccgtacggtacggggaccaacggggtacccg

SEQ ID NO: 381441 - DNA, 636 bp, Homo sapiens
  misc_feature: GZ8MTXP02IOL45.13.76.G10.1.454.CMB.2.raw
  modified_base (170)..(170): a, c, t, g, unknown or other
  modified_base (237)..(237): a, c, t, g, unknown or other
  modified_base (292)..(292): a, c, t, g, unknown or other
  modified_base (422)..(422): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtgtcccgtgtccccaggacagacagccagcatcacctgctctaggaaataatggacagataaatntacttctggtatcagcagagtcaggccagtcccctgtgctggtcatctatcaagntcgaccaagccgccctcgagggactcccccgtgagtcgtattctcgtcggccttaccaacttcgtacgggaacctcgacgtccctaactcacgtacccagtccgaacggaccgggacccgaggtctaagnggagtaggacggtctaggtacttagtttacgtcggtaccgacgggtacggtaggggaacgacggacgacgaccgtaccgtccggtcccgtacgttaacgtccggtttacccggttaaccggggtaaccggttacgggggtaaacccgtaaaccgggttacccgtaacccggggttaaccctaaaccggttacccgaaaccggtaaaccccccgg

SEQ ID NO: 381442 - DNA, 610 bp, Homo sapiens
  misc_feature: GZ8MTXP02HNCF0.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtcgggtccgccgaggcctccggaggggaaggggctggagtgcgttctttacttttatttatagtagtggtataccatactcgcagactcgtggagggcattccacctatctccagacgaactaataccaaagaaccacgtcttagtttactactaaatacgaaacacgacctggaagacgaccgaatcgaaccgaccggtccgtagttaacttacgtgacgacggaagtacggacgtacgggggacccctaacggtaaaccgttacgtaccgtaacgtagtacggtaccggtcggtaccgggggaccgaaacggggaaccccg

SEQ ID NO: 381443 - DNA, 572 bp, Homo sapiens
  misc_feature: GZ8MTXP02JGHJA.13.76.G10.1.454.CMB.2.raw
  modified_base (367)..(367): a, c, t, g, unknown or other
  modified_base (441)..(441): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtgggtccgccgaggcctccgaggggaaggggctggagtgcgtcttcttttattatagtagtggtagtaccatactccgnagactcgtgacggggcattcacatctccagagacaattaccaagaacacgtctagtttctacaaattcgaaacngtacctgagacgcccgatcgaccgacggtccgtagttacttacgtgtacgcgaagacggaacgtcgggggacccacgtaaaccgttacacgtctagtcggacgtcggtacggggacccaaggggaaccccg

SEQ ID NO: 381444 - DNA, 627 bp, Homo sapiens
  misc_feature: GZ8MTXP02GEBPS.13.76.G10.1.454.CMB.2.raw
  modified_base (470)..(470): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggtcaccgtcagtcacacctacatgagcgtcgggtcccgccgagggcctccggaggggaacggggcgtagggaggtcgccggttctttctttttaatttatagtagtggtagtaccatactccgcagaccttcgtggacggggccattccaccatctccagacgaactaattaccaaagaaccacgtcttagtttacctacaaaatcgaaacncgaccgtaggaacgacgacccgaatcgaaccgacgggtccgttagtacttacgtggtcgacggaggaggtcgtacgggggacccctaacggtaaaccgttacgtaacgtcgtacggtacggaccgtcggtacgggggacccgaaacggggtaccccg

SEQ ID NO: 381445 - DNA, 600 bp, Homo sapiens
  misc_feature: GZ8MTXP02JNUO7.13.76.G10.1.454.CMB.2.raw
  modified_base (470)..(470): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtcgggtccgccaggcctccgaggggaacggggcgtgggagtgcgttcttcttttatttagtagtagtggtagtacatactcgcagccgtcgtggacggggccattcacctatcctccgaagacgaactaattacccgaaagaaccacgtcttagtttaccttaacaaaagttcgaaaccncggtcctaggaacggacgacccgatacggaacgtacgggccgttagtaacttacgtgtcggacgaggagacggtccggggaccctaaggtaacttaacgacgctagcggaccgtcggtacggggaacccg

SEQ ID NO: 381446 - DNA, 553 bp, Homo sapiens
  misc_feature: GZ8MTXP02HNNZQ.13.76.G10.1.454.CMB.2.raw
  modified_base (401)..(401): a, c, t, g, unknown or other
  modified_base (436)..(436): a, c, t, g, unknown or other
  modified_base (452)..(452): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcgtgggtttccttgttagctattttaaaaggtgcccagtgtgaggtgcagctggtggagtctgggaggaggcttgatccagccgtggggggtccctgagactctcctgtgcagcctctgggttcaccgtcagtcacacctacatgagctgggtccgccaggctccgaggggaaggggctggagtgcgtcttctttatttatagtagtggtagtaccatactccgcagacgtccgtggacggggcgattccacatctccaganacaatccaagaacagctgtttctacaaatgaaacncgtctagagacgcgancgacgcggcgtagtacttacgtgacgacgagagtacgtccggggacctaacgtacgttacacgtaagtagtcggtacgtcggacgggtaccgaacgggccg

SEQ ID NO: 381447 - DNA, 577 bp, Homo sapiens
  misc_feature: GZ8MTXP02JSH6C.13.76.G10.1.454.CMB.2.raw
  modified_base (431)..(431): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggggttcaccgtcagtcacacctacatgagctgggtccgccaggctccgagggaggggctggagtgcgtctcttttattatagtagtggtagtaccatactccgcagactccgtgaggggccattcaccatctccagagacaattccaagaacacgctgtttctacaaatgaaacngcctgagagccgatgacacggccgtgtattactgtgcgagaggacgtcgggggaccccaacggtaaaccgtttaaccgtaaccggcttaacggtacggggtaaccggttccggttacggggggacccgaaacgggggtaacccccg

SEQ ID NO: 381448 - DNA, 651 bp, Homo sapiens
  misc_feature: GZ8MTXP02HKSFC.13.76.G10.1.454.CMB.2.raw
  modified_base (492)..(492): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtctgggaggaggcttgatccagccgtgggggtccctgagactctcctgtgcagcctctggggttcaccgtcagtcacacctacatgagcgtgggtccgccgaggcctccggaggggaacggggctggagtggcgttctttctttttatttatagttagtggtagtacctatacctcgcagactccggtggacggggccattccacctatcctcccaaagaccggaaactaaacgttacccaaaaggaaaacctaccggtcctttagttttacccttaacaaaattcggaaaaccncgtacgtaggaacgacgaccggagtacgaaccggtaccggtaccgttagtaactttacgtcggacggacggtaaggaggtacggaccggggaaccctaacgtaaccgttacgaccgtgtaaggacgggtacgtcggacggggaaccggaacgggacccg

SEQ ID NO: 381449 - DNA, 548 bp, Homo sapiens
  misc_feature: GZ8MTXP02IPXR9.13.76.G10.1.454.CMB.2.raw
  modified_base (398)..(398): a, c, t, g, unknown or other
  modified_base (477)..(477): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtccctgagactctcctgtgcagcctctgggttcaccgtcagtcacacctacatgagcgtgggtcccgccgaggctccgaggggaggggctggagtgcgtcttcttttattatagtagtggtagtacatactcgcagacctcgtggacgggccattcaccatctacaganactaatccaaagaaccacgtcttgtttctacaaatgaaacagcctagagacgccgaatcgacacgggtctgtattacgngtgcgagagcgtccggggaccacggtaaaccgttcacgctagtcggacgtcgacggggaccaaggggaccc

SEQ ID NO: 381450 - DNA, 574 bp, Homo sapiens
  misc_feature: GZ8MTXP02I2Q3Y.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctatttaaaggtgcccagtgtgaggtgcagctggtggagtctggaggaggcttgatccagccgtgggggtccctgagactctcctgtgcagcctctgggttcaccgtcagtcacacctacatgagcgtcgggtccgccgaggcctccgaggggaaggggctgggagtgcgtcttcttttattatagtagtggtagtacatactccgcagctccgtgacggggccattcaccatcctcagagaacaacttccaaagacacgtcttagtttactacaaatgaaacacgcctagagacgccgatacgacacggccgttagtacttacgtggtgacggaggagacgtcgggggacccctaacggtaaaccgtttaacgaccgtacgtacgtcggaccggttcggtacgggggaacccgg

SEQ ID NO: 381451 - DNA, 586 bp, Homo sapiens
  misc_feature: GZ8MTXP02IXI5D.13.76.G10.1.454.CMB.2.raw
  modified_base (491)..(491): a, c, t, g, unknown or other
  modified_base (540)..(540): a, c, t, g, unknown or other
  modified_base (548)..(548): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtgggtcaccgtcagtcacacctacatgagcgtcgggtcccgccgaggcctccgaggggaaggggctggagtgcgttcttcttttattatagtagtggtagtacatactcgcagactccgtggacgggccattcaccatctccagacgactaatccaaagacacgtcttgtttctacaaaatgaaacagcctaggacgacgtccgatacggaaccgacggccgttagtaacttcgngtaggcgagtacgacgtccggggaccctaacgtaaaccgttcgaaccgngttaacgngggtacccgtggaccggggaccgaaaacgggggacccg

SEQ ID NO: 381452 - DNA, 521 bp, Homo sapiens
  misc_feature: GZ8MTXP02JKV69.13.76.G10.1.454.CMB.2.raw
  modified_base (289)..(289): a, c, t, g, unknown or other
  modified_base (294)..(294): a, c, t, g, unknown or other
  modified_base (454)..(454): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttcctggtatcagcagaagtcaggccagtcccctgtgctggtcatctancaagntgccaagccggcccctgaggggactcccccgtgagcgattcgctgggcctccaactcgtagggaacctcagcccactctcgaccctatcgaacggccggaccccaggctaagtggatggacggctagaccttattacgtgtcgaggcgtgggacagcgancgacgtcgacccgctatcgtctacggatcggggaaccaggtccaccgtactaacgtccacggacccg

SEQ ID NO: 381453 - DNA, 522 bp, Homo sapiens
  misc_feature: GZ8MTXP02JG5F8.13.76.G10.1.454.CMB.2.raw
  modified_base (472)..(472): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctgggggtccctgagactctcctgtgcagcctctgggttcaccgtcagtcacacctacatgagctgggtccgccaggctccagggaaggtgctggagtgcgtctcttttattatagtagtggtagtacatactccgcagactccgtgaggggccgattcaccatctccagagacaattccaagaacacgctgtttctacaaatgaacagcctagagagccgatgacacggccgtgtatactgtgcgagngacgtcggggcccacggaacgttactacgctagtcggacgtcgtacgggg

SEQ ID NO: 381454 - DNA, 545 bp, Homo sapiens
  misc_feature: GZ8MTXP02IH4U1.13.76.G10.1.454.CMB.2.raw
  modified_base (417)..(417): a, c, t, g, unknown or other
  modified_base (442)..(442): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctatttaaaaggtgcccagtgtgaggtgcagctggtggagtctggaggaggcttgatccagcctggggggtccctgagactctcctgtgcagcctctgggttcaccgtcagtcacacctacatgagcgtcgggtccgccgaggcctccgaggggaaggggctgggagtgcgttcttcttttatttatagtagtggtagtacatactccgcacgctccgtggacgggggccatcacatcctcagagacaattaccaaanacacgcttgttctacaaatgaaacngcctagagagccgatcgacacggctgtatctgtgacgaggagacgtcggggaacccacgtaacgttaacgtacgactacgtacggacgtcggacgggaacccg

SEQ ID NO: 381455 - DNA, 581 bp, Homo sapiens
  misc_feature: GZ8MTXP02JWRKJ.13.76.G10.1.454.CMB.2.raw
  modified_base (293)..(293): a, c, t, g, unknown or other
  modified_base (444)..(445): a, c, t, g, unknown or other
  modified_base (483)..(483): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccnccaggcctccgaggggaggggctggagtgcgtcttctttttattatagtagtggtagtaccatactccgcagactcggtgacgggggcccattccacctatctcccagacacaattaccaaagaacacgctgtttctacaaattcgaaacnnctgagacgacgatcgacgacggtcgtagtattacgtgngacggagacggtacggtaccggggacccaacggtaaccgttacgaccgtaacgttacggtacgggtaccgtcggtacggggacccgaaacggggcccg

SEQ ID NO: 381456 - DNA, 596 bp, Homo sapiens
  misc_feature: GZ8MTXP02JFNCD.13.76.G10.1.454.CMB.2.raw
  modified_base (293)..(293): a, c, t, g, unknown or other
  modified_base (418)..(418): a, c, t, g, unknown or other
  modified_base (429)..(429): a, c, t, g, unknown or other
  modified_base (437)..(437): a, c, t, g, unknown or other
  modified_base (451)..(451): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccnccaggctccgagggaaggggctggagtgcgtcttcttttatttatagtagtggtagtaccatactccgcagactccgtggaggggccagttccaccatcctccagagacaattccaaagacacgntgtttcctaanaatgaacngctagagacgcgancgacgacgggtcgttagtacttacgtgtcgacggaggacggtacggtccggggaacccctaacggtaaaccgttaccgtaaccggtcgttaacggtacgggtaccggttaccgggtacgggggaacccgtaaacggggtaccccg

SEQ ID NO: 381457 - DNA, 660 bp, Homo sapiens
  misc_feature: GZ8MTXP02I3S47.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggtcaccgtcagtcacacctacatgagcgtgggtccgccgaggcctcgaggggaggggcgtggagtgcgtcttctttattatagtagtggtagtacatactcgcagacctcggtgggacggggcctattccacctatcctaccaagacgaacctaaactaccgaaagaaccacgtcctttgtttacctaacaaaagttcgaaacgtaacgtccgtaggagaccggtccgtaagtccggaaccgaccggggtccgttaagttactttaaccgtggttcggacggaggaacggtcgggtacccgggggaaccctaaccggtaaaacgtttaccgtacggtaacgttaacggtcgggtaccggttaccgggtaccgggggaacccggaaacgggggtaacccccgg

SEQ ID NO: 381458 - DNA, 539 bp, Homo sapiens
  misc_feature: GZ8MTXP02GLBQT.13.76.G10.1.454.CMB.2.raw
  modified_base (411)..(411): a, c, t, g, unknown or other
  modified_base (466)..(466): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtctggaggaggcttgatccagccgtgggggctccctgagactctcctgtgcagcctcgtgggttcaccgtcagtcacacctacatgagctggtccgccaggctccgagggagggctggagtgcgtctcttttattatagtagtggtacgtacatactccgcagactccgtgacggggccattccacatcctccagacgacaattcccaaagaacncgtcttgttctacaaatcgaacagcctgagagccatgacgacggcctgtatacgngtgcgagagagtcggggaccccaagtaaccgttacaacggtctagtcggaccgtcggcggggaccaaacgggg

SEQ ID NO: 381459 - DNA, 499 bp, Homo sapiens
  misc_feature: GZ8MTXP02F4BTC.13.76.G10.1.454.CMB.2.raw
  modified_base (235)..(235): a, c, t, g, unknown or other
  modified_base (310)..(310): a, c, t, g, unknown or other
  modified_base (377)..(377): a, c, t, g, unknown or other
  modified_base (401)..(401): a, c, t, g, unknown or other
  modified_base (409)..(409): a, c, t, g, unknown or other
  modified_base (425)..(425): a, c, t, g, unknown or other
  modified_base (427)..(427): a, c, t, g, unknown or other
  modified_base (440)..(440): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatntacttctggtatcagcagaagtcaggccagtcccctgtgctggtcatctatcaagatgcccaaaggccggccctnaaggggactccccccgtagacgcctattctcgtggcctccaatcctagggaacctcagcccactctnaccatcagcgggacccaggctagngatgagcngactatatgtcgaggngngacgagcagcacncgccgctatcgtcgtacgtacgacgaacgacgtacgaccgtacgtacgtacgacgaccg

SEQ ID NO: 381460 - DNA, 631 bp, Homo sapiens
  misc_feature: GZ8MTXP02IF3FI.13.76.G10.1.454.CMB.2.raw
  modified_base (279)..(279): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcgtgggtctttccttgttgcttaattttaaaaggtgcccagtgtgaggtgcagctggtggagtcgtgggaggaggtcttgatccgaggtccgtggggggtccctgagctctcctgtgcacgcctcgtggttccaccgtnagtcacacctcatgagcgtcggtcccgccgacggccgtaccggaggggaacggggctgggagtcgtcgttctttcttttatttagtaggtagtggtagtactactacctccgactacgccgtccgggtgggacggggcctattccacattccacgagacaactaactacaaagacacgtcttgtttactacgaaatcgaaacacgtcctaggaacgacgaccgtagtacgaccgtaccggggtcttagttacttaccgtggtagacgagacggtacggtaccggggaccccaaagggttacttaccgaacgtcgtaaggtcggaccggtcgggacggggaccgtaaaccggg

SEQ ID NO: 381461 - DNA, 658 bp, Homo sapiens
  misc_feature: GZ8MTXP02GRHAY.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtgggtcccgccaggcctccgaggggaaggggctggagtgcgtcttcttttattatagtagtggtagtacatactcgacagtactcggtggacggggccgtattccaccattccacccgaagacgaactaacttacccaaagaaactacgcttacgtttaccttaaacaaatacgaaactacgtaccgtaggaacgacgaccgtaagtaccgaaccggtaccgggtccgttaagttacttacgtggtacggacggaaggacggtacggggtaccggggaacccctaaaacggtaaaccgttaacgtaacggtaacgttaacggtacgggttacggtccgggtaccgggggaacccggaaaaccgggtacccg

SEQ ID NO: 381462 - DNA, 600 bp, Homo sapiens
  misc_feature: GZ8MTXP02HS90G.13.76.G10.1.454.CMB.2.raw
  modified_base (329)..(329): a, c, t, g, unknown or other
  modified_base (453)..(453): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggttcaccgtcagtcacacctacatgagctcgggtccgccaggcctccgaggggaggggctggagtgcgtnttcttttatttatagtagtggtagtaccatactccgcagacctccggtgacggggccgattccgaccatctccagacgacaattcccaaagaaccacgtcttgtttacttacaaattcgaaacncgcccttagaagacgacccggaattcggaaccacgggcccgttagttaacttacgtggtagcgaaggtaggacgtcgggggacccacgaaaccgtttcgaacgtcgtaagtcgggtacgtcgtcgggggacccgtaaagggaccccg

SEQ ID NO: 381463 - DNA, 531 bp, Homo sapiens
  misc_feature: GZ8MTXP02IXFJD.13.76.G10.1.454.CMB.2.raw
  modified_base (289)..(289): a, c, t, g, unknown or other
  modified_base (402)..(402): a, c, t, g, unknown or other
  modified_base (461)..(461): a, c, t, g, unknown or other
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataatggcagataatatactctgtatcagcagagtcaggccagtcccctgtgctggtcatctatcaanatgccaagcgcctcagggacctccctgagcgtattctctcgggcctacctaaacttccgtaggggaacctcgacgccctactctcgaccatcacggccggacccaggcctagngatgagctagactattacgtgtcgagggcgtacgggacacgacaggacacgtcgcccgnttacgtcgttacgttacggaacgtcgggaaccgtaacggtccctaaccggtccttaacggccaaacccgg

SEQ ID NO: 381464 - DNA, 588 bp, Homo sapiens
  misc_feature: GZ8MTXP02I6U7I.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggttcaccgtcagtcacacctacatgagctgggtccgccaggcctccgaggggaaggggctggagtgcgtcttctttttatttagtagttagtggtagtaccatacctccgcagacctccgtgagggaccgattccacatctcagagacaattaccaaagaacacgcttgtttacttacaaattgaaacagcccttaggagacgaccgtatcggaacacggtccgtagtacttacgtgtggcgagaggacgtcgggggaccctaacggtaacgttacgtacgtcgtagtacggtaccggtcggtacgggggacccgaaacggggaacccgg

SEQ ID NO: 381465 - DNA, 668 bp, Homo sapiens
  misc_feature: GZ8MTXP02GNGGJ.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtcgtggaggaggcttgatccagccgtgggggtccctgagactctcctgtgcagcctcgtggttcaccgtcagtcaccacctacatgagcgtcgggtccgccgagggcctaccggaggggaacggggcgtggaggtgcgtcttctttttattataggtagtggtagtacatactccgcacgtcctccgttagggacggggcctagttccacctatccctccgaagacgaactaaacttacccaaaagaaaccacgtctttacgtttaccttaacaaaattcggaaaacctacgtccctaaggaacgtacgcccgtaagtcgaacccgtaccgggtaccgttagttaaactttccgtaggttccgagggaggaacggtaacggtcccgggggaaccccctaacggttaaaccgttaaccgtaccgtacgttagtacgggggtaccgtccgggtacgggggaacccccgg

SEQ ID NO: 381466 - DNA, 750 bp, Homo sapiens
  misc_feature: GZ8MTXP02HW1UL.13.76.G10.1.454.CMB.2.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggcagataaatatacttcctaggtatcagcagaagtcaggccagtcccctgtgctggtcatctatcaagatgccgaagccggccctacgaggggtactccccccgtagacgtcgtactttccgtccgtcgggcccttaccctaaaccgttcccgtacgggggtaaaccttcccgaaacggtccccctaaaccttcccgttaccggaaccccctaacgttcccgaaaccggggtacccgggggtaaaccccccgaaggggtacccgttaaggttaccggggaaaggttacgggaaacggggttcgttacggtaaacctttaacgtttaacccggttcggtaccggtacgggggtacccgggttagggggaaaccgtaacggggaccgaacgggccctaaccgtccgggtaccccgtacgttacgttccggttacccgtttaccggggaaaccgttcgggggaaacccgtaacgggttacccgtaaccccggttaccgtaaacggttacccgaaccggaaacccccgg

SEQ ID NO: 381467 - DNA, 621 bp, Homo sapiens
  misc_feature: GZ8MTXP02I6YCS.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagctgggtccctccaggctccgaggggaggggctggagtgcgtcttctttttattatagtagtggtagtacatactccgcagaccgtccgtggacggggccgtattccaccatcctccaagagaacaacttaccaaagaaccacgtcctttgtttaccttacaaaattcgaaaactcgacccttaggaacgacgacccgaagtcgaaccgacgggtccgtagttacttacgtggtacgacggaggagtacggtacgggggacccctaacggtaaaccgttacgtaaccgccgttagtcggggaccgttcggtacgggggaccgaaacggggtaccccg

SEQ ID NO: 381468 - DNA, 796 bp, Homo sapiens
  misc_feature: GZ8MTXP02FW2FA.13.76.G10.1.454.CMB.2.raw
  modified_base (743)..(743): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctatttaaaaggtgccagtgtgaggtgcagctggtggagtctggaggaggcttgatccagccgtgggggtccctgagactctcctgtgcagcctcgtgggttccaccgtcagtcacacctacatgagcgtcggggtcccgccgaggcctaccggaggggaacggggcgtgggaggtcggtccggttctttctttttaagtttaagtaaggttaggttagggttaagttaacccgtaacgttaccgtcccgacgtaacgtaacccgttccgggttcggggaacgggggacccgtaactttcccgaaccctacttccgtacccgaaaggaacgtaaacccttaaaacgtttaccccgaaaacggtaaaccctaacccggtcttttacggtttttaacccttaacaaaaagttcggaaaaacctacggtacccgttaggaacggtaaccggcccgtaaagttacggaacccgtacggggtacccgtttaagttaacgtttaaccgtgggtacggaaccggaaggtaacggtacgggttacccgggggaacccctaaaacggggttaaaacccgttacgttaaacccggngtttaacggcgggtaaccggtcggtacgggggaacccgaacggggtaaccccg

SEQ ID NO: 381469 - DNA, 580 bp, Homo sapiens
  misc_feature: GZ8MTXP02JW6YV.13.76.G10.1.454.CMB.2.raw
  modified_base (254)..(254): a, c, t, g, unknown or other
  modified_base (266)..(266): a, c, t, g, unknown or other
  modified_base (374)..(374): a, c, t, g, unknown or other
  modified_base (422)..(422): a, c, t, g, unknown or other
  modified_base (446)..(446): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtctggaggaggcttgatccagccgtgggggtccctgagactctctgtgcagcctntgggtcaccgtnagtcacacctacatgagctggtccgcaggctcgaggggaagggctggagtcgcgttcttcttttaattatagttagtccggtagtacagtacctcggcagccttccgnggaggggccctatccacatcaccagagacaattcccaaagaccacgtntcgttactacaaaagtcgaaaccncgtcgagacgacgacgtagacgacgacggtacgtagttacttacgtggtacgacggagacggtacggtaccgggaccctaacggtaaccgttaacgacggtactacggtacggtaccggtcggtacggggaccg

SEQ ID NO: 381470 - DNA, 580 bp, Homo sapiens
  misc_feature: GZ8MTXP02GC4MO.13.76.G10.1.454.CMB.2.raw
  modified_base (294)..(294): a, c, t, g, unknown or other
  modified_base (326)..(326): a, c, t, g, unknown or other
  modified_base (442)..(442): a, c, t, g, unknown or other
  modified_base (483)..(483): a, c, t, g, unknown or other
tcagtcacgtactacacgaccggtgctcgatttagtcactcatacaggggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccnccaggctccgagggaaggggctggagtgcgtntcttttatttatagtagtggtagtacatactccgcagactccgtggacggggccgattcaccatctccagagaacaattccaaagaacacgcttgtttccttacaaaatgaaaacncgcctaggagacgccgatcgaccacggccgtagtattacgngtgcggagaggagtcgggggacccaaacggtaaacgttacctaacggcttacggtacgggtaccgtcggtacgggggacccgtaaaggggaaccccg

SEQ ID NO: 381471 - DNA, 693 bp, Homo sapiens
  misc_feature: GZ8MTXP02GRR8E.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagcgtgggtccgccaggctccgaggggaggggctggagtgcgtcttctttttatttatagtagtggtagtaccatactccgcagacctccgtggacggggccagttccaccatcctacccaagacgaacctaattacccgaaagaacctacgtcttagttttccttaacaaaattcgaaaactacgtcccgtaggaacgacggacccgtaatacggaacccgaccggggtacccgttaggttaactttaaccgtgggttacggaccggtaaagggaggtaacggttaccggggggaaccccctaaaccgggttaaaacccggtttaaccgtaaccgggtaaccgtttaacggtacggggtaacccggttccgggtacgggggaacccccgtaaaagggggtaaccccccgg

SEQ ID NO: 381472 - DNA, 650 bp, Homo sapiens
  misc_feature: GZ8MTXP02G4D9F.13.76.G10.1.454.CMB.2.raw
  modified_base (458)..(458): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctctggggttcaccgtcagtcacacctacatgagcgtgggtccgccaggcctccgaggggaaggggctggagtgcgtcttcttttattatagtagtggtagtacatactcgcagactccgtggacggggccgattccaccatctaccagagaacaattacccaaagaaccacgtcttagttttacctaacaaaattcgaaaaccncgtaccgtagacgaccgaccgaagtacgaaccggtacggtaccgttagttaacttacgtggtacggacggtaaggaggtaccgggtaccggggtaacccctaaacggttaaacccgttaaccgtaacggtaaccgttaacggtaccggggtaccggtccgggtaccgggggaacccgtaaacggggtacccg

SEQ ID NO: 381473 - DNA, 521 bp, Homo sapiens
  misc_feature: GZ8MTXP02F3Q0B.13.76.G10.1.454.CMB.2.raw
  modified_base (170)..(170): a, c, t, g, unknown or other
  modified_base (234)..(234): a, c, t, g, unknown or other
  modified_base (288)..(288): a, c, t, g, unknown or other
  modified_base (326)..(326): a, c, t, g, unknown or other
  modified_base (439)..(439): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctctggaaataatggcagataaatntactctgtatcagcagaagtcaggccagtcccctgtgctggtcatctatcaagntgccaagcggccctgaggctccccctgacgcgatttcnctgggcctcccaaactcgtaggggtaacctcgacgcccaactctcgaccatcgagccgggacccaggctagtggatgaggctagactagttactgtccgaggtcgtagggacnggcagcgacgtcgcccgatacgtcgtacgttaccggaacgtcgggaaccgaaggtacccacggtacctaacgtcacgacccg

SEQ ID NO: 381474 - DNA, 587 bp, Homo sapiens
  misc_feature: GZ8MTXP02IZ5NC.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctcgggtcccgccaggcctccgaggggaacggggctggagtgcgttcttctttttatttatagtagtggtataccgatacctcgcagacctccgtggcggggccgattccaccatctccagagacaattaccaaagaacacgctgtttctacaaatgaacagcctagagacgaccgatcgacgacggccgtagtattacgtggtcgacgaggagacggtcgggggaccctaaccggtaaaccgttacgacggtaaccgtaaggtacggtacgtaccggtacggggacccgaacggggaacccg

SEQ ID NO: 381475 - DNA, 593 bp, Homo sapiens
  misc_feature: GZ8MTXP02G0JOI.13.76.G10.1.454.CMB.2.raw
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctcagtgtcccgtgtccccaggacagacagccagcatcacctgctctagaaataatggacagataatatactctggtatcagcagaagtcaggccagtcccctgtgctggtcatctatcaagatgcaagcgccctcgagggcctcccgtgacgcgtattcctcgtcgggcctaccgaaactccgtaggggtaacctcgacgtcccaacgttcctacgaacccagtaccacggcccggggaacccaggcctaagtgggaaacttgggaacggcttagacttacgttaaccgtgtacgagggtcggtagggacagcgagcacgtcgccccggtatacgttcggtaccgttaccgggaacgttaaccggggaaccctaaacggggttaccctaccggtacccgtttaaacggtccgaaaccccggg

SEQ ID NO: 381476 - DNA, 506 bp, Homo sapiens
  misc_feature: GZ8MTXP02I9H0I.13.76.G10.1.454.CMB.2.raw
  modified_base (235)..(235): a, c, t, g, unknown or other
  modified_base (332)..(332): a, c, t, g, unknown or other
  modified_base (432)..(432): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatntacttcctggtatcagcagaagtcaggccagtcccctgtgctggtcatctatcaagatgccaagccggccctcaggggactccccctgagcgattcnctggctccaaactctagggaacctcgagtcccactctgaccatcaagcgggaccccaggctatgggatggagctgactagttactgtcaggcgtgggacngcagcactgacccgctatcgttcgttcggaacgtgggaaccgtaacggtcaccggtctaaggtccaagaccccg

SEQ ID NO: 381477 - DNA, 579 bp, Homo sapiens
  misc_feature: GZ8MTXP02GD9BP.13.76.G10.1.454.CMB.2.raw
  modified_base (492)..(492): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagctgggtccgccaggctccgaggggaggggctggagtgcgtctcttttatttatagtagtggtagtaccatactcgcagactccgtggacggggccgtattccgaccatcctccaagacgaacaattacccaaagaacacgtcttgtttactacaaaatgaaacacgcctagagagccgaatcgaccacgggccgtagtacttacgngtcgacgtagaggacgtcggggacccacggtaaccgttacacgcgtaagtcgggaccgtcgtacgggggaccaaacggggtaccccg

SEQ ID NO: 381478 - DNA, 577 bp, Homo sapiens
  misc_feature: GZ8MTXP02FU0CQ.13.76.G10.1.454.CMB.2.raw
  modified_base (360)..(360): a, c, t, g, unknown or other
tcagtcacgtactacacgaccggtgctcgatttagtcactcatacagggggggagaggagcccagcactgggattccgaggtgtttccattcggtgatcagcactgaacacagaggactaaccatggagttttggctgagctgggttttccttgttgctattttaaaaggtgcccagtgtgaggtgcagctggtggagtctggaggaggcttgatccagcctgggggtccctgagactctcctgtgcagcctctgggttcaccgtcagtcacacctacatgagcgtgggtccgccgaggcctccgaggggaagggctggagtgcgtctctttattatagtagtggtagtacatactccgnagactccgtgcggggccattcaccatctccagagactaacttaccgaaagaacacgtctgtttctactaaatacgaacagcctagacgagaccagtcgaaccgacggaccgtgtacttacgtgtgacgtacgagacggtacggggacccaacggtaacgttacctacgtacgtaagtacggtacgtcggtacggggaccgaacgggaccgtaaccgg

SEQ ID NO: 381479 - DNA, 582 bp, Homo sapiens
  misc_feature: GZ8MTXP02H5JVR.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgccaggcctccgaggggaggggctggagtgcgttctctttttattatagtagtggtagtacatacctcgcagactccgtggaggggccacgttcacctatctccagagacaattccaaagaacacgtctcgtttctacaatgaaacagtcctgagacgaccgagtgacacggtccgtagttactacgtgtcgcgtagaggacgtcgggggacccctaaacggaaccgtttacgaccgtccgttagtacggggtaccgtcggtacgggggaccgaacggggaacccccgg

SEQ ID NO: 381480 - DNA, 539 bp, Homo sapiens
  misc_feature: GZ8MTXP02GAT3E.13.76.G10.1.454.CMB.2.raw
  modified_base (233)..(233): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgcctcagtgtctggggccccagggcagaggtcaccatctcctgcactgggancagctccaacattggggcacattatgatgtacactggtaccagcagtttccaggagcaggtcccagactcctcatcaatacgtaacaacaatccggacccgacgacggggtccctgaccgtattctctggctccgagtctggcacctcacgccctcccgtggtcacttcacgtcgggcctccgaggtcgtggaggtactggacggtctagtattactttctcgacctacggttcctattcgaacgacgtacacgtcctagaacgtcgtacgttcggtagtttcccggggacgggggtaccctacgg

SEQ ID NO: 381481 - DNA, 536 bp, Homo sapiens
  misc_feature: GZ8MTXP02HN4HC.13.76.G10.1.454.CMB.2.raw
  modified_base (356)..(356): a, c, t, g, unknown or other
  modified_base (367)..(367): a, c, t, g, unknown or other
  modified_base (434)..(434): a, c, t, g, unknown or other
  modified_base (440)..(440): a, c, t, g, unknown or other
tcagtcacgtactacacgaccggtgctcgatttagtcactcatacagggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccccgagactctcctgtgcagcctctgggttcaccgtcagtcacacctacatgagctggtccgccaggctccgaggggaagggctggagtgcgtctcttttattatagtagtgtagtacatactccgnagactccgtgnggggccattcaccatctccagagacaattccaagacacgctgtttctacaaatgaacagcctagagngccgangacgacggccgtgtattactgtgacgagagagtcggggcccaacggaacgttactacgctaagtcgacgttcgcgggaccaacggggaccaccggg

SEQ ID NO: 381482 - DNA, 581 bp, Homo sapiens
  misc_feature: GZ8MTXP02H608F.13.76.G10.1.454.CMB.2.raw
  modified_base (408)..(408): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggtttttccttgttgctattttaaaaggtgcccagtgtgaggtgcagctggtggagtctgggaggaggcttgatccagccgtgggggtccctgagactctcctgtgcagcctcgtgggttcaccgtcagtcacacctacatgagcgtcgggtccgccgaggcctccggaaggggaacggggcgtggaggtggcgttcttcttttatttatagttagtggtagtacatactcgcagctcgtggacgggctagttcacatctcaganactaactccaaagacacgtcttagtttactacaaatgaacacgtccgtagagacgcgatgacacgggtctgtaactgtgtaggcgagacggacgtcggggaccctaacggtaacgtttacgaccgtaagtacgtacgggtaaccgttcggacggggacccgaaacgggacccg

SEQ ID NO: 381483 - DNA, 735 bp, Homo sapiens
  misc_feature: GZ8MTXP02J1SJD.13.76.G10.1.454.CMB.2.raw
  modified_base (139)..(139): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgngctgggttttccttgttgctattttaaaaggtgcccagtgtgaggtgcagctggtggagtcgtggaggaggcttgatccgaggccgtgggggtccctgacgactctcctgtgcacgccgtcgtcggggttccaccgtcacgtcaccacctacagtgcgcgtcgggtcccgccgaggccgtaccggaggggaacggggcgtgggaggttcgtcgtttcttactttttaagttagttagttaggtaggtaagtacccactaccgtccgacacgaccgttccgggtcgggacgggggaccctattccaacctacttacccgcccaaaggtaacgtaaacctaaaccgtttaacccgaaaacgaaaacccgtacgtcgtttaacgtttaccgtttaaaccaaaagttaccggaaaccgtacgtcccgaggacgaacggacccggtaaagtccgaaccgtaacccgggtcccgttagttaacgttacgtggtacggaccggaggacgtacggtaccgggacccaacggtaaccgtttaaccgacggtcgtaacggttcggacccgttacggggcccggggtaaccgaaaccgggtcccccg

SEQ ID NO: 381484 - DNA, 545 bp, Homo sapiens
  misc_feature: GZ8MTXP02JUYJO.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagcttgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagctgggtccgccaggcctccgaaggggaaggggctggagtgcgtcttcttttattatagtagtggtagtacatactcgcagctccgtggacggggccattcacatctccagacgacaattccaaagacacgtcttgtttactacaaatgaacagcctagacgagccgatcgacgacggccgttagtattacgtgtagcgagagaggtcgggacccaacgtaacgtaacacgctacgtggacgtcggtacgggaaccgg

SEQ ID NO: 381485 - DNA, 593 bp, Homo sapiens
  misc_feature: GZ8MTXP02GQOT3.13.76.G10.1.454.CMB.2.raw
  modified_base (443)..(443): a, c, t, g, unknown or other
  modified_base (463)..(463): a, c, t, g, unknown or other
  modified_base (468)..(468): a, c, t, g, unknown or other
  modified_base (485)..(485): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtctggaggaggcttgatccagccgtggggggtccctgagactctcctgtgcagcctctgggttcaccgtcagtcacacccacatgagcgtgggtcccgccaggcctaccgaggggaacggggcgtggagtggtcgtctttctttttatttatagttagtggtagtaccatactccgcgacgaccgtccggtggacggggcctattccgacctatctaccgagagaactaatacccaaagaaccncgtcttgtttactacaaatnaaacngcctagacgagccgtangaccacggtcgtattactacgtggtcgacgagagtacgtcgggggacccctaacgtaacgttactacgcgtagtacggtacgtcgtacggggaccaaagggtaccccg

SEQ ID NO: 381486 - DNA, 582 bp, Homo sapiens
  misc_feature: GZ8MTXP02I6D3N.13.76.G10.1.454.CMB.2.raw
  modified_base (244)..(244): a, c, t, g, unknown or other
  modified_base (260)..(260): a, c, t, g, unknown or other
  modified_base (269)..(269): a, c, t, g, unknown or other
  modified_base (306)..(306): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcgtggtttcgtgtaggctatttaaagtgccagtgtgaggtgcagctggtggagtctggaggaggcttgatccagccgtggggggtccctgagactctctgtgcncgctcgtggtcacgtnatcacacanatgagcgtcggccgcgaggcacggagggaggcgtggngtcgtcgttctttcttttattagtagttagtaggtagtacctactaccgtccgacacgtaccgttcggtgggacgggcctactccactactctacagactactaactaccaaagaacacgtcttacgtttactaacaaagtacgaacgacgacgtacgagacgacgacgacgacgacggtcgtacgtagtacgtgtcgacgagagacggtacggaccgaccgtaacgtacgtacgtaacgtacgtacggtacggtacggtacggacggaacggacg

SEQ ID NO: 381487 - DNA, 574 bp, Homo sapiens
  misc_feature: GZ8MTXP02FLSSW.13.76.G10.1.454.CMB.2.raw
  modified_base (238)..(238): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgccctcagtgtcgtggggccccagggcagagggtcaccatcctcctgcacgtgggancagctccaacattggggcacattatgatgtacactggtaccagctagtttccaggacgcgacggtcccagacctcctacatacaatacgtaacaacaatccggcccgcgacggggtccctgaccgtattcctctcgctccgtagtctcggccaccctcacgtccctcccgtcggtcactccacgtcggggacctccgacggctaggacggtagtggacgggtctaggtactttatttcgtcgccctagttccctatcgaacacgccgtacgccgtaggtaaggttcgtccgtttacggggttacggttccgggggaccgggggtaccctaaccggg

SEQ ID NO: 381488 - DNA, 705 bp, Homo sapiens
  misc_feature: GZ8MTXP02ITRUC.13.76.G10.1.454.CMB.2.raw
  modified_base (532)..(532): a, c, t, g, unknown or other
  modified_base (601)..(601): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtgggttcaccgtcagtcacacctacatgagcgtcgggtccaccgaggcctaccgggaaggggaacggggtcgtaggggagttcggaccgtttccttttactttttttaagtttagttaaggttaggttagggttaacgttaacccaattaaccgtcccggactaaaggtacccgttcccgggtggggacgggggtcctaactttccaacccgtatcctacccaagaacaactaaacttacccaaaggaaacctacgtctttacgttttacctaaaanaaactagaaacacgtcgtaggaagacgaccgtaagtacgaccggtacggtacgttaagttaacttacgngtacggacgaaggacggtacggtacccggggaacctaaacggtaaccgttaacgtacgtaacgtaggtacggtacggtcggacggggaaccgtaaacgggcccg

SEQ ID NO: 381489 - DNA, 580 bp, Homo sapiens
  misc_feature: GZ8MTXP02H11SZ.13.76.G10.1.454.CMB.2.raw
  modified_base (328)..(328): a, c, t, g, unknown or other
  modified_base (491)..(491): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtcctgagactctcctgtgcagcctcgtgggttcaccgtcagtcacacctacatgagcgtcggccgcgaggctccgaggggagggctggagtgcgtcttntttttattatagtagtgtatacatacctcgacagcctcgtgggacgggccgtattccaccatcctccagagacattaccaagaaactacgtcttgtttactacaaatcgaaactagcctagacgacgaccgatacgaccgaccggtaccgtggttaacttcgngtacggcgaaggagtacggccggggacccaacggtaaccgttacacgtcgtagtacggacggttcggacggggaccgaaacgggacccg

SEQ ID NO: 381490 - DNA, 684 bp, Homo sapiens
  misc_feature: GZ8MTXP02G4CK2.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctggattcacctttgatgattatgccatgcacgtgggtccggcaagctccgaggggacgggccgtgggaggtgggtctcgtaggtagtttagtaggtaatacggttaggtagcgtagtaggtactagtcggcgggtaactcgtggttagggaacggggccctaagttcccaacctacttcctaccgaaggacgaacgaacccgacaaacggaacctcccgtagtactctagactaaatagaacagccgtagaacggagacgtaggaacgggtaccgtaaccgggtaccgttttaggtttaactttacgttaggtttaacgaaacgtaaaaaaccgtaccgtttaaaccccctaaaacccccgttttaacgtttaacggttttttacgggggacgtttaacggggtttaaccggtttaaccggtaaacggggg

SEQ ID NO: 381491 - DNA, 600 bp, Homo sapiens
  misc_feature: GZ8MTXP02I0YBB.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgagggaaggggctggagtgcgtctcttttattatagtagtggtagtacatactcgacagactccgtggacggggcctagttccaccatctacccaagacgaactaaacttacccaaaagaaaccacggtcttgtttaccttacaaaattcgaaaacacgccctaggagacgacccgaatcggaaccgacgggcccgttagtatttacgtgtacgacggagaggagtccgggggacccaacggtaaacgttacacgcttaagtcgggacgttcggacggggaccaaacggggaaccccg

SEQ ID NO: 381492 - DNA, 600 bp, Homo sapiens
  misc_feature: GZ8MTXP02G1MHM.13.76.G10.1.454.CMB.2.raw
  modified_base (286)..(286): a, c, t, g, unknown or other
  modified_base (446)..(446): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtggttcaccgtcagtcacacctacatgngcgtggtccgggccaggcctcgaggggaaggggctggagtgcgttcttcttttattatagtagtggtagtacatactcgcagctcgtggacggggccattcacatcctcagagactaactaccaaagaaccacgtcttagttacttacaaaatcgaaacncgtcctaggacgagccgatcgaacgcgggtcccgttaggtaacttacgtggtcgacggtaacgaggtacggtaccgggggaccccaacggtaaaccggttaaccgtaacggtaccgtttaagcgggtaacggttccgggacgggggaaccccgg

SEQ ID NO: 381493 - DNA, 496 bp, Homo sapiens
  misc_feature: GZ8MTXP02IW1WF.13.76.G10.1.454.CMB.2.raw
  modified_base (234)..(234): a, c, t, g, unknown or other
tcagtcacgtactacacgaccggtgctcgatttagtcactcatacaggggaggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggancagctccaacattggggcacattatgatgtacactggtaccagcagtttccaggagcaggtccccagactcctcatcaatacgtaacaacaaatcggcccgcgacggggtccctgaccgattcctctggctccagtctggcacctcagcctccctggtcagtcactgggctccgaggctgaggatgaggctgattagtttctgcctacgtctactgacagcacgcctgaagtgcgttcggtagttcggcgggggacctacgg

SEQ ID NO: 381494 - DNA, 577 bp, Homo sapiens
  misc_feature: GZ8MTXP02G6VDJ.13.76.G10.1.454.CMB.2.raw
  modified_base (442)..(442): a, c, t, g, unknown or other
  modified_base (485)..(485): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtgggtccgccgaggctccgaggggaggggctggagtgcgtcttcttttattatagtagtggtagtacatactcgcagactcgtggacggggccagttccaccatctccagagacaaattccaaagaacacgtctgtttacttacaaatcgaaacngtacctagagcgaccgatgaccgacgggtccgtagtattacgngtcggacgagagacggtcgggaccctacggaacgtttacgaacgtcgttaacgtcgggtacgtcggtacggggacccgtaagggtaaccccg

SEQ ID NO: 381495 - DNA, 574 bp, Homo sapiens
  misc_feature: GZ8MTXP02FNC5N.13.76.G10.1.454.CMB.2.raw
  modified_base (396)..(396): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggttcaccgtcagtcacacctacatgagcgtgggtccgccgaggctccgaggggaggggctggagtgcgtctcttttattatagtagtggtataccatactcgcagactcggtgacggggctatcacctatctcaganacaatacaagaacacgcttgttactacaaatgaaacacgccgtagacgacgaccggaattacggacgacggtccgtagttaacttacgtgtgacgaggagacggtcgggggaccctaaccggtaacgttactacggctaggtcggtacggtcgtcgggggaccctaacggggaacccg

SEQ ID NO: 381496 - DNA, 599 bp, Homo sapiens
  misc_feature: GZ8MTXP02G7WMD.13.76.G10.1.454.CMB.2.raw
  modified_base (469)..(469): a, c, t, g, unknown or other
  modified_base (513)..(513): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggatttttggctgagctgggttttccttgttgctattttaaaaggtgcccagtgtgaggtgcagcgtggtggagtcgtgggaggaggcttgatccagccgtggggggtccctgagactctcctgtgcagcctcgtcgggttcaccgtcagtcacacctacatgagcgtcgggtccgccgaggcctccggaggggaacggggcgtggagtcgcgttctttcttttatttagtagttaggtggtagtacctatacctccgacacgaccgtccgtggacggggccattccaccatcaccagacacaataccgaaagaaccacgtcttgtttactaacaaatgaaacngcctagagacgaccgatcgaacgacggtccgtagttactagtgngacgaggagacggtcggggacccaacggtaacttacgacgaagttaacgcgggtaacgtcggacggggacccaaaggggtaccccg

SEQ ID NO: 381497 - DNA, 556 bp, Homo sapiens
  misc_feature: GZ8MTXP02FXLLK.13.76.G10.1.454.CMB.2.raw
  modified_base (426)..(426): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggtcaccggtcagtcacacctacatgagcgtgggtcccgccaggcctccgaggggaggggctggagtgcgtctcttttatttatagtagtggtagtaccatacctcgcagactccgtgacggggccattccacatctccagagacaatccaagacacgcttgtttctanaaatgaaacagcctagagacgccggatcggaccacgggtccgtgtacttacgtgtgacgtaggagacggtcggggacccaacgtaaccgtactacgctagtcggacgtcgtacggggaccaggggacccg

SEQ ID NO: 381498 - DNA, 631 bp, Homo sapiens
  misc_feature: GZ8MTXP02FGB9C.13.76.G10.1.454.CMB.2.raw
  modified_base (236)..(236): a, c, t, g, unknown or other
  modified_base (261)..(261): a, c, t, g, unknown or other
  modified_base (361)..(361): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactggggancagctccaacattggggcacattangatgtacatggtaccagctagtttccaggagcacggtcccagacctcctcatcaatacgtaacaacaatcggcccgcgacggggtccctgaccgattccnctggcctcgagtctggcacctcacgccctccctggtcctactccgaccttcggggccctccgacgggtcctacggagggtagtcggaacgggtccgttaggtaacttttaactttccgtcgggtaccccctaacggtttccccttaaagttacggaaaccgtacgggtaccctaacggcccccgtttacggaaggttccggttaccggttttccgggggttaaacggttttcccggggggaccccggggggggtaaccccctaacggggg

SEQ ID NO: 381499 - DNA, 659 bp, Homo sapiens
  misc_feature: GZ8MTXP02ID77J.13.76.G10.1.454.CMB.2.raw
  modified_base (270)..(270): a, c, t, g, unknown or other
  modified_base (297)..(297): a, c, t, g, unknown or other
  modified_base (366)..(366): a, c, t, g, unknown or other
  modified_base (466)..(466): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtccctgagactctcctgtgcagcctcgtgggttcaccgtcngtcacacctacatgagcgtcgggtccnccgaggcctccgaggggaggggctggagtgcggtcttcttttattatagtagtggtatacatactccgnagactccgtggacggggctacttcgaccatctccgagtacgaactaaattccaaaagaactacgtctttacggtttacctacctaaaagttcgaaaaccncggtaccccgtaggaacgacgtaccccgggtataccggaccgtacgggtccgttgttaacttacgtgttacggaccggagtaacgggacgttccgggggaacccctaacggtaaaccgttttaccgaacggtaacccgttaggacggtaccggttacgggtaccgggggaaccgtaaacgggggtaacccccg

SEQ ID NO: 381500 - DNA, 670 bp, Homo sapiens
  misc_feature: GZ8MTXP02H3NIK.13.76.G10.1.454.CMB.2.raw
  modified_base (250)..(250): a, c, t, g, unknown or other
  modified_base (443)..(443): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtccctgagactctcctgtgcngcctcgtgggttcaccgtcagtcacacctacatgagcgtcgggtccgccgaggcctccggaggggaacggggctaggagtcgtcgttctttctttttatttagtagttagtggtacgtacctatacctccgacagtacccgtccggtggggacggggtcccgtagtttcccaacctatcctacccaaaggtanaacctaaacttacccgaaagtaaacccgaccgtctttagttttacctaacaaaagtcggaaaaccacgccctagggacgaacgcccgaagtcggaaccgtaccgggtaccgttaggttaatttacgtgggtcgtacggaggtagacggttaccgggggacccctaacggtaaaaccgtttcgtaacgcgttaagcggacggtcggtaccggggaccaacggggaccc

SEQ ID NO: 381501 - DNA, 589 bp, Homo sapiens
  misc_feature: GZ8MTXP02F933Y.13.76.G10.1.454.CMB.2.raw
  modified_base (268)..(268): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtnagtcacacctacatgagctggggtcccgccgaggcctccgaggggaaggggctggagtgcgtctcttttatttatagtagtggtagtacatactcgacagacctcgtgacggggcattcaccatcctccagagacaatccaaagaacacgcttgtttactacaaatgaaactgcctagagacgccgatacgacacggccgtgtattacgtgtcgacggtagagacgtacgggggacccctaacggtaaaccgttacgtaccgtaacgttacgtacggggtaaccgtcggtacgggggtacccgaaacggggtaaaccccgg

SEQ ID NO: 381502 - DNA, 554 bp, Homo sapiens
  misc_feature: GZ8MTXP02GMKYF.13.76.G10.1.454.CMB.2.raw
  modified_base (430)..(430): a, c, t, g, unknown or other
  modified_base (441)..(441): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtggggttcaccgtcagtcacacctacatgagcgtgggtcccgccgaggcctccgaggggaaggggctggagtgcgtcttcttttatttatagtagtggtatacatactcgcagactcgtggacgggcgatcaccatctcagagacaagttccaaagaacacgcttgtttactanaaagtgaaacngacctgagacgaccgatcgacgacggtcgtagtattacgtgtacgcgagagcgtacggggacccacgtaacgtacacgcgtacgtcggacgtcggacgggacgaacggacccg

SEQ ID NO: 381503 - DNA, 527 bp, Homo sapiens
  misc_feature: GZ8MTXP02GKGJN.13.76.G10.1.454.CMB.2.raw
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctcaggaaataattggacagataaatatacttctggtatcagcagaagtcaggccagtcccctgtgctggtcatctatcaagatgaccaagccgcctcgaggtactcccccgtgacgcgattctctcggcctaccaactcgtagggaacctcgacgcccactctacgaccatcgacggaccggacccaggctagcggtatggacgcttgaacttagttacctgtcgagggtcggtcgggacagcaggccacgcgcccgtctatcgtcgttacggaacgtggaaccgtaaggtccaccggtacacgtcacgaacccg

SEQ ID NO: 381504 - DNA, 653 bp, Homo sapiens
  misc_feature: GZ8MTXP02I6XBU.13.76.G10.1.454.CMB.2.raw
  modified_base (235)..(235): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataatggcagataaatntacttcctggtatcagcagaagtcaggccagtcccctgtgctggtcatctatcaagatgaccaagcggccctgaggggactcccccgtagacgcgtacttctcgtggcctaccaactcgtacggggaaccttcgacgcccacgtctagacccatcgacgaccgggaccccaggccttaagtggattcgggaaggtctaggtaacttacgtttacgtaggttacccgaaggggtccggtcggggaaacacgggacaaacggcccgttaaacgtccggaccccgtacgttaaacgttccggttaccgtttaacccggggaaacgtttaccgggggaaaaccccgttaaacgggggttacccctaaaaccccggttaccccggttaaaaacggttccccgaaccggtaaaacccccccggg

SEQ ID NO: 381505 - DNA, 562 bp, Homo sapiens
  misc_feature: GZ8MTXP02FVJN1.13.76.G10.1.454.CMB.2.raw
  modified_base (294)..(294): a, c, t, g, unknown or other
  modified_base (441)..(441): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggtcaccgtcagtcacacctacatgagctgggtcccnccaggctccgaggggaggggctggagtgcgtcttcttttatttatagtagtggtagtaccatactccgcagactccgtgaggggccattccaccatctccagagacaattccaaagaacacgcttagtttcttacaaaatcgaaacngcctagagagccgatgacgacggccgttgtacttacgtgtgacgagagacggtcggggacccaacgtaaaccgttactacgcttaagcggacgtcgtacgggggacccaagggggaacccc

SEQ ID NO: 381506 - DNA, 539 bp, Homo sapiens
  misc_feature: GZ8MTXP02G483F.13.76.G10.1.454.CMB.2.raw
  modified_base (504)..(504): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggggttcaccgtcagtcacacctacatgagctgggtccgccaggctccgagggaaggggctggagtgcgtcttcttttattatagtagtggtagtaccatactccgcagactcgtggagggccgattcaccatctccagagacaatccaagaacacgctgttcttacaaaatgaaacagcctagagagccgatcgacacggcctgtattacgtgtgacgagagcgtcgggacccacgaaacgttcacgngtactcggacgtcgtacggggaccaaggggacccg

SEQ ID NO: 381507 - DNA, 575 bp, Homo sapiens
  misc_feature: GZ8MTXP02FK2M7.13.76.G10.1.454.CMB.2.raw
  modified_base (449)..(449): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggtcaccgtcagtcacacctacatgagcgtgggtccgccaggcctccgaggggaaggggctggagtgcgtcttcttttatttatagtagtggtagtacatactcgcagacctcgtggaggggccgattccacctatcctccagagaacaacttaccaaagaacacgtcttagtttcttacaaatcgaaacncgcctagagacgaccgatcgacacggccgtagtattactgtagcgaggtagagtaccgggggacccaacgtaacgttacctacgcgtaagtcggaccggtcgtacgggggacccaaggggaccccg

SEQ ID NO: 381508 - DNA, 647 bp, Homo sapiens
  misc_feature: GZ8MTXP02GAV8B.13.76.G10.1.454.CMB.2.raw
  modified_base (478)..(478): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtggggggtccctgagactctcctgtgcagcctcgtgggtcaccgtcagtcacacctacatgagcgtcgggtcccgccgacggcctccggaggggaaggggcgtggagtgcgtcttctttattatagtagtggtagtaccatacctccgcagacctcgtgggacggggccgtattccgacctactcctacccgaagacgaaacctaaagttacccaaaaggaacctacgcctttgtttacctacaaaatgaaaccngccgtagacgagcccgtaatcggaaccacgggtcccgttagttattacgtgtacgacggtaggagacggtccggggacccctaaacggtaaacccgttacgaaccggtccttaaggttaccggggacccttcggggtaccgggggaacccgaaacggggtaacccccgg

SEQ ID NO: 381509 - DNA, 632 bp, Homo sapiens
  misc_feature: GZ8MTXP02GION8.13.76.G10.1.454.CMB.2.raw
  modified_base (234)..(234): a, c, t, g, unknown or other
  modified_base (248)..(248): a, c, t, g, unknown or other
  modified_base (278)..(278): a, c, t, g, unknown or other
  modified_base (314)..(314): a, c, t, g, unknown or other
  modified_base (328)..(328): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagtttttggctgagcgtggtttcgtgtaggctatttaaaaggtgccagtgtgaggtgcagctggtggagtctggagaggcttgatccagcctggggggtccctgganactctcctgtgccncgctcgtcggtcgcgtcacgcacaccacangagcgtcggccgccgacgcgcggagggaggcgtggngtcgtcgttctttntttatttagttagtagtaggtagtactatactcgacgacgtacgtcggtcggacgggacgtactacacctactactacgacgaacgaactaactaacgaaacgaacgacgtacgttacgtttacttaactaaacgtaacgaacacgacgtagacgacgacgacgtacgaccgaccggtaccgtacgttacgttacgtacgtacgacggaggacggtacggtaccgggaacccggtaaccgtaaccgttaaccgtacgtaacgtacgtacggtacggtacggtacgggaccggaaccggaaccgg

SEQ ID NO: 381510 - DNA, 580 bp, Homo sapiens
  misc_feature: GZ8MTXP02HLVLZ.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggttcaccgtcagtcacacctacatgagctgggtccgccaggctccgaggggaaggggctggagtgcgtcttcttttatttatagtagtggtagtaccatactccgcagacctcgtggacgggggccattccaccatcctccagagacaattcccaaagaaccacgcttgtttactacaaatgaaacagtcctgaagacgccggatgaaccgacggtccgtagtattacgtgtgcgagaggacgtcgggggaccccaacgtaaccggttacacggtaacctagtacgggtaacgtcggtcgggggacccaaagggggaccccg

SEQ ID NO: 381511 - DNA, 560 bp, Homo sapiens
  misc_feature: GZ8MTXP02HVD0N.13.76.G10.1.454.CMB.2.raw
  modified_base (355)..(355): a, c, t, g, unknown or other
  modified_base (384)..(384): a, c, t, g, unknown or other
  modified_base (423)..(423): a, c, t, g, unknown or other
  modified_base (431)..(431): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcgtgggttttccgttgttaggctattttaaaaggtgcccagtgtgaggtgcagctggtggagtctggaggaggcttgatccagccgtggggggtccctgagactctcctgtgcagcctctgggttcaccgtcagtcacacctacatgagctgggtccgccaggctccgaggggaggggctggagtgcgtcttcttttattatagtagtgtagtacntactcgcagactcgtgaggggcattcacntctccagagacaattccaagactacgcttgtttcctaanaatgaacngctagagcgacgatcgacgacggtcgtagtacttacgtgtcgacgagaggacggtacgggacccgtaccgtaaccgtaaccgtacgtaacgtacgtacggtacggtcggtacgggaccggaacggaccg

SEQ ID NO: 381512 - DNA, 576 bp, Homo sapiens
  misc_feature: GZ8MTXP02IF0X6.13.76.G10.1.454.CMB.2.raw
  modified_base (440)..(440): a, c, t, g, unknown or other
  modified_base (485)..(485): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagcgtgggtccgccaggctccgaggggaaggggctggagtgcgtcttcttttattatagtagtggtagtaccatactcgcagactccgtggaggggccattccaccatcctccagagacaatccaaagaacacgcttgtttacttacgaaatgaaacncgcctggagagcccgatcgaaccacgggtccttggtaatttacgnggtcgacgaaggagacggtccgggggaccctaacggaaaccgtttcaacgctagtacgggaccttcggacgggggaccaagggggaccccg

SEQ ID NO: 381513 - DNA, 575 bp, Homo sapiens
  misc_feature: GZ8MTXP02IEWI3.13.76.G10.1.454.CMB.2.raw
  modified_base (447)..(447): a, c, t, g, unknown or other
  modified_base (456)..(456): a, c, t, g, unknown or other
  modified_base (483)..(483): a, c, t, g, unknown or other
  modified_base (493)..(493): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtctggaggaggcttgatccagccgtggggggtccctgagactctcctgtgcagcctcgtgggttcaccgtcagtcacacctacatgagcgtgggtccgccgaggcctccgaggggaaggggctggagtgcgtcttcttttattatagtagtggtagtaccatactcgcagactccgtgagggggccattccacctatcctccagtagactaattccaaagaaccacgtcttgtttactacaaatgaaacngcctgaagngccgatcgacacggccgtgtattacgngtagcgaagnggacgtcggggaccctaacggtaacgttaccgacgtcgtaagtacgggaccgtcggtacggggacccgaaacggggaccccg

SEQ ID NO: 381514 - DNA, 592 bp, Homo sapiens
  misc_feature: GZ8MTXP02HX6PJ.13.76.G10.1.454.CMB.2.raw
  modified_base (454)..(454): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtccctgagactctcctgtgcagcctctgggttcaccgtcagtcacacctacatgagcgtcgggtcccgccgaggcctccgaggggaaggggcgtggagtgcgtcttctttttatttatagtagtggtagtaccatacctccgcagacctcgtgggacggggccgtattccaccatctccagagactaattaccaaagaactacgcttgtttctacaaatgaaacncgcctagagagcccgatcgacgacgggtccgtagttattacgtgtagcgaggagaacggtcgggggaccctacggtaaacgttcctaacggcgtaacggtcgggaccggtcggtacgggggaccgaacggggaccccg

SEQ ID NO: 381515 - DNA, 537 bp, Homo sapiens
  misc_feature: GZ8MTXP02IDU6L.13.76.G10.1.454.CMB.2.raw
  modified_base (337)..(337): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggtcacgtcagtcacacctacatgagctgggtccgccagggctccgagggaaggggctggagtgcgtctctttatttanagtagtgtagtacatactcgcagctccgtgacgggggccattcacatctccagagacaattccaaagaaacacgctagtttcttacaaaacttgaaacagtcctagacgagccgatagacacggccgtagattactgtgcgagagatcggggccaacgaacgttaacacggtactagtcggacgtcgtacgggggaaccg

SEQ ID NO: 381516 - DNA, 531 bp, Homo sapiens
  misc_feature: GZ8MTXP02FS2SO.13.76.G10.1.454.CMB.2.raw
  modified_base (356)..(356): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataaattggaagataaatatacttctggtatcagcagaagtcaggccagtcccctgtgctggtcatctataggataataaccggccctctgggactcccgtgaccgtattccctctcggctaccaacgtcggggaacnccggccaccctgacccatcaaacagacgacccaaaggacggggatggagctgactattatagctaggtgtgggacagacaccgaggtgatacgtcggcggacgggacacggctacgaccgtcctaggtacacggacccaaggcctcgccccgtcggtcacgtctctcccacctcc

SEQ ID NO: 381517 - DNA, 680 bp, Homo sapiens
  misc_feature: GZ8MTXP02GOCHL.13.76.G10.1.454.CMB.2.raw
  modified_base (499)..(499): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacagtgagcgtggggtccccgccgaggcctccggaggggaacggggtcgtgggagtcggtcggttcctttacgtttttattttagtagttaggtggttagtaaccagtactactgacagacctccggtaggacggggccgtattccgactactcctaccgaggtacactaaactcccaaagtacaccggtctttaggtttacctacgaaattcggaaaccngtacccgttggaacgacggaccctagtcggaacctacgggtccttaagttacttacgtggtacgcggaatacggacggttaccggggaccccttaaacgggaaacccgttttacggaaaccgtcgttaaagtccgggggtaccgtttacgggacccgggggaaaccggttaaaccccgggg

SEQ ID NO: 381518 - DNA, 642 bp, Homo sapiens
  misc_feature: GZ8MTXP02G2CKF.13.76.G10.1.454.CMB.2.raw
  modified_base (461)..(461): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtcgtgggaggaggcttgatccagccgtggggggtccctgagactctcctgtgcagcctcgtgggtccaccgtcagtccacacctacatgagcgtcgggtcccgccaggcctccggaggggaaggggcgtggagtggcgttcttcttttatttatagtagtggtagtaccatactcgcagactcggtggacggggcctattccaccatcctaccagagaactaattaccaaagaacacgtcttgtttacctacaaaatcgaaacngacctagagacgccgaagtcgaaccgacgggtcccgttaggttaacttacgtggtacggaccggaaggacgtaacggtccgggggaaccccctaacgggtaaaaccgttaaccgtaacgtaacgtaacggttacggggaaccggtttcggaccgggggacccgaaaacgggggacccccgg

SEQ ID NO: 381519 - DNA, 674 bp, Homo sapiens
  misc_feature: GZ8MTXP02G44IH.13.76.G10.1.454.CMB.2.raw
  modified_base (282)..(282): a, c, t, g, unknown or other
  modified_base (422)..(422): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcgtggttttccttgttgctatttaaaaggtgcccagtgtgaggtgcagctggtggagtttggaggaggcttgatccagccgtgggggtccctgagactctcctgtgcagcctctgggttcaccgtcagtcacacctacatgngcgtcgggtccgccgaggcctaccgaggggaaggggctagggagtcgcgttcgtttacttttatttagtagttagtggtaagtacataccgtccgacacgtcgttccggtgggacgggggtccctaagttcccaaacccnttccgtacccaaggaacgtaacctaaacgttacccaaaggaacctaaccggtctttaccgtttccttaactaaaagttacgaaaacgtacgacccttaggaacgacgcccgagtacgaccgtaccgggtcgtagttacttaccgtgggtagcgaacggagtacggtaccgggaccctaaaggtacccgttaacgaccgtacgtaacgtcggtaaccggtcggtaccggggaccgaacgggaccccgtaccgg

SEQ ID NO: 381520 - DNA, 634 bp, Homo sapiens
  misc_feature: GZ8MTXP02GY9GI.13.76.G10.1.454.CMB.2.raw
  modified_base (468)..(468): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtgggtcccgccgaggcctccgaggggacggggctgggagtgcgttcttctttttattagtagtagtggtagtaccatactccgcagacctccggtggacggggccattccacctatcctacccaagacgaacctaattacccaaaggaacctacgtcttgtttactaacaaagtgaaacngcctagagacgccgatcgaccgacgggtccgtagtacttacgtggtacgacggaaggaggtacggtaccgggggacccctaaacgggtaaaccgtttaaccgtaaccggtcttaaacggtcggggtaaccgttcggtacgggggaaccctaaacgggggaaccccc

SEQ ID NO: 381521 - DNA, 600 bp, Homo sapiens
  misc_feature: GZ8MTXP02I5SWB.13.76.G10.1.454.CMB.2.raw
  modified_base (372)..(372): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggttgagctgggttttccttgttgctattttaaaggtgcccagtgtgaggtgcagctggtggagtctggaggaggcttgatccagccgtgggggtccctgagactctcctgtgcagcctcgtgggttcaccgtcagtcacacctacatgagctcgggtccgccaggcctccgaggggaagggctggagtgcgtcttcttttattatagtagtggtagtacatactccgcagactccggngacgggggcctattccacctatcctaccgagacgaactaacttacccaaagaaccacgtcttacgttttactactaaaatacgaactacggaccttaggacgacgacccgtatacgaaccgacggtccgttagtacttacgtgtaggacgagagagtcggggacccaacggtaaccgttacgtacgctaagtcggacgtcggtacggggacccaagggaccctaccgg

SEQ ID NO: 381522 - DNA, 555 bp, Homo sapiens
  misc_feature: GZ8MTXP02IO9EG.13.76.G10.1.454.CMB.2.raw
  modified_base (371)..(371): a, c, t, g, unknown or other
  modified_base (464)..(464): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgccaggcctccgaggggaaggggctggagtgcgtcttcttttattatagtagtggtagtacatactccgcagactccgnggacggggccattcaccatctccagagacaattccaaagaacacgcttgttctacaaatgaaacagcctagagagccgatcgacacggccgtntattactgtgcgagagacgtacggggacccaacgtaaaccgttacaaccgcgtagtcggacgttcggacggggaccgaaacgggaaccccg

SEQ ID NO: 381523 - DNA, 561 bp, Homo sapiens
  misc_feature: GZ8MTXP02JFRC6.13.76.G10.1.454.CMB.2.raw
  modified_base (356)..(356): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggtcaccgtcagtcacacctacatgagctggtccgccaggctccgagggaagggctggagtggggttcggtattagtgctcttgatgatgcacatactagngcagacgtacgtacgctctcacatcacagacactaactaccaagaacacgtactatacgtcgacgacagtaatacgaacgacgaccggtacgggacggaccggacggaccggaccggtaccgttacgtacgtacgtagtacgaacgaaacgtaagttaagttaagtaagtaagtagtacggtacgtacgtacgtactacttaacg

SEQ ID NO: 381524 - DNA, 576 bp, Homo sapiens
  misc_feature: GZ8MTXP02FQT22.13.76.G10.1.454.CMB.2.raw
  modified_base (359)..(359): a, c, t, g, unknown or other
  modified_base (391)..(391): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctcgtgggttcaccgtcagtcacacctacatgagctgggtccgccaggctccgaggggagggctggagtgcgtcttctttattatagtagtggtatacatactcgnagctccgtgaggggccattcacatctccaganacattccaagacacgtcttgtttacctacaaatcgaaacagtcctagacggacgacccgatcggacgtacgggccgttagtacttacgtggtacggcgtaaggacgacgttcgggggaaccccctaaggtaaacccgtttaacgaccggtacttaaggtcgggacgtcggtagggggaaaccccg

SEQ ID NO: 381525 - DNA, 652 bp, Homo sapiens
  misc_feature: GZ8MTXP02JRNL0.13.76.G10.1.454.CMB.2.raw
  modified_base (489)..(489): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctcgtgggttcaccgtcagtcacacctacatgagcgtcgggtcccgccgaggcctaccggaaggggaaggggccgtgggaggtggtccggttctttctttttaagtttagtaagttacgtggtagtaccctatacctccgacagacctcggtcgggacggggccgtacttccacctatcccgtaccgagtacgaaactaacttaccgaaagtaaccacgtcttcgtttacctaaanaacgtacgaactacgtactaggacgacgaccgtagtcgaaccgtacgggtcgttagttacgttacgtggcggacggaggacggtacggtaccgggaacccgtaacgtaaccgttacgacgtcgtacggtacgggtacggtcggaccgggaccggaacggaccg

SEQ ID NO: 381526 - DNA, 630 bp, Homo sapiens
  misc_feature: GZ8MTXP02JXPCR.13.76.G10.1.454.CMB.2.raw
  modified_base (463)..(463): a, c, t, g, unknown or other
  modified_base (494)..(494): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcgtggtttccttgttgctatttaaaaggtgccagtgtgaggtgcagctggtggagtcgtgggaggaggcttgatccagccgtgggggtccctgagactctcctgtgcagcctcgtggttcaccgtcagtccacacctacatgagtcgtcgggtccgccgacggcctaccggaggggaacggggcgtgggagtggtccgtttcgtttactttttaattagtaagttaggtaggtacgtaaccatacctccgacacgtaccgtcggtgggacggggcctattccacctctcctccaagacgaaactaacttaccgaaagtaaccncgtcttacgtttactaacaaattacgaaacncgcctaggacgacgccgaatcgaccgtacggtcgttagtacttcgtgacgcggaaggacggacggtccggggaccctaacggtaccgttacgacgtcgtaggtcggacgttcggaccggggaccgaaacgggcccg

SEQ ID NO: 381527 - DNA, 576 bp, Homo sapiens
  misc_feature: GZ8MTXP02GKLSE.13.76.G10.1.454.CMB.2.raw
  modified_base (435)..(435): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctctgggtcaccgtcagtcacacctacatgagcgtgggtccgccaggctccgagggaggggctggagtgcgtctcttttattatagtgtggtagtaccatactcgcagacctccggtggacggggccgattccacccatcctaccagagacaacttaccaaagaacacgcttgtttacttanaaaatgaaactagacctagacgagcccgaatcgaccacggccgtagtattacgtgtcgcgaagagacgtcgggggaccctacggaaaccggtttacaacgtcgtaacgtgggtacgtcgtcggggaccgaacggggacccg

SEQ ID NO: 381528 - DNA, 551 bp, Homo sapiens
  misc_feature: GZ8MTXP02GPB9Z.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggggttcaccgtcagtcacacctacatgagctgggtccgccaggctccgagggaggggctggagtgcgtctctttttattatagtagtggtagtaccatactccgcagactccgtggaggggccattcaccatctccagagacaattaccaagaacacgcttgtttctacaaatgaacagcctgagagccgatcgacacggccgtagtacttactgtcgcggagagacgtcgggggaccccaacgtaacgttactaccgcttagtcgggacgtcgtcgggggaccaaggggacccg

SEQ ID NO: 381529 - DNA, 561 bp, Homo sapiens
  misc_feature: GZ8MTXP02I4PZC.13.76.G10.1.454.CMB.2.raw
  modified_base (296)..(296): a, c, t, g, unknown or other
  modified_base (370)..(370): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggtttcctgttgctatttaaaaggtgccagtgtgaggtgcagctggtggagtcgtggaggaggcttgatccagccgtgggggtccctgagactctcctgtgcagcctcgtgggttccaccgtcagtcacacctacatgagcgtcgggtccnccgaggctccggaaggggaacggggctgggagtgtcgtcttcttttattatagtagtggtagtacatactccgnagtcgtccgtggacgggggcctattccacctatcctccaagacgaacaattcccaaagaccaacgtctgttactacaaatgaaacagcctagagagcccgagtgaccgtacggccgtagtacttactgtgcgagagacgtcggggacccacgtaacgttaacgacgcgtagtcggacgtcgacgggaaccg

SEQ ID NO: 381530 - DNA, 538 bp, Homo sapiens
  misc_feature: GZ8MTXP02HZ1PB.13.76.G10.1.454.CMB.2.raw
  modified_base (297)..(297): a, c, t, g, unknown or other
  modified_base (307)..(308): a, c, t, g, unknown or other
  modified_base (310)..(310): a, c, t, g, unknown or other
  modified_base (312)..(312): a, c, t, g, unknown or other
  modified_base (314)..(314): a, c, t, g, unknown or other
  modified_base (316)..(316): a, c, t, g, unknown or other
  modified_base (318)..(318): a, c, t, g, unknown or other
  modified_base (321)..(321): a, c, t, g, unknown or other
  modified_base (325)..(325): a, c, t, g, unknown or other
  modified_base (332)..(332): a, c, t, g, unknown or other
  modified_base (339)..(339): a, c, t, g, unknown or other
  modified_base (341)..(342): a, c, t, g, unknown or other
  modified_base (347)..(347): a, c, t, g, unknown or other
  modified_base (349)..(349): a, c, t, g, unknown or other
  modified_base (361)..(361): a, c, t, g, unknown or other
  modified_base (365)..(365): a, c, t, g, unknown or other
  modified_base (370)..(370): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttcttgttgctattttaaaaggtgccagtgtgaggtgcagctggtggagtctggaggaggcttgatccagccgtggggggtcctgagactctcctgtgcagcctctgggttcaccgtcagtcacacctacatgagcgtggtccgcaggcncgaggacggnngngngntntnttntatntgtgtancatctcncnnctcgngnggcgtactcacnctcncaganacactacaacgacactacttcttactactaactacgacgacgactagagacgacgacgacgacgacggtacgtacgtagtacgtgtgacgagagacggacggaccgtaaccgtaacgtaacgtacgtaacgtacgtacggtacggtacggtacgggacggaacggacg

SEQ ID NO: 381531 - DNA, 744 bp, Homo sapiens
  misc_feature: GZ8MTXP02F6XMJ.13.76.G10.1.454.CMB.2.raw
  modified_base (268)..(268): a, c, t, g, unknown or other
  modified_base (303)..(303): a, c, t, g, unknown or other
  modified_base (325)..(325): a, c, t, g, unknown or other
  modified_base (553)..(553): a, c, t, g, unknown or other
  modified_base (566)..(566): a, c, t, g, unknown or other
tcagtcacgtactacacgaccggtgctcgatttagtcactcatacgagggggggagaggagcccagcactgggattccgaggtgtttccattcggtgatcagcactgaacacagaggactcaccatggtagttttggctgagcgttgggttttccttgttgcttaattttaaaaggtgccagtgtgaggtgcagcgtggtggagtcgtgggaggaggtcttgactccgacggtccggtcgggggtccctgacgtctcctcctgtcgcncgtcctcgtcggtccaccgtcacgtcaccacctanagtgacgcgtcggtcccgacgnggcctacgggaaggggacgggtcgtagggtacgttcggtaccgtttcctttagtttttagtttaagtaaggttaggttaggttaacgtacccgtattacccgtcgaacgtacgtacccgtcggtcgggggaccgggcctacttacccaacctacgttacccaccgaaaagtacctaaacctaaacttaacccggaaaataacccgtctcgttttaatttacccaaaanaagtacgaaaccncggtacgtaacgacgcgtaaccgtaagtaccgaccggttacggtattaagttacgtagcggacggaaacggtacggacggttacccgggaccggaacccttaaacgttaacgtccgtacgtaacggttaacggtacgggtaccggtacggggtaacgggaacccgtaaaccggtcccg

SEQ ID NO: 381532 - DNA, 598 bp, Homo sapiens
  misc_feature: GZ8MTXP02HBD79.13.76.G10.1.454.CMB.2.raw
  modified_base (232)..(232): a, c, t, g, unknown or other
  modified_base (372)..(372): a, c, t, g, unknown or other
  modified_base (436)..(436): a, c, t, g, unknown or other
  modified_base (556)..(556): a, c, t, g, unknown or other
tcagtcacgtactacacgaccggtgctcgatttagtcactcatacagggggggagaggagcccagcactgggattccgaggtgtttccattcggtgatcagcactgaacacagaggactaaccatggagttttggctgagctgggttttccttgttgctatttaaaggtgccagtgtgaggtgcagctgggtggagtcgtggaggaggcttgatccagccgtgggggtcccngagactctcctgtgcagcctcgtgggtccaccgtcagtcacacctacatgagcgtcgggtcccgcaggcctccgaagggggaaggggcgtgggaggtggccgttctttcttttatttataggtagtggtagtacactacnccgcagactcggtgcggggcctatccactactctaccaggaacactaaacttaccaaagaaccncgtcttagtttactaacaaatcgaaacagcctaggaacgagacccgagtacgaacgccgggtactagtaacttcgagtcggacgaggtagcggtacgggacccctaagtaacgtcgtacncgtaagtcggacgttcggacggggaccaacgggcctaaccgg

SEQ ID NO: 381533 - DNA, 618 bp, Homo sapiens
  misc_feature: GZ8MTXP02GCQK3.13.76.G10.1.454.CMB.2.raw
  modified_base (363)..(363): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcgtgggttttcttgttgctatttaaaaggtgccagtgtgaggtgcagctggtggagtctggaggaggcttgatccagcctggggggtccctgagactctcctgtgcaacctctggattcagtatttgatgagtatggcatacactggtccgccaacctccgagggaggggctgcaggtggtctcgtggtaataaactggaaatggtcgccagcaactaacttangcagactcgtagaggaacggtcctattaccacctatccacgaagacgacgacggtacgacccgtaaacgtaaccctccgtaacacttacgtacgaaactaaaagtacgaaaccgtacgttaccggtacggggaacggtacggaacggtaccgtaccggttccgtttacgttactttcggtaggtacggtacggtacggttacggcgtagggtcggtacgttacggttaccttacggacgtaacggtacggtacgg

SEQ ID NO: 381534 - DNA, 587 bp, Homo sapiens
  misc_feature: GZ8MTXP02F64HW.13.76.G10.1.454.CMB.2.raw
  modified_base (538)..(538): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagctgggtccgccaggctccgaggggaaggggctggagtgcgtctcttttattatagtagtggtagtacatactcgcagactcgtgacggggcctattccacctatcctccaagagaccaattaccaaagaacacgcttagtttacttacaaaagtcgaaacacgccttaggaacgacgcccgaagtacgaccgacgggccgttagtacttacgtgtcgacgagtaggacgtcggggacccacgtaacccgttanaccgtaacgtagtcgggaccgtcgacggggacccgaaaggggtaacccg

SEQ ID NO: 381535 - DNA, 530 bp, Homo sapiens
  misc_feature: GZ8MTXP02HFI1Q.13.76.G10.1.454.CMB.2.raw
  modified_base (328)..(328): a, c, t, g, unknown or other
  modified_base (388)..(388): a, c, t, g, unknown or other
  modified_base (417)..(417): a, c, t, g, unknown or other
  modified_base (420)..(421): a, c, t, g, unknown or other
  modified_base (423)..(423): a, c, t, g, unknown or other
  modified_base (425)..(425): a, c, t, g, unknown or other
  modified_base (427)..(427): a, c, t, g, unknown or other
  modified_base (436)..(436): a, c, t, g, unknown or other
  modified_base (458)..(458): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagatggtggagtctggaggaggcttgatccagccgtggggggtccctgagactctcctgtgcagcctctgggttcaccgtcagtcacacctacatgagcgtcggtccgccaggctccgaggggaaggggctggagtgcgtnttcttttattatagtagtggtagtaccatactcgcagactcgtgagggccattcacatcncagagacatccaagaacagctgttctaanaannanancnagagacganagacgacgcgtagtatacgtgngacgagagacgacggaccgacgtaacgtacgtacgtaacgtagtacgtacgtacgtacggacggaacggacg

SEQ ID NO: 381536 - DNA, 540 bp, Homo sapiens
  misc_feature: GZ8MTXP02J09HF.13.76.G10.1.454.CMB.2.raw
  modified_base (434)..(434): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggggttcaccgtcagtcacacctacatgagctgggtccgccaggctccgagggaaggggctggagtgcgtctcttttattatagtagtggtagtaccatactccgcagactccgtgacgggggccatcaccatctccagagacaattaccaagaacacgcttgttctacaaatgaaacngcctgagagccgatcgacacggccgtgtacttacgtgtgcgagagacgtcggggacccacgaacgttacacgctagcggacgtcgtcggggaccaacggggacccg

SEQ ID NO: 381537 - DNA, 772 bp, Homo sapiens
  misc_feature: GZ8MTXP02GBF49.13.76.G10.1.454.CMB.2.raw
  modified_base (252)..(252): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttattttaaaaggtgcccagtgtgaggtgcagctggtggagtcgtgggaggaggcttgatccagccgtgggggtccctgagactctctgtgcngcctcgtggtcaccgtcagtcacacctacatgagcgtcgggtcccgccgacggcctaccggaaggggaacggggcgtgggacgtcggtccgtttctttacgtttttaagtttagttaggttaggttaggttaacgtacctacgttacccgtccgacaacgtaccgttccgggtggggacgggggtcccgtaactttcccgaacctacttcctacccgaaagaacgtaaacctaaacgttaacccaaaaggtaaaccctaccggtccttttacgttttaaccttaaacgaaaacgttacgaaaaccgtacggtaccccgttaagggaaacggtacccggacccggtaagtaaccggaaacccggtaccggggttaccgtttaggttaactttaccggtagggtcgaacgggtaagacggtaaccggtaccgggggaacccctaaacgggtaaaccgtttaccgtacgtaacgttacggtacggacggttccggacgggggaacccaaacgggggtaccccg

SEQ ID NO: 381538 - DNA, 649 bp, Homo sapiens
  misc_feature: GZ8MTXP02IXRH9.13.76.G10.1.454.CMB.2.raw
  modified_base (297)..(297): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtgggtcccnccgaggcctccggaggggaaggggctgggagtcgcgttcttcttttattatagtagtggtataccatacctcacagactcgtgggacggggcctaattccacctatcctcccgaaaggactaacctaaacttaccgaaacgtaacccacgtccttagttttaccttacaaaatcgaaaaccacgtaccaggaacgacgaccgaagtaccgaccgtaccggtcgttagttacgttacgtggtacgacggaggacggtacgggtacccgggaaccctaaacggtaaccgtacgtaccggtaacgtacggtacgggtaccggtacggtaccgggggaacccgaaacggggtcccg

SEQ ID NO: 381539 - DNA, 623 bp, Homo sapiens
  misc_feature: GZ8MTXP02FZPJX.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagctgggtcccgccaggctccgaggggaggggctggagtgcgtctcttttattatagtagtggtagtaccatacctcgcagacctccggtggaggggccattccaccatcctccaagagaacaattaccaaagaaccacgcttagttttaccttacaaaattcgaaaacacgaccctaggaagacggcccgaatcggaccgaccgggccgttagtacttacgtggtacgcggagaggacggtacgggggaccccctaaacgggtaaaccgttaccgtaaccggcgttaacgtacggggtaccggttcggtacgggggacccaaacgggggtaacccccg

SEQ ID NO: 381540 - DNA, 608 bp, Homo sapiens
  misc_feature: GZ8MTXP02JISQE.13.76.G10.1.454.CMB.2.raw
  modified_base (330)..(330): a, c, t, g, unknown or other
  modified_base (361)..(361): a, c, t, g, unknown or other
  modified_base (444)..(444): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtggggttcaccgtcagtcacacctacatgagctgggtccgccaggctccgaggggaggggctggagtgcgtctnttttattatagtagtggtatacatactccgnagactccgtggacggggccgattccaccatcctccaagagactaattaccaaagaacacgcttgtttactacaaaatgaaacngcctagagacgcccgatcggaaccgacgggtccgttagtacttacgtgtacggcggagaggacggtcgggggacccctaacggtaaaaccggttacctaaccggcgttaaacggtcggggtaccggttaccggtacgggggaaccccaaacgggggaacccccg

SEQ ID NO: 381541 - DNA, 688 bp, Homo sapiens
  misc_feature: GZ8MTXP02J15Y4.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagcttgggttttccttgttgcttattttaaaaggtgcccagtgtgaggtgcagctggtggagtcgtggaggaggcttgatccagccgtgggggtccctgagactctctgtgcacgtcctcgtggttccaccgtcagtcacacctacatgacgcgtcggtccgccgaggcctccggaaggggacgggtcgtaggtagtcgtcgttcttactttttaattagtagtaggtacggtagtacactaccgtccgacgacgtccgtccgggtacgggacgggggtacctacttacccaacctacgttacccgtaccgaaagtaaaccgtaaacctaaacttacccgaaaaggtaaccctaacggttctttacggttttacctaacgtaaaagttcgaaaacgtcgtccgtaggacggaacgcccgagtaccgacgtacggtccgtagtactacgtcggagacggagacgtcggtccggggaacccctaaggttaaccgttaaccgtacgtcgtacggtaccgggtaccgttaccggggacggggaaaccccgg

SEQ ID NO: 381542 - DNA, 571 bp, Homo sapiens
  misc_feature: GZ8MTXP02J08X1.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagctgggtcccgcaggcctccgaggggaagggctggagtgcgtcttctttatttatagtagtggtagtacatactccgcagcctccggtggacggggccagttccaccatcctacccgagacgactaattcccaaagaaccacgtcttcgtttctacaaatgaacagcctaggacgagccgagtacgacgaccgggccgttagtaacttactggtgacgaggaggacggtcggggacccctaacggtaacgttcgaacgctagtcgggacgtcggtcgggaacccg

SEQ ID NO: 381543 - DNA, 636 bp, Homo sapiens
  misc_feature: GZ8MTXP02GMDNK.13.76.G10.1.454.CMB.2.raw
  modified_base (280)..(280): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctanatgagcgtcgggtcccgccgaggcctaccgaagggggaacggggcgtagggaggttcggcgttctttctttttagtttataagttaggtggttaagtacctataccgtccgacagtaccttccggtgggacggggcctattccaccatcctccagacacaaacgttccaaagaacctacgtcttgtttacttacaaaatgaaaccagaccgttaggaacgacggacccgataccgacgaacccgggtccgttagttaacgttacgtggtcgacgaaggacggtacgtcgggggacccctaagtaaaccgttcacgtcgtagtacggacgtccggtaggggacccgaagggaccccg

SEQ ID NO: 381544 - DNA, 624 bp, Homo sapiens
  misc_feature: GZ8MTXP02I7TF4.13.76.G10.1.454.CMB.2.raw
  modified_base (235)..(235): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggancagctccaacattggggcacattatgatgtacactggtaccagcagtttccaggagcaggtcccagactcctcatcaatacgtaacaacaactccggcccgacgacggggtccctagacccgattcctcgtcggctccgagtctggcaccgtcacgccctccctggtcactcgactcgggccttccgacggtcctaggacggtagtacggaggtccgttagtacgtttaactttccgtacgtcccgttaacggttaccccttaaacgtttcggtaaaccgtacggaccgtaaaccggtccccgtttaggaacggtttcggtccggtttttacccggggttaacgggttttcccggggggacccgggggggtaacccccttaaccggggg

SEQ ID NO: 381545 - DNA, 635 bp, Homo sapiens
  misc_feature: GZ8MTXP02HBEOB.13.76.G10.1.454.CMB.2.raw
  modified_base (475)..(475): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtggattcaccttcagtacctaagacatgcacgtcgggtcccgacccaacctcgtaaagggaaaacggtccggaggtcgggtctcgagggtattggcgtaggtggttggtgacacctattctattcagacgtcgtggaacgggctattccacctatctaccaagaagaaaatcgaaccaacaacccttcccttaccacttaccgtaacaaatacgaaacncgacctaggagacggaccgggggaacacggtctaggtagttaacttacgtgtacgacgaaagggtacgggtattaaacgtttacttaacttaccgttaacgttcggacgttcggacggggtaaccgaaaacgggaccctaccgtaccgtaaccggtcccg

SEQ ID NO: 381546 - DNA, 768 bp, Homo sapiens
  misc_feature: GZ8MTXP02GD1YP.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtgggtccaccgtcagtcacacctacatgagcgtcgggtcccgccgaggcctccggaaggggaacggggcgtgggaggtcggtccgtttctttactttttaattttagtaggttaggttagggttaagtaaccctacttacctcccgactaacgtacccgttccgggtggggacgggggcccgtagttcccaacccgtacttcctacccgaagaacgaaacctaaacttaacccgaaaagtaaaccctaaccgtcctttacgttttaccttaaaccaaaagttacggaaaaccctacggtacccgttaggaacggaccggtacccggaagttacggaacccggtaccgggtacccggtttaggttaactttaccgtgggtacggacggaagggaaggtacgggtccgggggaaccccctaaacgggttaaaccgttaacccgtacggtaaccgttaaggtacggggtaacccggtcgggtaccgggggaaccccgaaacgggggtaacccccg

SEQ ID NO: 381547 - DNA, 556 bp, Homo sapiens
  misc_feature: GZ8MTXP02HW66M.13.76.G10.1.454.CMB.2.raw
  modified_base (295)..(295): a, c, t, g, unknown or other
  modified_base (432)..(432): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagctgggtccncaggctccgagggaagggctggagtgcgtcttctttattatagtagtgtagtacatactcgcagctcgtgaggggccgattcgactatctccagagacaattacccaaagaccacgtctgtttctacaaatgaaacngacctgaagacgaccgaatcgaaccacggtcccgtagttaacttacgtgtacgacggagagacggtcggggacccaaggtaacgtaacgtacgctagttcgggaacgtcggtacggggaacccg

SEQ ID NO: 381548 - DNA, 583 bp, Homo sapiens
  misc_feature: GZ8MTXP02IZKFZ.13.76.G10.1.454.CMB.2.raw
  modified_base (250)..(250): a, c, t, g, unknown or other
  modified_base (293)..(293): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggacagataaatatacttctggtancagcagagtcaggccagtcccctgtgctggtcatctatcaagntgccaagccggacctcgaggggactccccccgtgacgcgtattctcgtcggcctaccaaacgttccgtacggggaacctcgaacgcccactcgtacgaacccatccgaacggccgggacccaggcctaagtggatggaggtctggtaacttatacgttgacgagggtcggtaggggacaggacgacgcctacgccggtacccgacttagtcggttaccgttaccgggaacgttcgggaacccgtaacgggtcccaacccggttaccgtaacggtccgaacgaacccccgg

SEQ ID NO: 381549 - DNA, 652 bp, Homo sapiens
  misc_feature: GZ8MTXP02JP9FW.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtcgggtccgcccgagggcctccggaagggggaacggggctggagtggcgttcttcttttatttatagtagtggtatacatactccgacagacctcgtggacggggccgtattccacctactcctacccgaaagacgtaaacctaaacttaccgaaaacggaaaccctacggtcctttagtttttaccttaaaccaaaattcgaaaacctacggaccgttaggaacgacggacccgagtacgaaccgaccggtccgttaggtactttaacgtggtacggacgaggaggtacgtcgggggaccccaacggtaaacggttcaacggcttaggtacggacggtcggcggggacccgaacggggtacccg

SEQ ID NO: 381550 - DNA, 608 bp, Homo sapiens
  misc_feature: GZ8MTXP02J3CQK.13.76.G10.1.454.CMB.2.raw
  modified_base (251)..(251): a, c, t, g, unknown or other
  modified_base (263)..(263): a, c, t, g, unknown or other
  modified_base (268)..(268): a, c, t, g, unknown or other
  modified_base (277)..(277): a, c, t, g, unknown or other
  modified_base (280)..(280): a, c, t, g, unknown or other
  modified_base (282)..(282): a, c, t, g, unknown or other
  modified_base (292)..(292): a, c, t, g, unknown or other
  modified_base (378)..(378): a, c, t, g, unknown or other
  modified_base (398)..(398): a, c, t, g, unknown or other
  modified_base (428)..(428): a, c, t, g, unknown or other
tcagtcacgtactacacgaccggtgctcgatttagtcactcatacaggggggggagaggagcccagcactgggattccgaggtgtttccattcggtgatcagcactgaacacagaggactcaccatggagttttggctgagcgtgggttttccttgttgctattttaaaaggtgccagtgtgaggtgcagctggtggagtctggaggaggcttgatccagccgtggggggtccctgagactctcctgtgcngtctgtcggtcncgtcntcacactanagngngcgtcggccncgaggctcggagggacggctggagtcgtcgttacttattttatagtagtagtcgtataccactccgtccgacacggacgttcgggngggacgggacctatcacctntccacgaagaacaactaactaccaaagacncgtcttcgtttaacaacaaagtacgaaacgtcgccgaggacgacgaccgtagcgaccgtacggtacgtagtacttcgagtacggacgagacggtacgggtaccggacccgtaacgtaaccgttaacgacgaacgttacggtacggtacggtacgggaccgggaaccggaaccggtacccg

SEQ ID NO: 381551 - DNA, 636 bp, Homo sapiens
  misc_feature: GZ8MTXP02JJI7M.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggtcaccgtcagtcacacctacatgagcgtgggtccgccgaggcctccgaggggaaggggctggagtgcgttcttcttttatttatagtagtggtagtaccatacctcgcacgactcgtgacgggggccgtattccactctcctacccaagacgaacctaaattacccgaaaagtaaaccacgtccttagttttaccttacaaaattcgaaaactacggccttaggaaggacgacccggtaatcggaaaccgaccggggtccgttagttaacgtttaacgtggtaggacgaggacggacggtaccgggggacccaacggtaacggttaacctacgaacgtagtacggacgtcggtacggggaccgaacggggaccccg

SEQ ID NO: 381552 - DNA, 679 bp, Homo sapiens
  misc_feature: GZ8MTXP02HOW0K.13.76.G10.1.454.CMB.2.raw
  modified_base (501)..(501): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtcgtgggaggaggtcttgactccagtccgtggggggtccctggacgactctccgtgtgcacgcctcgtgggttcaccgtcagtcacacctacatgagcgtcgggtccgaccgaggcctccggaaggggaacggggcgtagggagtggtcggttctttactttttatttagtaagttaggtaggtagtaaccatacctcgacagtacgtcggtggacgggggcctacttccgaacctactctacccgaagaacgactaacttaccaaagaacctacgtctttatttacctactaaagtagaaacncgaccgtagaagacgaccggatacggaccgaccggtaccgtagttaactacgttggagcgaagaggtaacggtcggggaacccctaacgggtaaaccgtttaccgtaacggtaacgttaacggttacggggaacccggttcgggtaccgggggaaacccggtaaacggggacccccgg

SEQ ID NO: 381553 - DNA, 581 bp, Homo sapiens
  misc_feature: GZ8MTXP02G19CH.13.76.G10.1.454.CMB.2.raw
  modified_base (170)..(170): a, c, t, g, unknown or other
  modified_base (212)..(212): a, c, t, g, unknown or other
  modified_base (344)..(344): a, c, t, g, unknown or other
  modified_base (462)..(462): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctntaggaaataatggacagaataaatatacttcctggtatcagcagaagtcaggccacgtcccctgtgctggtcatctatcaagatgaccaagccggccctgacgggtactccccccgtgacgtcgtatttccncgtcgggcctacccgaaacttccgtacgggaacctcgacgtcccactctacgacccataccgacgccggaccccaggcctagtcggagtagacggcctaggtaaccttagtttaccgngtccgagggcggtacggacacgacgacgcaccgtcgccccgtatcgttacgtccgttaccggacgtacgggaacccgaacgggtacctacccgtacttaacggccaaccggaacccccg

SEQ ID NO: 381554 - DNA, 513 bp, Homo sapiens
  misc_feature: GZ8MTXP02HB38P.13.76.G10.1.454.CMB.2.raw
  modified_base (285)..(285): a, c, t, g, unknown or other
  modified_base (290)..(290): a, c, t, g, unknown or other
  modified_base (331)..(331): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataatggcagataaatatactctggtatcagcagaagtcaggccagtcccctgtcgctggtcatctancaagntcgccaagccgcctcgagggactcccccgtgacgcgattcncgtgctccaactctagggactcagcccactctgaccatcagccggacccaggctagtcgaatggagctgactattacgtgtcagggcgtgggacaggcagccacgcggcccactagtcgtcgttacggaacgttacggaaccgacggtaccgtaccggtaccttaacggccaacgaaccccg

SEQ ID NO: 381555 - DNA, 573 bp, Homo sapiens
  misc_feature: GZ8MTXP02IWMNT.13.76.G10.1.454.CMB.2.raw
  modified_base (417)..(417): a, c, t, g, unknown or other
  modified_base (441)..(441): a, c, t, g, unknown or other
  modified_base (481)..(481): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagcgtcgggtccgccaggctccgaggggaaggggctggagtgcgtcttcttttattatagtagtggtatacatactcgcagacctccgtggacggggccgattcaccatcctccagagactaatccaaagaaccncgcttgtttctacaaatcgaaacngcctagcgagcccgatcgacaacgggcgtagtacttacgngtgcgagagacggtcgggggacccctagggaaaccttcgacgaacgtacgtcgggaccgttcgggacggggtaacccaagggggtaaccccg

SEQ ID NO: 381556 - DNA, 632 bp, Homo sapiens
  misc_feature: GZ8MTXP02IVHUX.13.76.G10.1.454.CMB.2.raw
  modified_base (251)..(251): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtggggggtccctgagactctcctgtgcngcctctgggttcaccgtcagtccacacctacatgagcgtgggtcccgccgaggcctccgaggggaggggctggagtgtcgtcttcttttatttagtagtagtggtagtaccatacctccgacagacctccgtggacgggccgtattccacctatcctccaagagactaataccaaagaaccacgtccttagtttaccttacaaaagttcgaaaaccacgtccctaggaacgacgtacccggaatacggaaccgccgggtcccgttagttaacttacgtgtaggaccgtaggacggtaacggtccgggggacccctaacggtaaccgttacgtacgaacgtagtacggaccggtcggtacgggggaacccaacggggacccg

SEQ ID NO: 381557 - DNA, 541 bp, Homo sapiens
  misc_feature: GZ8MTXP02HUSTB.13.76.G10.1.454.CMB.2.raw
  modified_base (375)..(375): a, c, t, g, unknown or other
  modified_base (419)..(419): a, c, t, g, unknown or other
  modified_base (438)..(438): a, c, t, g, unknown or other
  modified_base (450)..(450): a, c, t, g, unknown or other
  modified_base (472)..(472): a, c, t, g, unknown or other
tcagtcacgtactacacgaccggtgctcgatttagtcactcatacaggggggagaggagcccagcactgggattccgaggtgtttccattcggtgatcagcactgaacacagaggactcacccatggagttttggctgagctgggttttccttgttgctattttaaaaggtgcccagtgtgaggtgcagctggtggagtctggaggaggcttgatccagcctggggggtccctgagactctcctgtgcagcctctggggttcaccgtcagtcacacctacatgagctgggtcccgccaggcctccgaggggaggggctggagtgcgtctctttttattatagtatggtagtaccatacctcgcagacctccgtgnggggccattccacccatcctccagagacaactccaaagacacgnttgttctacaaatgaaacngcagagacgcancgacacggcgtagtactagtgngacgagagacgcgggaccaacgtaacgttacacgtcgtagtacggacgtcggacgggaccgaacggccg

SEQ ID NO: 381558 - DNA, 611 bp, Homo sapiens
  misc_feature: GZ8MTXP02I5E94.13.76.G10.1.454.CMB.2.raw
  modified_base (427)..(427): a, c, t, g, unknown or other
  modified_base (437)..(437): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctggggttttccttgttgctattttaaaaggtgcccagtgtgaggtgcagctggtggagtctggaggaggcttgatccagcctgggggtccctgagactctcctgtgcagcctctgggttcaccgtcagtcacacctacatgagctgggtccgccaggctccgaggggaggggctggagtgcgtctcttttatttatagtagtggtatacatactccgcagactcgtggaggggccgattcacctacgtctccagacgaacaattcccaaagacacgctgtttctanaaatgaaacngacctgagacgccgaaatcgaaccgacggtcccgttagtacgtttactgtagtaccgaggaagacggttaccgggggaccccaaaaccggtaaacggtttacctaaccggcttaacggtacggggtaaaccggttcgggtccgggggaacccgaaaacgggggtaaacccccgg

SEQ ID NO: 381559 - DNA, 579 bp, Homo sapiens
  misc_feature: GZ8MTXP02ILL43.13.76.G10.1.454.CMB.2.raw
  modified_base (365)..(365): a, c, t, g, unknown or other
  modified_base (374)..(374): a, c, t, g, unknown or other
  modified_base (394)..(394): a, c, t, g, unknown or other
  modified_base (402)..(402): a, c, t, g, unknown or other
  modified_base (434)..(434): a, c, t, g, unknown or other
  modified_base (489)..(489): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtccctgagactctcctgtgcagcctctgggttcaccgtcagtcacacctacatgagcgtgggtcccgccgaggcctccgaggggaaggggctggagtgcgttcttcttttattatgtagtggtatacatactccgnacgactcgnggaggggccattccacctanctccaganactaataccaagaaccacgtcttgtttactanaaaatcgaaacagcctagagcgaccgaatcgaccgacggtccgtagtacttacgngtagacgagagacgtcggggaccctacggtaaaccgttactaacgaactaggtcggacggttcgacgggggtacccaaaggggtaccccg

SEQ ID NO: 381560 - DNA, 544 bp, Homo sapiens
  misc_feature: GZ8MTXP02GFZ9N.13.76.G10.1.454.CMB.2.raw
  modified_base (370)..(370): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtggttcaccgtcagtcacacctacatgagctgggtccgccaggctccgaggggaagggctggagtgcgtcttcttttattatagtagtggtagtacatactcgcagctccgngacggggccattcacatctcagagacatccaaagaccacgcttgttactacaaatcgaaacacgcctagacgacgaccgatcgaccgacgggccgtagtacttacgtgtcgcgagtagacgtcggggacccaggtaacgtaacgtacgctagtcggacgtcgtacggggaaccg

SEQ ID NO: 381561 - DNA, 557 bp, Homo sapiens
  misc_feature: GZ8MTXP02JRCU6.13.76.G10.1.454.CMB.2.raw
  modified_base (429)..(429): a, c, t, g, unknown or other
  modified_base (439)..(439): a, c, t, g, unknown or other
  modified_base (480)..(480): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctggggttttccttgttgctattttaaaaggtgcccagtgtgaggtgcagctagtggagtctggaggaggcttgatccagccgtggggggtccctgagactctcctgtgcagcctctgggttcaccgtcagtcacacctacatgagctgggtcccgccaggctccgaggggaggggctgggagtgcgtctctttttattagtagtagtggtagtaccatacctcgcagctccgtggacggggccattcaccatcctccagacacaattccaaagacacgtctgtttctanaaatgaaacngcctagagacgccgatgaccacgggtccgtgtactttacgngtgcgagaggacgtcggacccaacgtaccgttacgacgtcgtagtacggacggtcggtcggggaccgaacgggaccg

SEQ ID NO: 381562 - DNA, 624 bp, Homo sapiens
  misc_feature: GZ8MTXP02FNBFF.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtggggggtccctgagactctcctgtgcagcctcgtgggtcaccgtcagtcacacctacatgagcgtcgggtcccgccaggcctccggaggggaggggctggagtgcgtcttcttttattatagtagtggtagtaccatactcgcagacctcggtggacggggccattccgacctagtcctaccaagacgaactaacttacccaaagaaccacgtcttagtttactaacaaaatcgaaacgagaccctagaagacgacccgatcgaccgacgggtccgttagtacttacgtggtaggacgaggaggtacggtaccgggggacccctaaacggtaaaccgttaccgtaacggcgtaacgtacgggacggttccggtacgggggacccgaaacgggaaccccgg

SEQ ID NO: 381563 - DNA, 615 bp, Homo sapiens
  misc_feature: GZ8MTXP02HQTO6.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctcggggtccgccgaggcctccgaggggaggggcgtggagtgcgtcttcttttatttatagtagtggtagtacatactcgcagacctcgtggaggggcattccaccatcctccagacgaactaattccaaagaaccacgtcttgtttactacaaaatcgaaacacgcctaggaacgacgacccgatcggaaccgaccgggtaccgttaggttacttaccgtggtacggaccgggaaggtacgggacggttcgggggacccctaacggtaaaccgtttaccacggtaacctagtcgggacgttcgtacgggggaccgtaaacggggaccccg

SEQ ID NO: 381564 - DNA, 700 bp, Homo sapiens
  misc_feature: GZ8MTXP02JD4DO.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggtcaccgtcagtcacacctacatgagcgtcgggtccgccgaggcctccggaggggaacggggcgtggagtgtcgttcgtttctttttatttagtagttagtaggttagtaccgtatactcccgacacgtactccggtgggacggggtccgtagttccgacctactcctaccgaagacgtaaactaacttaccgaaaggtaaaccctacgtcgttacgtttttaccttaacgaaaacttcgaaaacctgtacccgttaggaacggaccgacccggaaattcgggaaacccgtacccggggtaccgttagttaacgttacgtgtacggcgaaggaggaacggttccgggaaacccctaacgggtaaaaccgtttaccgaaacggtcgttaacggtacgggtaacccggttggtaccgggggaaacccgtaacgggggaacccccg

SEQ ID NO: 381565 - DNA, 565 bp, Homo sapiens
  misc_feature: GZ8MTXP02JRLZN.13.76.G10.1.454.CMB.2.raw
  modified_base (317)..(317): a, c, t, g, unknown or other
  modified_base (394)..(394): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcgtgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgccaggctccgaggggaggggcnggagtgcgtcttcttttattatagtagtggtagtaccatactccgcagacctcgtggacgggggccattcaccatcnccagagacaattaccaagaacacgctgtttctacaaatcgaacacgcctgagagcccggaatcgaccgacggtccgtagtacttacgtgtgacgagagacgtcgggggacccacgtaaacgttaccgtaacgcgtaagcggtacgtcgcgggggaccgaacgggaccccgg

SEQ ID NO: 381566 - DNA, 578 bp, Homo sapiens
  misc_feature: GZ8MTXP02GIL4J.13.76.G10.1.454.CMB.2.raw
  modified_base (448)..(448): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggtcaccgtcagtcacacctacatgagctgggtcccgccaggctccgaggggaagggctggagtgcgtcttctttatttatagtagtgtagtacatactcgcagactccgtggacggggccgtattccaccatcctaccagagaacaacttaccaaagaacctacgcttgtttactacaaaatcgaaacngcctagacgagcccggatgaccacgggccttgtaacttacgtgtcgacggtagaggacgtcgggggacccaacggtaaacgttactacgcgtagtacggaccgtcggtacgggggaccaacgggaacccg

SEQ ID NO: 381567 - DNA, 659 bp, Homo sapiens
  misc_feature: GZ8MTXP02GHAS3.13.76.G10.1.454.CMB.2.raw
  modified_base (483)..(483): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggaggaggcttgatccagccgtggggggtccctgagactctcctgtgcagcctcgtgggtcaccgtcagtcacacctacatgagcgtcgggtcccgccgaggcctaccggaggggaacggggctgggagtgcgttcttcttttaatttatagtagtggtagtaccatacctccgacagacctcggtgggacggggccgtattccacctatcctacccaagacaactaaagttacccaaaagaaccacgtctttagttttacctacaaaattcgaaaaccncgtacctaggaacgacggacccgaataccggaaccgaccgggtccgtagttaacttacgtgtacggacgaggacgacggtccgggggacccctaaacgggtaaaaccgttacgaacggaaccgttaaggtcggggtaccggtcggtacgggggaaccccgtaaacggggacccccg

SEQ ID NO: 381568 - DNA, 578 bp, Homo sapiens
  misc_feature: GZ8MTXP02IB5J3.13.76.G10.1.454.CMB.2.raw
  modified_base (368)..(368): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgtccagtgtgaggtgcagctggtggagtctgggaggaggcttgatccagccgtggggggtccctgagactctcctgtgcagcctcgtgggttcaccgtcagtcacacctacatgagctgggtcccgccaggcctccgaggggaaggggctggagtgcgttcttctttttattatagtagtggtataccatacctccgnagactccgtggacggggccattcaccatctaccagagacaattccaaagaacacgcttgtttactacaaatgaaacagcctagagacgaccagtcgacgacggtccgtagttattacgtgttagcggaggtagacgtcgggggaccctacgaaccgtttacaccggctacggtacggtaccggtcggtcgggggaccaacggggtacccg

SEQ ID NO: 381569 - DNA, 604 bp, Homo sapiens
  misc_feature: GZ8MTXP02G0PL3.13.76.G10.1.454.CMB.2.raw
  modified_base (294)..(294): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccnccgaggctccgaggggaggggctggagtggcgtcttctttttatttatagttagtggtagtaccatactccgacagacctccggtggacggggcctaagttccaccatctccagacgacaattaccaaagaacacgtcttagtttcctacaaatgaaactacgtcctaggagtacggcccgatcgaacgaccgggccttaggttaacttacgtgtcgacgaggtacgacgtcgggggacccctaacggtaaccgttactaacgcttaagtacgggtacgtcggtacggggacccgaaacggggaaccccg

SEQ ID NO: 381570 - DNA, 580 bp, Homo sapiens
  misc_feature: GZ8MTXP02IVKAN.13.76.G10.1.454.CMB.2.raw
  modified_base (413)..(413): a, c, t, g, unknown or other
  modified_base (491)..(491): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataatggacagataaatatacttctggtatcagcagaagtcaggcccagtcccctgtgctggtcatctatcaagatcgaccaacgccggccctcgagggactccccccgtagagcgtacttctcgtcggcctccaactcgtacgggaacctcgaacgcccactctcgaccatcgaacggccggacccaggctagnggattaggacggtctaggtaaccttagttacgtcgtaccgagggcggtgggaacgagcgacgcctacgtcgccccgtnttacgtcgttaccgttacggtaacggttacggggaacccgtaacggtcccgtaacccggttacgtaaacgtcccgaacgtaacccccgg

SEQ ID NO: 381571 - DNA, 736 bp, Homo sapiens
  misc_feature: GZ8MTXP02H9N4K.13.76.G10.1.454.CMB.2.raw
  modified_base (295)..(295): a, c, t, g, unknown or other
  modified_base (395)..(395): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctctgggttcaccgtcagtcacacctacatgagctgggtccnccaggcctccgaggggaaggggctggagtgcgtctctttttattatagtagtggtagtacatacctcgcagactccgtgacgggggccagttcacctacnctacccagacgaactaaacttacccgaaaagaaccgtaacgtctttacggttttaccttaaccaaaagttacggaaaccacggtaccccttaagggaacgacgggaccccggtaagttcgggaaacccgacccggggtaccccggttagggtttaaactttaacccggttgggttacggtaccgggaaaagggtacgggtaaacggttacccgggggggaaaccccctaaaccggggaaaacccgggtttttaaccaaacccgggtaaccgttaacggtacgggggtaaaccggttccgggttaccggggggaacccgtaaaaccgggggtaaccccccgg

SEQ ID NO: 381572 - DNA, 545 bp, Homo sapiens
  misc_feature: GZ8MTXP02GODQR.13.76.G10.1.454.CMB.2.raw
  modified_base (513)..(513): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggggttcaccgtcagtcacacctacatgagctgggtccgccaggctccgaggggaaggggctggagtgcgtcttcttttatttatagtagtggtagtaccatactccgcagactcgtggaggggccgattccaccatctccagagacaatccaaagaacacgcttgtttctacaaatgaaactagcctagagagccgaatcgacacggccgtgttatactgtgacgagagagtcggggacccaggtaaacctctacgntagtcggacgtcgtcggggaccaagggacccg

SEQ ID NO: 381573 - DNA, 560 bp, Homo sapiens
  misc_feature: GZ8MTXP02JQOHS.13.76.G10.1.454.CMB.2.raw
  modified_base (371)..(371): a, c, t, g, unknown or other
  modified_base (389)..(389): a, c, t, g, unknown or other
  modified_base (394)..(394): a, c, t, g, unknown or other
  modified_base (430)..(430): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgaggggaaggggctggagtgcgtcttcttttattatagtagtggtagtaccatactccgcagactccgngaggggccattcacatcncaganacaatccaagaacacgctgtttctacaaatgaaacngcctggagagcccgatcgacgacggtccgtagttacttacgtgtacgcgaagagtaacgtcgggggacccacggtaaacgttacacggcttaagcggtacgtcgtacgggggacccaaaggggtaccccg

SEQ ID NO: 381574 - DNA, 549 bp, Homo sapiens
  misc_feature: GZ8MTXP02IS6II.13.76.G10.1.454.CMB.2.raw
  modified_base (236)..(236): a, c, t, g, unknown or other
  modified_base (410)..(410): a, c, t, g, unknown or other
  modified_base (461)..(461): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataatntacttctgtatcagcagaagtcaggccagtcccctgtgctggtcatctatcaagatcgaccaagccggccctcgagggactcccccgtgacgctattcctcgtcggcctccaacgtcgtacgggacctcgacgtcccacttcagacccatcgacgaccgggacccaggcctagnggatggaaggtcctaggtacttaagttacgtgtccgaggtcggtggaacgngacgacgcacgtcgaccgtcttagtcgtacgtacggaacgtcggaaccgtaacggtccgtaccgtaccgtaacgtcgacgtaaccccg

SEQ ID NO: 381575 - DNA, 541 bp, Homo sapiens
  misc_feature: GZ8MTXP02I3GBW.13.76.G10.1.454.CMB.2.raw
  modified_base (435)..(435): a, c, t, g, unknown or other
  modified_base (470)..(470): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctatttaaaggtgcccagtgtgaggtgcagctggtggagtctggaggaggcttgatccagccgtggggggtccctgagactctcctgtgcagcctctgggttcaccgtcagtcacacctacatgagctgggtccgccaggctccgagggaaggggctggagtgcgtcttctttattatagtagtgtagtacatactcgcagctccgtgacggggccagttcaccatcctcagacgaacaattccaaagacacgtcttagttactacaaatgaaacncgtctgagagccgatgacgacggcgtagtattacngtgcgagagacgtcggggacccacggtaacgttaacgacgtcgtacgtcggacgtcggtacgggaacccgg

SEQ ID NO: 381576 - DNA, 620 bp, Homo sapiens
  misc_feature: GZ8MTXP02JV3L5.13.76.G10.1.454.CMB.2.raw
  modified_base (403)..(403): a, c, t, g, unknown or other
  modified_base (414)..(414): a, c, t, g, unknown or other
  modified_base (597)..(597): a, c, t, g, unknown or other
tcagtcacgtactacacgaccggtgctcgatttagtcactcatacagggggggattccgaggtgtttccattcggtgatcagcactgaacacagaggactcaccatggagttttggctgagctgggttttccttgttgctatttaaaggtgccagtgtgaggtgcagctggtggagtctggaggaggcttgatccagccgtggggggtccctgagactctcctgtgcagcctctgggttcaccgtcagtcacacctacatgagctggtccgcaggctccgaggggagggctggagtgcgtctcttttattatagtagtggtagtacatactccgcagactcgtggacgggccgattcacatctccagacgacaactccaaagaaccacgcttagtttacctanaaatcgaaacngcctaggacgagcccgatcggaccacgggcccgttgtaacttacgtggtagacggaaggacgtaaggtccgggggaccccctaaggtaaacccgttacgtacggacttacggtacgggtaccggttcgacggggggaaccctaaaagggggccccgtaacgggggttcccaacccgggttccnccccgttacgaaccgtccccccg

SEQ ID NO: 381577 - DNA, 557 bp, Homo sapiens
  misc_feature: GZ8MTXP02HHS0L.13.76.G10.1.454.CMB.2.raw
  modified_base (358)..(358): a, c, t, g, unknown or other
  modified_base (361)..(361): a, c, t, g, unknown or other
  modified_base (369)..(369): a, c, t, g, unknown or other
  modified_base (394)..(394): a, c, t, g, unknown or other
  modified_base (433)..(433): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggttcaccgtcagtcacacctacatgagcgtgggtccgccgaggctccgagggaggggctggagtgcgtcttcttttattatagtagtggtatacatacncgnagactcgngacgggcatccaccatcctccaganactaatccaagaacacgcttgtttactacaaatgaaacngcctgagacgccgatcgacgacggtccgtgttaacttacgtgtgacgagagacgtcgggggaccctacggaaacgttaccgaacgctagtcgggacgtcggtacggggaccaacgggaaccccg

SEQ ID NO: 381578 - DNA, 531 bp, Homo sapiens
  misc_feature: GZ8MTXP02FZF02.13.76.G10.1.454.CMB.2.raw
  modified_base (522)..(522): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctgggggtccctgagactctcctgtgcagcctctgggttcaccgtcagtcacacctacatgagctgggtcccgccaggctccgaggggaagggctgggagtgcgtcttcgttttaattatagtagtggtagtacatactcgcagctccgtgaggggccattcacatctcagagacaattccaagacacgcttgttactaccaaatcgaaacaggcctgagagcccgatgacacggccgtagtattactgtgcgagagagtcggggacccacgaacgttaacgacgctatggacgttcgnggggaaccg

SEQ ID NO: 381579 - DNA, 546 bp, Homo sapiens
  misc_feature: GZ8MTXP02GSF3A.13.76.G10.1.454.CMB.2.raw
  modified_base (412)..(412): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctgggggtcctgagactctcctgtgcagcctctgggttcaccgtcagtcacacctacatgagctgggtccgccaggctccgaggggaaggggctggagtgcgtcttctttattatagtagtggtagtacatactcgcagctccgtggaggggccgattcgacatctccagagacaattcccaagaaccncgtctgtttctacaaatgaacagcctagagagccgatgacacggccgtagtattacgtgtgacgagaggactcgggggaccccaacggtaacgttaaccgacgacttagtcggaccgtcggtacggggaacccg

SEQ ID NO: 381580 - DNA, 528 bp, Homo sapiens
  misc_feature: GZ8MTXP02FQ9Y0.13.76.G10.1.454.CMB.2.raw
  modified_base (237)..(237): a, c, t, g, unknown or other
  modified_base (273)..(273): a, c, t, g, unknown or other
  modified_base (291)..(291): a, c, t, g, unknown or other
  modified_base (451)..(451): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataatggcagataaatntacttctgtatcagcagagtcaggccagtcccctgngctggtcatctatcaagntgaccaagccgccctagacgggactcccccgtagacgcgtattcctcgtcggcctaccaacgtcgtacgggaacctcgacgcccaactctacgaccatcgacggccggacccaggctagtgatggacgtctgacttatacgtgtacgaggtcgtgggacngacgacgacacgtcgcccgtctacgtcggttctacggactgggaaccaaggtccaccggtctaacgcgacgaacccg

SEQ ID NO: 381581 - DNA, 746 bp, Homo sapiens
  misc_feature: GZ8MTXP02G3PZ2.13.76.G10.1.454.CMB.2.raw
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagcccaccctcagtgtccgtgtccccaggacagacagccagcatcacctgctctaggaaataattggacagataaatatacttctggtatcagcagaagtcaggccagtcccctgtgctggtcatctatcaagatgaccaagccgcctcgacggtactcccgtagacgcgtattccgtcgtcgggtaccctaccgaaaccgttccgtacggggtaaacctcgaaacgcccctaacttccgtacgaaccctacgtaccgaaccgggaccccgggggaaccccgaacggggtacccgttaacggtaggggtaaacgttacggggaaacgggtccgttaacggtaacccgtttaaagtttaaacccggttcgggttaacccggtaagggggttacccgggttaagggggaaccgtaacggggaccgaacggttaccgaacccggttcggaccccccggttagttaaacggtttccggtttacccggttaaccgggtaaaccgggttaaccgggggaaaacccgttaaaccgggggtacccttaaccccgggtacccgtttaaaacggtacccgtaaaacccccggg

SEQ ID NO: 381582 - DNA, 763 bp, Homo sapiens
  misc_feature: GZ8MTXP02F10NH.13.76.G10.1.454.CMB.2.raw
  modified_base (173)..(173): a, c, t, g, unknown or other
  modified_base (256)..(256): a, c, t, g, unknown or other
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctnagtgtcccgtgtccccaggacagacagccagcatcacctgctctaggaaataattggcagataaatatacttctggtatcagnagaagtcaggccagtcccctgtgctggtcattctatacaaagactcgacccgtaaacggccggacccctacgacggggtaacccttcccccgtagacgacggtaactttcccgtacgttcgggtaccctacccgtaaaccgttccgtaacgggggtaaacccttccaaccggtaccctaaccttaccgttacggaaccctaacgttaccgaaaccgggacccgggggtaaacccccaagggggtaccttaacgggtagggttaaacgtacggggtaacggggtaccttacgggtaaacctttaacggtttaaccggttcggtacccggtaagggggtccgggttaagggggaccgtacggacgtaacgggtaccaaccggttccggacccccgtagttaacggttccgggtttacccggtttaccggggaaaccggttccggggaaacccggtaaacggttaccccggtaacccggtttaaccgtaacggttacccgaaaccccggg

SEQ ID NO: 381583 - DNA, 530 bp, Homo sapiens
  misc_feature: GZ8MTXP02GP2EX.13.76.G10.1.454.CMB.2.raw
  modified_base (368)..(368): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccaccctgggggtccctgagactctcctgtgcagcctctgggttcaccgtcagtcacacctacatgagctgggtccgccaggctccgaggggaagggctggagtgcgtctcttttattatagtagtggtagtacatactccgcagactccgtgngggggccattcaccatctccagagacaattcccaaagacacgctgtttctacaaatgaacagcctagagagccgatgacacggcgtgtatactgtgcgagagagtcggggacccagacgttacacgctaagtcggacgtcgtcgggccaacgggacctacgg

SEQ ID NO: 381584 - DNA, 558 bp, Homo sapiens
  misc_feature: GZ8MTXP02IRULY.13.76.G10.1.454.CMB.2.raw
  modified_base (295)..(295): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtcccnccaggctccgaggggaaggggctggagtgcgtcttcttttattatagtagtggtagtaccatactccgcagacctcgtggaggggcccagttccaccatctccagagacaatccaaagacacgcttgtttctacaaatgaaacacgcctagacgagccgatcgacacggccgtagtactttacgtgtgtcgagaggacgtcggggacccacgtaaccgttacacgtcgtacgtacggacgtcgtcggggaccgaagggacccg

SEQ ID NO: 381585 - DNA, 706 bp, Homo sapiens
  misc_feature: GZ8MTXP02GDGC3.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcacgcctcgtggttcaccgtcagtcacacctacatgagcgtcgggtcccgccgaggcctaccggaagggggaacggggcgtaggggacggtcggtccgttctttactttttaatttagttaggttaggttagggttaacgtaacctaacttaccgttcccggactaacggtaccgtccgggtggggaacgggggacccgtacttacccacccgtacttccgtacccgaaaggaacgaaacctaacttaacccgaaaagaaccctaacggtcctttacgtttaccttaacgtaaaagttcggaaactcggtaccctaggacggacgacccgtaagtacggaccgtaccggtcgttacgtacttacgtggtcggacgtaggaaggtacggtaccggggaccccaaggtaaaccgttaacgacgtactaggtcggtacgtacgggtacggggaacccgg

SEQ ID NO: 381586 - DNA, 546 bp, Homo sapiens
  misc_feature: GZ8MTXP02IHIVJ.13.76.G10.1.454.CMB.2.raw
  modified_base (238)..(238): a, c, t, g, unknown or other
  modified_base (451)..(451): a, c, t, g, unknown or other
  modified_base (473)..(473): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagcccaccctcagtgtccgtgtccccaggacagacagccagccatccacctgctctgaaataatggcagataaatntacttctgtatcagcagagtcaggccagtcccctgtgctggtcatctatcaagatgccaagccggccctcgacgggactccccctgacgcgtattctctcggctccaactcgtcgggaactcgacgccactctgaccatccgagccggacccaggcctaagtcggagtggaaggctaggtactagttacgtgttccgagggcggtaggggacnggacacggctacgtcgccccgngtacgtcgttccgttacgggacttcgggggaacctaacggtccaaccgtacgttaacgccgaaccgaaccccg

SEQ ID NO: 381587 - DNA, 569 bp, Homo sapiens
  misc_feature: GZ8MTXP02GIA3X.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgccaggctccgaggggaggggctggagtgcgtctcttttattatagtagtggtagtacatactcgcagactccgtggacggggccgattccgaccatcctccagacgacaattcccaaagaacacgtctgtttactacaaatcgaaacagcctaggacgacgccggatcgacacgggccgtagtacttacgtgtgacggagtagcgtcgggggaccccaacggtaaccgttacgtacgcttagcgggacgtcgtacgggggaccaacggggacccg

SEQ ID NO: 381588 - DNA, 627 bp, Homo sapiens
  misc_feature: GZ8MTXP02HURCE.13.76.G10.1.454.CMB.2.raw
  modified_base (457)..(457): a, c, t, g, unknown or other
  modified_base (474)..(474): a, c, t, g, unknown or other
  modified_base (503)..(503): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggttcaccgtcagtcacacctacatgagctgggtccgcaggctccgaggggaggggctggagtgcgtcttctttatttagtagtagtggtagtacatactccgcagacctcgtggacggggccgtagttccacctactcctcccgaagacaactaattacccaaaggaacctacgtctttgtttacctacaaaatgaaacngccctggaagcgaccgntacgaccgacgggtccgtagttaattcgnggtgccggaaggtagacgggtcgggggaccccctaagggtaaaacccgtttccgaaccgggtctttaaacgcgggggtaaccggtccggtacggggggaccccgtaaacgggggtaacccccgg

SEQ ID NO: 381589 - DNA, 566 bp, Homo sapiens
  misc_feature: GZ8MTXP02I61N0.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggggtcaccgtcagtcacacctacatgagctgggtccgccaggctccgaggggaggggctggagtgcgtcttcttttatttatagtagtggtagtacatactcgcagactccgtggaggggccattccaccatctccagagacaattccaagaacacgcttgtttctacaaatgaaacagcctagagacgccgatcgaccgacggccgtgtattacgtgtgacgagaggacgtcgggggaccccacggtaaaccgttacgtaacggctaagtcgggaccggtcgtacgggggaccgaaacggggaaccccg

SEQ ID NO: 381590 - DNA, 682 bp, Homo sapiens
  misc_feature: GZ8MTXP02JGZ96.13.76.G10.1.454.CMB.2.raw
  modified_base (170)..(170): a, c, t, g, unknown or other
  modified_base (235)..(235): a, c, t, g, unknown or other
  modified_base (289)..(289): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctctaggaaataatggcagataaatntactctgtatcagcagaagtcaggccagtcccctgtgctggtcatctatcaagntacgaccaagccggaccctcgagggactcccccgtgacgcgtattcctcgttacggttcccaaacttcgtacggggtaaacctcgaacgtcccacttacgtaccgaccctagtaccgacggcccggggaaccctacggggaccttaacgtgggaaaccgttgggaaacgggtcccttaaggtaaaccgtttacgtttaaaccgttcgggttacccgaaaggggtccggttacggggaaacgtacggccgaagaccgtaacgttccgggaccccctagttaccgttacggttaccgttacccgggtaaaacgttcccgggggaaacccttaaacggggtcccctaaacccggttaccgtaacgtacccgaaccggtaccccgaaaacccccggg

SEQ ID NO: 381591 - DNA, 698 bp, Homo sapiens
  misc_feature: GZ8MTXP02JBUV8.13.76.G10.1.454.CMB.2.raw
  modified_base (511)..(511): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgccagtgtgaggtgcagctggtggagtcgtgggaggaggcttgatccgagccggtggggggtccctggacgactctcctgtcgcacgtcctcgtcggtcaccgtcacgtcacacctacatgacgcgtcgggtccgccgaggcctaccggaggggacggggcgtagggaggtcggtcgtttctttacttttagtttagtagttaggtggtactacctataccgtccgacacgtaccgtcggtggggacggggaccctagttaccacctactcctaccgaaagacgaactaacttacccgaaagtaccctacgtctttacgtttactaacaaatcgaaaaccncggtcctaagggacgacgaccggtaagacggaccgtacggggtaccgtttaggttaaccttacggtggtacggtaccggaggtacggacgggtcccgggggaaaccctaaacgggtaaaccgtttacgaccggtcgttaggaccgggtaccggtacgggtacggggacccgtaaacggggacccccg

SEQ ID NO: 381592 - DNA, 559 bp, Homo sapiens
  misc_feature: GZ8MTXP02G21NH.13.76.G10.1.454.CMB.2.raw
  modified_base (294)..(294): a, c, t, g, unknown or other
  modified_base (311)..(311): a, c, t, g, unknown or other
  modified_base (483)..(483): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcggcctctgggctcaccgtcaacaccaactacatgagctgggtccnccaggctccaggggaanaggccggagtgggtctcagttatttatgtcgacggtgccacattctacgcagactccgtggaggggccggttcaccatctccagagacaattccaaagaacacggtagtatcgttacaaatcgaacacctgagagtcgagaccgacgccgtctattactgtgacgaaaagtntacgacgagacggaccggacccgtaagtcggggtcgtgggtcggtacggtttcttcgttagacgtcgacggtcggg

SEQ ID NO: 381593 - DNA, 602 bp, Homo sapiens
  misc_feature: GZ8MTXP02I0P6T.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctcgtggggttcaccgtcagtcacacctacatgagctgggtccgccgaggcctccgaggggaaggggcgtggagtgcgtcttcttttatttatagtagtggtagtacatacctccgcagtaccgtccgtggacgggggccgtattccaccatctcccaagagacaattaccaaagaacacgtcttgtttactacaaaatgaaacacgcctagagacgacgatacggacgaacggtcgtagttacttacgtgtcgacgtaggagtacgtacgggggccccaacggtaaaccgtttacgaacgtccgttaagtcgggtacctcgggtacgggacccgaaacggggtaaccccg

SEQ ID NO: 381594 - DNA, 683 bp, Homo sapiens
  misc_feature: GZ8MTXP02JEL9K.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtgggtccgccgaggctccgaggggaggggctggagtgcgtcttctttatttatagtagtggtagtaccatactccacagacctcggtggacggggccgtacttccacctatcctacccaagaacgaactaaacttaccaaagaaaccacgtccttagttttaccttacaaaattcgaaacacgtacctggaagtacgacccgatacggaaccgaccgggtccgttagttaacgttacgtggtacgacggtaaggacggtaacggttccgggggaaaccccctaaacggggttaaacccgtttaaccgtaaccgggttaaccgttaaaaggttccgggggtaaacccggttccggggtaccgggggggaaccccgtaaaacggggggtaaccccccg

SEQ ID NO: 381595 - DNA, 627 bp, Homo sapiens
  misc_feature: GZ8MTXP02I76N5.13.76.G10.1.454.CMB.2.raw
  modified_base (248)..(248): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtctggaggaggcttgatccagccgtgggggtccctgagactctcctgtgcngcctcgtgggtcaccgtcagtcacacctacatgagccgtcggggtcccgccgaggcctccggaggggacggggctgggagtgcgtctttcttttattagtagttagtggtatacctatacctcgcagaccttccggtggacggggtcccgtattccgacctatcctcccgaagacgtaccaattacccaaagaccacgtcttgtttactacaaaagtcgaaacagtccctaggagacgacccgaagtcgtacgacggtccgttagtactttacgtgtacgacggtagacgacgtaccgggggaccctacggtaaccgttacgtacggaacgttagtacgggtaccgtacggtacgggggaccgtaaacggggtaccccg

SEQ ID NO: 381596 - DNA, 622 bp, Homo sapiens
  misc_feature: GZ8MTXP02FLVP3.13.76.G10.1.454.CMB.2.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagccggcccctgacggggatcccccgtgagcgattctctggcctccaaactcgtagggaactcgagcccactctacgaccatcagccgggacccagggctagtcggataggaggctacgacttaacgttacgtaggttccgaaggggtccggtaggggaaccgaggccgaaacgggcctaaaccgttcggcccccggtacttaacgttcgggttacccgttttaacgggggaaaaccgtttacggggggaaaacccgtaaaacggggttacccccgtaaacccggttacccgttaaaaccggtccgaaaccggtaaacccccgg

SEQ ID NO: 381597 - DNA, 590 bp, Homo sapiens
  misc_feature: GZ8MTXP02H88X1.13.76.G10.1.454.CMB.2.raw
  modified_base (364)..(364): a, c, t, g, unknown or other
  modified_base (450)..(450): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtccctgagactctcctgtgcagcctcgtggtcaccgtcagtcacacctacatgagcgtcgggtccgccgaggctccgaaggggaggggctgggagtgcgttctcttttattatagtagtgtatacatactcgnacgctccggtgacggggcctattccactatcctccagacgactaaactaccaaaagaccacgtctgtttactacaaaatgtaaacngcctagacgacgccgaagtcgaacgacggtccgtagtattaccgtggtacgacgaagacggaacggttccggggacccgtaacgtaaaccgttaacgtaccggtgtaacggtcggacggttacggtacggggaaacccgg

SEQ ID NO: 381598 - DNA, 620 bp, Homo sapiens
  misc_feature: GZ8MTXP02JW0HM.13.76.G10.1.454.CMB.2.raw
  modified_base (339)..(339): a, c, t, g, unknown or other
  modified_base (370)..(370): a, c, t, g, unknown or other
  modified_base (449)..(449): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttagctgagctgggttttccttgttgcttattttaaaaggtgcccagtgtgaggtgcagctggtggagtctggaggaggcttgatccagccgtgggggtccctgagactctcctgtgcagcctcgtggttcaccgtcagtcacacctacatgagcgtcgggtccgccaggctaccgaggggaacggggctgggagtcgcgttcttnttttattatgtagtagtagtacatactccgnagcctcggtaggacgggaccattcaccatccacgagacgaactaactacccaaagaccacgtacttgttttacctaaanaaaagtacgaaacgcgtacgaggaacgacgaccgtacgtacgaaccggtaccggtaccgttagttacttacgtcggtacggacggaacggaaggtacggtacccggggaccctaaacggtaaccgttaaccgacgtacgtaacggtcggaaccggttcggacggggaaccg

SEQ ID NO: 381599 - DNA, 580 bp, Homo sapiens
  misc_feature: GZ8MTXP02HEJBK.13.76.G10.1.454.CMB.2.raw
  modified_base (368)..(368): a, c, t, g, unknown or other
  modified_base (376)..(376): a, c, t, g, unknown or other
  modified_base (388)..(388): a, c, t, g, unknown or other
  modified_base (396)..(396): a, c, t, g, unknown or other
  modified_base (401)..(401): a, c, t, g, unknown or other
  modified_base (444)..(444): a, c, t, g, unknown or other
  modified_base (477)..(477): a, c, t, g, unknown or other
  modified_base (486)..(486): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctattttaaaaggtgcccagtgtgaggtgcagctggtggagtcgtggaggaggcttgatccagccgtggggggtccctgagactctcctgtgcagcctcgtgggttcaccgtcagtcacacctacatgagcgtcgggtccgccgaggcctccggaggggaggggcgtggagtgcgtcttcttttattagtagtagtggtagtaccatacncgcacgcncgtggacgggcntcacatcncaganactaataccaagaacacgtcttgtttactaacaaatcgaaacncgcctagaagcgacgatcgaacgacggtacgtntacttacgngtcgacgaggagacggtccggggacccaacgggtaaccgttacgaacgccgttagtacgggacgtcgggtacggggaaccgaacggggaccccg

SEQ ID NO: 381600 - DNA, 635 bp, Homo sapiens
  misc_feature: GZ8MTXP02J2NRT.13.76.G10.1.454.CMB.2.raw
  modified_base (251)..(251): a, c, t, g, unknown or other
  modified_base (454)..(454): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcngcctcgtgggttcaccgtcagtcacacctacatgagcgtgggtccgccaggcctccggaggggaaggggctgggagtgcgttcttcttttattatagtagtggtagtacatactcgcagcctcggtggacggggcgattcacatcctaccgaagacgactaacttccaagaaccacgtcttacgtttcttacaaatcgaaacncgcctaggacgacgccctagtacgaaccgtacgggtccttagtaacgttaccgtggtacggacgaaggacgtacgggttaccgggggaacccctaaaccggtttaaaccggttaacccgtaaccggtacgtaacgggtacggggacccggtttaccggggtacgggggaaacccccggggg

SEQ ID NO: 381601 - DNA, 653 bp, Homo sapiens
  misc_feature: GZ8MTXP02JPY5F.13.76.G10.1.454.CMB.2.raw
  modified_base (462)..(462): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccgagccgtgggggtccctgagactctcctgtgcagcctctgggttcaccgtcagtcacacctacatgagcgtcgggtccgccaggcctaccggaggggaaggggctgggagtgcgttcttcttttattagtagtagtggttttagactatacctcgacacgtccgtccggtggacgggggccctagttccaacctacgtcctaccgagaacgtaacctaaacttaccccgaaaagtaaacccncgtaccgtttagtttaccctttaacgaaaactcggtaaaccacggtccctaggaaggaccgaccgaagttacggaccgaacgggtcccgttaaggtaacttacgtggtacggacgaggtacgacggtaccggggaccctaacggtaaccgttaacgtacgacctagtcggacggttcggacgggaacccgg

SEQ ID NO: 381602 - DNA, 577 bp, Homo sapiens
  misc_feature: GZ8MTXP02FQX3C.13.76.G10.1.454.CMB.2.raw
  modified_base (364)..(364): a, c, t, g, unknown or other
  modified_base (430)..(430): a, c, t, g, unknown or other
  modified_base (440)..(440): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtgggtccgccgaggcctccgaggggaaggggcgtggagtgcgtcttcttttatttatagtagtggtagtacatacncgcagactcgtgaggggcctattccactatctccagagacaatccaaagaacacgcttgtttctanaaatgaaacngacctagagacgccgatcgacacgggtccgttagtacttacgtgtcgacgagagtacggtcggggacccacggtaaacgttaccgtaacgcgtaacgtcgggtaccgtcggtacggggacccgaaggggtaaccccg

SEQ ID NO: 381603 - DNA, 560 bp, Homo sapiens
  misc_feature: GZ8MTXP02IHPHZ.13.76.G10.1.454.CMB.2.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctagaaataatggcagataaatatactctggtatcagcagaagtcaggccagtcccctgtgctggtcatctatcaagatgccaagccgcctcgagggactccccccgtagacgcgtattctctggcctccgaaactcgtagggaacctcgaacgtcccactctcgacccatccaggcccgggacccaggcctaagtcggatggaggctaggtactattaccgtgtcgaggcggtaggacagcgagccgtacgcgccccgtatacgttcggtccgttacgggaaccgttacggggaacccgtaacggtaccgtaacccgtacccgtaaacggtccgaaccgaacccccgg

SEQ ID NO: 381604 - DNA, 701 bp, Homo sapiens
  misc_feature: GZ8MTXP02HJVUC.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctcgtgggttcaccgtcagtcacacctacatgacgcgtcgggtcccgccgaggcctccggaaggggaaggggcgtggagtgcgttcttcttttatttatagtagtggtagtaccatactccgcagacctccggtgggacggggcctacgttcacctatcctacccaggaaactacctaaacttacccgaaaacgtaaacccgaccggtcctttaggttttaccttaaacaaaagttcgaaaaccgtacggtaccctagggaacgacggacccggtaagtacggaaccgaccggggtaccgttaggtttaacttaccggttggtacggaccggaaaaggtggtaaacgggttccgggggacccctaaacggtaaccgggttaaccttaccggaacgtaacgttacgggaccggttacgggtaccgggggaccggaaacggggaccccgg

SEQ ID NO: 381605 - DNA, 635 bp, Homo sapiens
  misc_feature: GZ8MTXP02ILIRF.13.76.G10.1.454.CMB.2.raw
  modified_base (374)..(374): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagcgtcgggtcccgccgaggcctccgaaggggaggggcgtggagtgcgttcttcttttattatagtagtgtatacatactccgcagcctcgngggacgggcgattccaccatcctaccagacgacctaattaccaaagaaccacgtctttgtttacctaacaaaatcgaaacacgcctaggaagacgccgtaatcggaaccgtaccgggtaccgtttaggttactttaaccgtggtacggacggaaggtaacggaacggttccgggggaacccctaaacgggtaaaccgtttacaacggtcgttacgtacgggtaccggtacggtacgggggaacccgaaaacggggaccccg

SEQ ID NO: 381606 - DNA, 535 bp, Homo sapiens
  misc_feature: GZ8MTXP02GFXDW.13.76.G10.1.454.CMB.2.raw
  modified_base (467)..(467): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgaggggaggggctggagtgcgtcttcttttatttatagtagtggtagtaccatactccgcagactcgtggaggggccattcaccatctccagagacaattccaaagacacgctgtttctacaaatgaaacagcctagatagccgatcgacacggcgtgtattagngtgcgagagacgtggggacccacgtaacgtacacgctagtcggacgtcgtcggggaccaaggggaccc

SEQ ID NO: 381607 - DNA, 566 bp, Homo sapiens
  misc_feature: GZ8MTXP02H20Z6.13.76.G10.1.454.CMB.2.raw
  modified_base (406)..(406): a, c, t, g, unknown or other
  modified_base (444)..(444): a, c, t, g, unknown or other
  modified_base (452)..(452): a, c, t, g, unknown or other
  modified_base (487)..(487): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctcgggttcaccgtcagtcacacctacatgagcgtgggtccgccgaggcctccgaggggaaggggctggagtcggtcgttctttctttttatttatagttagtggtagtaccatacctccgacagactccgtggacggggccgacttccaccntctccagagactaatccaaagacacgtctgtttactanaatgaacngacccgagacgccgatcgacacggctgtattacgngtgcgagagaggtcgggacccaacggtaacttacgacgctaagtcggacgttcggacggggaccaaggggaccctacgg

SEQ ID NO: 381608 - DNA, 617 bp, Homo sapiens
  misc_feature: GZ8MTXP02GWHEI.13.76.G10.1.454.CMB.2.raw
  modified_base (442)..(442): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtctggaggaggcttgatccagccgtgggggtccctgagactctcctgtgcagcctctgggtcaccgtcagtcacacctacatgagcgtcgggtccgccgaggcctccggaggggaaggggctggagtgcgtcttcttttattatagtagtggtataccatactcgcagactccgtggacgggggctattcacctatcctccaagagaaccaattcccaaagaacctacgtcttgtttacctanaaaatgaaacagtcctaggagacgcccgtaagcgaaccgacgggtccgttagttaacttaaccgtgtacggacgaggtagacggttacgggggacccctaaacggtaaacgttaccgacgaacgttaacgtcggggtaaccgtcggtacgggggaacccgaaacggggtaccccg

SEQ ID NO: 381609 - DNA, 593 bp, Homo sapiens
  misc_feature: GZ8MTXP02J2J61.13.76.G10.1.454.CMB.2.raw
  modified_base (440)..(440): a, c, t, g, unknown or other
  modified_base (458)..(458): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctggagactctcctgtgcagcctctgggttcaccgtcagtcacacctacatgagctgggtccgcaggctccgagggagggctggagtgcgtctcttttattatagtagtgtagtaccatactcgcagacctccgtggaggggtccgattcaccatctcccagtagaacaacttaccaagaacacgtctgtttactacaaattgaaacngcctagagacgccgtaancgaccgacggtcgtatagttacgtgtcgacgaggaggacggtaccggggacccctaacggtaaccgttaaccgtacgtaacgttaacggtacgggtaccggtaccgggtaccggggaacccggtaacgggacccg

SEQ ID NO: 381610 - DNA, 586 bp, Homo sapiens
  misc_feature: GZ8MTXP02FXAFG.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggtcaccgtcagtcacacctacatgagcgtcgggtcccgccgaggcctccggaggggaaggggctggagtgcgtcttcttttatttatagtagtggtagtaccatacctcgcagactccgtggacggggccattccaccatcctccagacgaactaattaccaaagaacacgcttagtttctacaaatcgaaacagcctagagacggacccgaatcgaaccgaccggtccgttagtacttacgtgtgacgagagacgtacgggggacccaacggtaaacgttcgaacgcgtagtacggtacgtcggtacggggaccgaacgggacccg

SEQ ID NO: 381611 - DNA, 539 bp, Homo sapiens
  misc_feature: GZ8MTXP02IZ6HG.13.76.G10.1.454.CMB.2.raw
  modified_base (390)..(390): a, c, t, g, unknown or other
  modified_base (437)..(437): a, c, t, g, unknown or other
  modified_base (513)..(513): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctggggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagcgtgggtccgccaggctccgagggaggggctggagtgcgtcgttcttttatttatagtagtggtagtacatactcgcagactccgtgacggggccgattccaccntctccagagacaatccaaagaacacgcttagtttctacaatgaaacngcctgagacgccgatcgacacggccgtagtattacgtgtgcgagagacgcgggacctacgacgtacgacgctacgnggactggcgggaccgtaacggacccg

SEQ ID NO: 381612 - DNA, 644 bp, Homo sapiens
  misc_feature: GZ8MTXP02I42IR.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtggggttcaccgtcagtcacacctacatgagctgggtccgccaggctccgaggggagggctggagtgcgtcttctttattatagtagtgtagtacatactcgcagactcgtggacgggcctagttccacctatcctaccaagacgaacctaaattacccaaaggaacctacggtcctttagttttacctaacgaaattcggaaacacgtcctaggacgacgccgaatcgaacgtaccgggcgttagtacttaccgtgacggacgtaggaacggtcggtacccgggggaccccctaaagggtaaaaccgtttccgtaaaccggtcgttaaacggtcggggtaaacccgttcgggtaccgggggaaccgtaaaccgggggaaacccccgg

SEQ ID NO: 381613 - DNA, 596 bp, Homo sapiens
  misc_feature: GZ8MTXP02JLOP9.13.76.G10.1.454.CMB.2.raw
  modified_base (303)..(303): a, c, t, g, unknown or other
  modified_base (461)..(461): a, c, t, g, unknown or other
  modified_base (504)..(504): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtgggccgccaggccncgagggaggggctggagtgcgtcttcttttattatagtagtgtagtacatactccgcagactccggtgggacggggcctagttccaacctatcctaccgaaagagaacctaaacttcccaaagaaccacgtcttacgtttactacaaaattcgaaacngacctgacgacgccgatcgaccacgggtccgttgtaacttcgnggtgacgaagacggacggtcggggacccctacggtaaaccgttacacgtaacgtacgcgggtacgtcggacggggacccgaagggtaccccg

SEQ ID NO: 381614 - DNA, 628 bp, Homo sapiens
  misc_feature: GZ8MTXP02HFWHR.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggtcaccgtcagtcacacctacatgagcgtgggtccgccgaggcctccgaggggaggggctggagtgcgtcttcttttattatagtagtggtagtacatacctccgacagacctccggtggacgggggcctattccacctatcctacccgagacgaacctaaattaccgaaagaaccacgtccttagtttacctacaaatgaaactagcctagagacgccgatgaccgacggtccgtagttacttacgtgtacggacggagacggacggtacgggggacccctaaacgggtaaaccgtttaccgaacggtaaccgtagttaccgggtaccggttacggtaccgggggaacccgaaacgggggtacccccg

SEQ ID NO: 381615 - DNA, 574 bp, Homo sapiens
  misc_feature: GZ8MTXP02HQKCT.13.76.G10.1.454.CMB.2.raw
  modified_base (294)..(294): a, c, t, g, unknown or other
  modified_base (354)..(354): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagttggtggagtctggaggaggcttggtccaggccgggggggtccctgagactctcatgtgcggcctctgggctcaccgtcaacaccaactacatgagctgggtccnccaggctccgagggaagagggccggagtgggtctcagtttatttatgtcgacggtgccanattccctacgcagactcgtggaggggccgttcacatcctcagagacaattccaagacacggtgtatacttacaaatagaacgactagagagtcgaggacacggccgtactattacgtgtgacgaaagatgacaggacggacgggacccccgtaaaggtcggggccgtcggggtggtacgggtttcttcgtttcgactggtcgtcggggccgtaaccgggg

SEQ ID NO: 381616 - DNA, 608 bp, Homo sapiens
  misc_feature: GZ8MTXP02IXSZG.13.76.G10.1.454.CMB.2.raw
  modified_base (170)..(170): a, c, t, g, unknown or other
  modified_base (238)..(238): a, c, t, g, unknown or other
  modified_base (249)..(249): a, c, t, g, unknown or other
  modified_base (300)..(300): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctctaggaaataattggacagaataaatntacttctgtancagacagaagtcacggccacgtcccctgtgctggtcatctatcaagttacncgaccgaacggccgccctacgagggtacctccccgtagacgtcgtattcctccgttcggcctaccaacgttccgtacgggaactcgaacgccctaactcctacgaccctagtaccgacggccgggaacccaggtactacgtggagtacggaggtctacggtaacttagttaacgtggtaccgaggggtccggtaggggacaggacgacgtccgtacgtcggcccgtacgttagtcggttccgttaacgggaacggttacgggaaccgtacggtaccgtacccgtacgtaacgtaccgaaccgaacccg

SEQ ID NO: 381617 - DNA, 977 bp, Homo sapiens
  misc_feature: GZ8MTXP02JP52N.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctatttaaaggtgcccagtgtgaggtgcagctggtggagtctggaggaggcttgatccagccgtgggggtccctgagactctcctgtgcagcctcgtgggttcaccgtcagtcacacctacatgacgcgtcgggtccgccgacggccgtaccggaaggggaacggggccgtaggggaggttcggtccggtttccttttaccgttttttaagttttaacgttaaaggggtttaggtttaggggttaaacgttaaccccgtaacgtttaacccgttaccccggtaccgtaacgggtaacccgtttcccggggtcgggggtaaaccggggggtacccggtaacgtttaccccgaaccctaaccttaccccgttaaccccgtaaagggaaaccgtaaaaccctaaaaccgttttaacccccgaaaaacgggtaaaaccctaaccggttccccgttttaagggtttttaacccctttaaaacctaaaaagtttaaaccggtaaaacccgacgggttaacccgttaacggggaaacggttaacccgggacccgggttaaaacgttaccgggaaacccggtaaaacccccggggggttcccgtttaaggtttaaaccgttttaaccgggttgggttacccgggaacgggttaaaagggacgggttaaaccgggggtacccgggggtaaacccccgtaaaacccgggttaaaaccgggttttacccgtaaaccgggtaaccgtttaaaacgggggtttcccggggaaaacccgggtttccggggtaccgggggggaaacccccggaaaacggggggttacccccccgg

SEQ ID NO: 381618 - DNA, 567 bp, Homo sapiens
  misc_feature: GZ8MTXP02JA536.13.76.G10.1.454.CMB.2.raw
  modified_base (293)..(293): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggggtcaccgtcagtcacacctacatgagctgggtccnccaggctccgaggggaggggctggagtgcgtcttcttttatttatagtagtggtagtaccatacctcgcagacctccgtggacggggccaattccaccatcctccagagaacaattcccaaagtaacacgtctgtttcttacaaatgaaacagcctgagagccgaatcgacacggcctagtatacgtgtgacgaggagacggtcgggggacccacggtaaaccgttacacgccgtagtacggtacgttcgacgggggacccaaggggtaccccg

SEQ ID NO: 381619 - DNA, 649 bp, Homo sapiens
  misc_feature: GZ8MTXP02H173U.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtgggtcccgccgaggcctccggaaggggaacggggccgtagggagtggtccggttctttctttttaatttatagttaggtggtagtaccatacctcgacagaccgtccgtgggacggggcctacttccgacctactacctcccaagagaactaacttaccaaagaaacctacgtcttagtttacctacaaatacgaaaccagtacccgttaggaacgacggcccgaagttacgaaccgaccggtccgtagttaacttacgtgtaggcgaaggagtacggtcggggaaccccacggtaaaccgttactacgtaacgttacgtacggtacgggtaccgacgggggtaccgaaacggggacccgg

SEQ ID NO: 381620 - DNA, 536 bp, Homo sapiens
  misc_feature: GZ8MTXP02IRBCY.13.76.G10.1.454.CMB.2.raw
  modified_base (235)..(235): a, c, t, g, unknown or other
  modified_base (450)..(450): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggancagctccaacattggggcacattatgatgtacactggtaccagcagtttccaggagcaggtcccagactcctcatcaatacgtaacaacatccggcccgcgacggggtcccctgacccgtattcctctggcctccgaggtctcggcacctcacgcctcccgtggtcatcacgtgggcctccgacggtctggacggatggaggtctaggtaatttntttcgtgtaccgtagttcccttagtcgaacacggaccacgtcctgtaagtcgtctttcgggtagttcgggtacgggggactaacgg

SEQ ID NO: 381621 - DNA, 648 bp, Homo sapiens
  misc_feature: GZ8MTXP02GEQH2.13.76.G10.1.454.CMB.2.raw
  modified_base (431)..(431): a, c, t, g, unknown or other
  modified_base (441)..(441): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtcgtggaggaggcttgatccagccgtggggggtccctgagactctcctgtgcagcctcgtgggtcaccgtcacgtcacacctacatgagcgtcggtccgccaggcctccgagggaagggcgtggagtgcgtcttctttatttatagtagtggtagtacatactcgcagactcgtggagggccgtatccaccatctccagagacaaatccaagaacacgcttagtttcctaanaaatgaaacngacctaggaagacgaccgaatacgaccgtaccgggtaccgttagttaacttacgtggtacggacggtaaggtaaggtaccgggtaccgggggtaaaccccctaaaacggttaaaacccggtttaccaaccggtaacgttaacggttacgggggtaacccggttaccggggtaccgggggaaccccgtaaaaccgggggtaacccccg

SEQ ID NO: 381622 - DNA, 587 bp, Homo sapiens
  misc_feature: GZ8MTXP02HJV66.13.76.G10.1.454.CMB.2.raw
  modified_base (297)..(297): a, c, t, g, unknown or other
  modified_base (461)..(461): a, c, t, g, unknown or other
  modified_base (499)..(499): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggttcaccgtcagtcacacctacatgagcgtcgggtccnccgaggcctccgaggggaaggggctggagtgcgttcttcttttatttagtagttagtggtagtaccatacctccgcagacctccggtggaacgggggcctaagttccaccatcctaccagagactaattccaaagaacacgtcttgtttactacaaatgaaacngcctgagagccgatcgactacggccgttgtaacttcgngtcgacggagaggacgtaccgggggaccccaacgtaaaccgtttacaccgcgtagtacgggacgttcgcggggaccaaacgggacccg

SEQ ID NO: 381623 - DNA, 665 bp, Homo sapiens
  misc_feature: GZ8MTXP02JBR4K.13.76.G10.1.454.CMB.2.raw
tcagtcacgtactacacgaccggtgctcgatttagtcactcatacaggggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagcgtgggtcccgccaggctccgaggggaaggggctggagtgcgtctcgttttatttatagtagtggtagtaccatactcgcagactccgtgggacggggcgaacgttccaccatcctccaagtagaaacctaattcccgaaaagaaaccacgtcctttagtttaccttacaaaacttgaaaaccacggtaccctaggacgaacgcccggaagttacgaacccgaaccggtccggttaggttaactttaaccgtggtacggaccggaaggaacgggacggttaccgggggaaccccctaaacgggggtaaacccggtttaacaccgggtaactaaggtcggggtaacgtcgggtacgggggcccgaaaacgggggtaccccg

SEQ ID NO: 381624 - DNA, 677 bp, Homo sapiens
  misc_feature: GZ8MTXP02INQ9S.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggtcaccgtcagtcacacctacatgagcgtgggtcccgccgaggctccgaggggaaggggctggagtgcgttcttcttttattatagtagtggtagtaccatactccgcacgacctccgtggacggggcctattccaccatcctccgaagacgtaacaaattcccaaagaaacctaccgtcttacgttttaccttaacgaaaacgttcgaaaaccgacgacccgttacggacgtaacggaccccggtaaattcggaacccgtaaccggggtcccgttagttaacgttaaccgtggtacggaccggagggacgacggttaccgggggaaccccctaacgggtaaaaccgttacttaaccggcgttaaacgttacggggaacccgttcggtaccggggggaacccaaacgggggtaaccccg

SEQ ID NO: 381625 - DNA, 795 bp, Homo sapiens
  misc_feature: GZ8MTXP02FFY0S.13.76.G10.1.454.CMB.2.raw
  modified_base (606)..(606): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctatttaaaaggtgcccagtgtgaggtgcgagcgtggtggagtcgtggaggacggtcttgatccgacgtccgggtccggggggttccctggacgtacctccttccgtggtcgcacgtccctcgttgggtcccaccgtcacgtaccaccaacctacagtggacgtcggtcggggtccccgccgacggcctaccgggaagggggaacggggtcgtaggggtaggtcggtccgtttacctttacgtttttaagtttttaagttaagggtaggtttaggggtttaactaaccctacgtacccgtcccgacgaacggtacccgttcgggtgggggaccgggggtccctattacccacctacttcccgtaccgaacggaacgtaaacctaaacgttaacccgaaaagaaacccgtaccgtcgtttacgttttaccttaacaaaagttacgaaacnccgtacgtaggaacggacgaccgaagtccggaaaccgccgggtcgttagttacgttacgtgggtacgacggaaggacggtacgggtcccgggggaacccctaaacggggttaaaacccttaccgtaaccgtaacgttaacggtacgggtaccgtcgggtaccgggggaaccgaaccggggtaaccccgg

SEQ ID NO: 381626 - DNA, 748 bp, Homo sapiens
  misc_feature: GZ8MTXP02GWKOH.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttattttaaaaggtgcccagtgtgaggtgcagcgtggtggagtctggaggaggcttgatccagccgtgggggtccctgagactctcctgtgcagcctcgtgggttcaccgtcagtcacacctacatgagcgtcgggtccgccgaggcctccggaagggggaacggggcgtgggagtcggcggtttctttacgtttttaatttaagttaaggttaggttacggttaagtaacccgtaacgttaccgtccgacgtaacggtacccgttcccgggtggggaacgggggtccctaactttacccgaaccctacgttccctacccgaaagaacgtaaacctaaacttaccccgaaaaggtaaaccctacgtctttagttttaccctaacaaaaagttcgaaaacctggtccctaggaacgaccggacccgtaagtaccggaaacccgtaccggggtacccgtttagttaacgtttaccgtggtacgacggtaaaggaggtacggtacccgggggacccaaacgggttaaacgtttaccgacgtaacgttaggtacgggtaccgtcggtacgggggaccccaaaagggggtcccc

SEQ ID NO: 381627 - DNA, 636 bp, Homo sapiens
  misc_feature: GZ8MTXP02F5JUL.13.76.G10.1.454.CMB.2.raw
tcagtcacgtactacacgaccggtgctcgatttagtcactcatacagggggggagaggagcccagcactgggattccgaggtgtttccattcggtgatcagcactgaacactgaggactcaccatggagttttggctgagctgggttttccttgttgctattttaaaggtgcccagtgtgaggtgcagctggtggagtctggaggaggcttgatccagccgtggggggtccctgagactctcctgtgcagcctcgtgggtcaccgtcagtcacacctacatgagcgtgggtcccgccgaggcctccgaggggaacggggcgtggagtgcgtcttcttttatttatagtagtggtagtacatacctcgcagactccgtggacgggccgattccaccatcctccaagacgaaactaacttacccgaaagaaaccacgtcttagttttacctacaaaattcgaaacacgccttaggagacgacccggtaatcggaaccgacgggccgttagtacgttacgtcgggcgacggaggacggtacggtaccggggaaccctaaacgggttaaccgttaacgtacggtaacgttacggtacgggtaccggtcgggtaccgggggaaccgtaaacggggtacccg

SEQ ID NO: 381628 - DNA, 573 bp, Homo sapiens
  misc_feature: GZ8MTXP02GP9VS.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagctgggtccgccaggctccgaggggaaggggctggagtgcgtcttctttttattatagtagtgttagacctatacgtcgacagacctccggtggacgggtccgattcaccatcctaccagagaactaataccaaagaacacgcttgtttactacaaatgaaacagcctagagacgccgatcgacgacggtccgtagtacttacgtgtgacgagagacgtcggggacccacgtaaacgttacgacgaacgttaacgcggtacgtcggtcggggaccgaacggggacccg

SEQ ID NO: 381629 - DNA, 630 bp, Homo sapiens
  misc_feature: GZ8MTXP02JTH5F.13.76.G10.1.454.CMB.2.raw
tcagtcacgtactacacgaccggtgctcgatttagtcactcatacagggggggagaggagcccagcactgggattccgaggtgtttccattcggtgattagcactgaacacagaggactcaccatggagttttggctgagctgggttttccttgttgctattttaaaggtgcccagtgtgaggtgcagctggtggagtctggaggaggcttgatccagccgtgggggtccctgacgactctcctgtgcagtcctctgggtcaccgtcagtcacacctacatgacgcgtggcccgcgaggcctccgaggggaggctggagtgcgttcttcttttattagtagtagttggtagtacactactccgactagacctccggtaggacgggggtccaatttcccaaccctattcccgacccgaaagaacgaacctaaacttacccgaaagaaccacgtacttcggtttacttaaccaaaagttagaaccaggtacctaggagaacgaccgatagaccgacggtcgtagttacttacgtgtcgacgtagacggtagacgggggaccccaacggtaaccgttaacctacggactaagttcggaacgttcggacggggaccgaacggacccgtaaccgg

SEQ ID NO: 381630 - DNA, 609 bp, Homo sapiens
  misc_feature: GZ8MTXP02GJ6GX.13.76.G10.1.454.CMB.2.raw
  modified_base (453)..(453): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggtcaccgtcagtcacacctacatgagctcgggtccgccaggctccgaggggaaggggctggagtgcgtcttcttttatttatagtagtggtagtaccatactcgacagacctcgtggacggggcctagttccacctatcctccaagagactaaacttccaaagaaccacgcttgtttactacaaaatgaaaacngacctagagacgccgatacgaccgacggccgttagtacttaactggtcgacggagacggtacgtccgggggaccccaaacgggtaaaccgtttaccaacccggaagttaacgtcgggtaaccgttcggacgggggacccgtaaacggggacccccg

SEQ ID NO: 381631 - DNA, 552 bp, Homo sapiens
  misc_feature: GZ8MTXP02IX3BT.13.76.G10.1.454.CMB.2.raw
  modified_base (253)..(253): a, c, t, g, unknown or other
  modified_base (396)..(396): a, c, t, g, unknown or other
  modified_base (433)..(433): a, c, t, g, unknown or other
  modified_base (449)..(449): a, c, t, g, unknown or other
  modified_base (472)..(472): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctctgtgcagcctntgggttcaccgtcagtcacacctacatgagcgtgggtcccgccaggcctccgaggggaggggctggagtgcgtcttcttttattatagtagtggtagtacatactcgcagactccgtggacgggcgtactcaccatctcaganacaatcaaagacacgcttgtttctacaaatgaaaccngacagacgacgacganacgacgacggtcgtagtattagngagacgagagacggtaccggaccaacgtaacgttacacgaacgtaggtacggtacgtcggaccgggaccgaacggtaccg

SEQ ID NO: 381632 - DNA, 645 bp, Homo sapiens
  misc_feature: GZ8MTXP02ILCOZ.13.76.G10.1.454.CMB.2.raw
  modified_base (543)..(543): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggctgatccagccgtgggggtccctgagactctcctgtgcagcctcgtgggttcaccgtcagtcacacctacatgagcgtcgggtcccgccgaggcctaccgaaggggaaggggcgtggagtgcgttctttctttttaattagtagtagtggtatacctatacctccgcacgtaccgtccggtggggacgggaccgtacgttaccaacccgtatcctacccgaagagaacctaattaccaaaggtaaccacggtcctttagtttaccttaaacaaaagttcgaaaacacgtacctaggagacgccgaatcgacgacgggtcttagttacttacgnggtagacgaggtagacggtcgggggaacccctacggtaaaaccgtttcaacggtcctaagtcggggacgttacggtacggggacccgaaacggggtaccccg

SEQ ID NO: 381633 - DNA, 629 bp, Homo sapiens
  misc_feature: GZ8MTXP02F02Q9.13.76.G10.1.454.CMB.2.raw
  modified_base (407)..(407): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcgtggtttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtcgggtcccgccgaggcctccggaggggaggggctggagtgcgttcttcttttatttatagtgtggtagtacatactccgcacgacctcgtggacggggccgattccaccatcctccaganacaataccaaagaacacgcttgtttactacaaaatgaaacagcctaggagacgacccggataccggaaccgaccgggtaccgttagttaatttacgtggtcggacggaaggaggtacggtaccgggggaacccctaaacgggtaaaaccgtttaccgtaaccggtaacgttaaggtacgggtaccggtcggtacgggggaacccgaacgggggtaacccccg

SEQ ID NO: 381634 - DNA, 526 bp, Homo sapiens
  misc_feature: GZ8MTXP02F5G30.13.76.G10.1.454.CMB.2.raw
  modified_base (402)..(402): a, c, t, g, unknown or other
  modified_base (419)..(419): a, c, t, g, unknown or other
  modified_base (428)..(428): a, c, t, g, unknown or other
  modified_base (455)..(455): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctcgtgggtcaccgtcagtcacacctacatgagctgggtccgccaggctccgagggaggggctggagtgcgtctcttttattatagtagtgtagtacatactccgcagactcgtgagggcattcaccatctcagagacaatccaagacacgntgttctcaaatgaaacngcctagagngaccgatgaccacggccgtgtattacngtgacgtagagagtcggggaccacgtaacgttacacgctacgcgggtacgtcgtcgggaccgaacggaccg

SEQ ID NO: 381635 - DNA, 650 bp, Homo sapiens
  misc_feature: GZ8MTXP02F5ETP.13.76.G10.1.454.CMB.2.raw
  modified_base (239)..(239): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcacgcccgcctcagtgtcgtcggggccccagggcagacggtcaccatctcctgcacgtgggancagctaccaacagttgggcacgtattatgatgtactacgtcggtaccagctagtttccgaggacgcgacggtcccagaccttccacatacaaataccgtaaacaacaacgtccggacccgacgtacggggtccctagacccgtattcctcgtacggtcctccgtaggttcctcggcctaaccgtccgaccgtcccctcccgttggtacctaacgtccgaccggtcggggtaccctaccggacggtcgtacgggtagggtaacgttcggaacgggttcttaggttaactttacgtttccgtacgtacccgtacgttacccgttagtaccgaacgcgtaccgtacgtccgttaggtcgttccgttacgtttaccggggttacggttacccgggggaccggggtaccctacggg

SEQ ID NO: 381636 - DNA, 567 bp, Homo sapiens
  misc_feature: GZ8MTXP02H1PXT.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctcgtgggttcaccgtcagtcacacctacatgagctgggtccgccgaggcctccgaggggaggggctggagtgcgtcttcttttattatagtagtggtagtacatactccgcagactcgtggaggggccgattccaccatctccagagacaataccaagaacacgcttgtttctacaaatcgaaacagcctagagacgaccgatcgacgacggtccgtaggtattacgtgtgcgagagagtcgggggacccacggtaaaccgtttacgacgccgtagtcgggtacgtcggtacggggccaaacggggtaccccg

SEQ ID NO: 381637 - DNA, 514 bp, Homo sapiens
  misc_feature: GZ8MTXP02HOJXS.13.76.G10.1.454.CMB.2.raw
  modified_base (406)..(406): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagccggccctcgacggggactccccccgtgagcgtattctcgttgggcctccaaactcgtagggaacctcgacgcccactctcgaccatcagcgggacccaggctagngatgaggctagactattactgtcgaggcggtaggcagcagcacgtcgccgctatcgtcgtcggaacgtcggaaccgtaggtaccgaccgtccgtaacgtcacgacccg

SEQ ID NO: 381638 - DNA, 694 bp, Homo sapiens
  misc_feature: GZ8MTXP02IHGMR.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcaccacctacatgagcgtcggggtccgccgaggcctccgaggggaaggggcgtggagtggcgttcttctttttatttatagtagtggtagtaccatacctcgcagactcgtggacggggcctattccaccatcctccaagagactaattaccaaagaacccacgtcttagttttacctaacaaaagtcgaaaactacggccttaggaagacgacccggtaatcgggaaaccacccgggtaccggttagttaaacttaccggtgtacggccggaaaggtaacgggaacggttacccggggggaacccccttaaaacggggtaaaaccccggttttaacgtaacccgggtaaccgtttaagggtacgggggtacccggttaccgggtaccgggggggaaccccaaaacgggggggtaccccccg

SEQ ID NO: 381639 - DNA, 649 bp, Homo sapiens
  misc_feature: GZ8MTXP02G3209.13.76.G10.1.454.CMB.2.raw
  modified_base (491)..(491): a, c, t, g, unknown or other
  modified_base (553)..(553): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtggttcaccgtcagtcacacctacatgagcgtgggtccgccaggctaccgaggggaagggcgtggagtgcgttcttactttttatttataggttagtacggtagtacatacctcgcaacgtccgtccggtgggacggggcctattacgacctattcctacgaaggaacactaaaccgttacaaaacggtaaccacgttctttacgtttacctaaagtaaaactcggtaaaaccncgtaccgttaagggacgaacggcccgtaagtcggaacgaccgggtcgttagttacgttacgnggtacgagacggtaaggacggttccgggggaaaccctacggttaaaacgtccgaacgtacgtacggtaccggacggttcgggaacggggaacccgg

SEQ ID NO: 381640 - DNA, 746 bp, Homo sapiens
  misc_feature: GZ8MTXP02IQNJV.13.76.G10.1.454.CMB.2.raw
  modified_base (564)..(564): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggtcaccgtcagtcacacctacatgagcgtggtccgccgaggcctccgaggggaaggggcgtggggtagtcgtcgttctttacgttttattagttaggttggtacggttacgtactacttacccgtcgacgtaccgtccggttccgggtacggggtaccgggtaccgttacctaccctaactacttaccccgagaacggaaaccgaaacttacccgtaaaacgaaaaccgccgtaccggtttactttttcgttaccctaaaagtaaagtaaccggaacgccctagggtaagacggaccgacgtanaggtacccggtaccgtggtttaattaacgtcgttacgggacgaacgttacgggggaactacggggggtaccccctaaaaaccccgggtccgtttaaaaacggttaacccgtaacggttaacggttacgggggtaaaccggtccgggggtttaagggggacccccgggtaaaaaccccggggg

SEQ ID NO: 381641 - DNA, 617 bp, Homo sapiens
  misc_feature: GZ8MTXP02IIJLL.13.76.G10.1.454.CMB.2.raw
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagcccaccctcagtgtccgtgtccccaggacagacagccagcatcacctgctctaggaaataatggacagaataaatatacttctgtatcagcaagaatcaggccacgtcccctgtcgctggtcatctatacaagactgaccaaggccgccctagacgggacctccccgtgacgcgatttccactcgggacctcctaaacgttcgtacgggaactcaacgcctaactctacgacctactcgacggcccggggaaccagggacccttaaggacggtaacgtagggtacggtcgttaacgtaacttacgttacgtcgtacggtacgggtacggtacggacgacggacgacgaccgtacgtccggccgtagttacgttcgttaccggttaaccggaaccggtaacgggtaaacccgtaacggtacccgtaacccgttaccgtaacgaccgtaacccg

SEQ ID NO: 381642 - DNA, 580 bp, Homo sapiens
  misc_feature: GZ8MTXP02ISSUL.13.76.G10.1.454.CMB.2.raw
  modified_base (169)..(169): a, c, t, g, unknown or other
  modified_base (234)..(234): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctctatgagctgactcagccaccctnagtgtccgtgtccccaggacagacagccagcatcacctgctctaggaaataatggcagataaatntacttctggtatcagcagaagtcaggccagtcccctgtgctggtcattctatacaagatcgaccaagccgccctgacgggtactcccctgacgtcgtacttcgtctcggcctaccaacgtctacgggtaacctcgacgccacgtctacacaactcgacggaccggacccgaggcctagtggagtacggaggtctaggtactttaagttacgtacggtcgacgggtcggtaggggaacacggaccgacgggacctcggtaccgccggtactagttcggttaccgttaccggaacgtacgggaaccgtaacggtaccgtaaccgtaccgtaaacgccgacgaaacccg

SEQ ID NO: 381643 - DNA, 599 bp, Homo sapiens
  misc_feature: GZ8MTXP02JYMRA.13.76.G10.1.454.CMB.2.raw
  modified_base (368)..(368): a, c, t, g, unknown or other
  modified_base (459)..(459): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtggggttcaccgtcagtcacacctacatgagcgtgggtccgccaggctccgaggggaacggggctggagtgcgttcgttctttttatttatagtagtggtagtaccataccncgcagacctcggtggacgggggccattcaccatctccagacgacaattcccaaagaacacgcttgtttcttaacaaatgaaactgcctagngacgccgatcgacgtacggccgttgtacgttacgtggtagacggaggacgtacggtccgggggtacccaacgggtaaaccgtttaccgacgtccgttaaggtcgggtacgtcggtacgggggacccgaacggggaccccg

SEQ ID NO: 381644 - DNA, 573 bp, Homo sapiens
  misc_feature: GZ8MTXP02FR22M.13.76.G10.1.454.CMB.2.raw
  modified_base (170)..(170): a, c, t, g, unknown or other
  modified_base (223)..(223): a, c, t, g, unknown or other
  modified_base (231)..(231): a, c, t, g, unknown or other
  modified_base (238)..(238): a, c, t, g, unknown or other
  modified_base (242)..(242): a, c, t, g, unknown or other
  modified_base (265)..(265): a, c, t, g, unknown or other
  modified_base (278)..(278): a, c, t, g, unknown or other
  modified_base (284)..(284): a, c, t, g, unknown or other
  modified_base (349)..(349): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagcccacctnagtgtccgtgtccccaggacagacagccagcatcactgctatagaaataatgnagataatntacttcngtancagcagagtcagccagtccctgngctgatcatacanacaagncgacgacgccgccagacggccctccgagacgctactctcgtcgcctactacgtcggtacgtaacncgacacctactcgacactacgaccgaccggaccgacgagtacgtaggagtagacggacgtacgtacgtacgttacgtacgtacggacggacgggtacggacggacgacgacgaccgtaccgtaccgtccgaccttacgttacggttaccgtaccggtaacggtaaccgggtaaccggtaaaccgtaccgtacccggtaacccgtaacgtaccgaccgaacccgg

SEQ ID NO: 381645 - DNA, 742 bp, Homo sapiens
  misc_feature: GZ8MTXP02FR32R.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctctgtgcagcctcgtggtcaccgtcagtcacacctacatgagcgtcgggtccgccgaggcctccggaggggaacggggcgtagggaggtcggtccgtttctttactttttattttagtaaggttaggttagggttaagtaaccgtaactacctccggactacggaccgttccggtcgggacgggggaccgtacttacccacctactcctacccgaaagacgtaaacctaaacttaacccgaaaacggtaaaccctacgtcccgttttaggttttacccttaaacgaaaaacttacggtaaaaccacgtacccgttaaggaacggtacggaacccggtaattaccgggaaaccggtaccgggtaccgtttagttaaccgttacgtgggtacgacggaaggaggaacggtccgggggaaccctaaacgggaaaccgttacgtacggaacgttacggtacgggtaccggtcgggtaccggggaaccggtaaacggggaaccccg

SEQ ID NO: 381646 - DNA, 597 bp, Homo sapiens
  misc_feature: GZ8MTXP02I5VDL.13.76.G10.1.454.CMB.2.raw
  modified_base (299)..(299): a, c, t, g, unknown or other
  modified_base (461)..(461): a, c, t, g, unknown or other
  modified_base (475)..(475): a, c, t, g, unknown or other
  modified_base (487)..(487): a, c, t, g, unknown or other
  modified_base (527)..(527): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatccagccgtgggggtccctgagactctcctgtgcagcctcgtcgggtcaccgtcagtcacacctacatgagcgtcgggtcccnccgaggcctccgaggggacggggcgtgggagtggtcgttcgtttctttttatttagtagttaggtggtaagtacctactaccgtccgactacgaccttcggtggggacggggccgtacttaccaccgtatcctaccaagacgtaaccaattaccaaagaacncgtcttgttactanaaagtgtaaacngcctagagaccgcagtacgcgacggtcctagttcttacgngtgacgaggagcggtaccggacctacggtaactcgacgtgtacggacggtacgtcggacggacgacggcg

SEQ ID NO: 381647 - DNA, 610 bp, Homo sapiens
  misc_feature: GZ8MTXP02GPB1J.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagctgggtccgccaggctccgaggggaaggggctggagtgcgtcttcttttatttatagtagtggtagtaccatacctcgcagactccggtggacggggccagttccacctatcctcccgaagacgaactaacttacccgaaagaaccacgtcttgttttactacaaaatcgaaacagcctagagagcccgatcgaccgacgggtccgttagtacttacgtgtcgacggaagaggacggtaccgggggaccccaacggtaaaccgttacctaccgtaacgtaagtcggggtaccgtcgggtacgggggaccgaacggggaaccccg

SEQ ID NO: 381648 - DNA, 724 bp, Homo sapiens
  misc_feature: GZ8MTXP02JO67W.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtggggggtccctggagactctcctgtgcacgcctcgtcgggttcaccgtcacgtcacacctacatgagcgtcgggtccgccgaggcctcggaaggggacggggcgtaggaggtcgtcgtctttactttttatttagtagtagtaggtagtaccgtataccgtccgacacgtaccgttccggtggggacgggggccgtacttccgaacctacttcctacccgaagaacgtaaacctaaacttaacccgaaaacggtaaacccacggttacctttacgtttttacccttaaacctaaaagttacgaaaaccgacggtacccgttaggaacggaccgtaccgaaagtacggaacccggacgggtacccgttagttaacgttaccgtagtacggacgaaggtacggtaacgggtcggggtaaaccccgaacggtaaaccgttaaccgacgtaaccgtaggtacggtaccggtacggtaccggggacccgaaacgggtaaccccgg

SEQ ID NO: 381649 - DNA, 690 bp, Homo sapiens
  misc_feature: GZ8MTXP02HPT0B.13.76.G10.1.454.CMB.2.raw
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagcccaccctcagtgtccgtgtccccaggacagacagccagcatcactgctctaggaaataattggacagaataaatatacttcctgtatcagcagaagtcaggccagtcccctgtgctggtcatctatcaagatgcaaagccggaccctcgacggtactcccctgacgcgtattcctcgtggtcctaccctaaacttccgtacgggggtaaaccctcgaaccgccctaaccgttcctacgaacccacgttccgaacggacccggggtaaccccacggggtacctaaagtcgggtaaagtcgggaacgggtacccgttaggtaaaccctttaagttaaaccgttcggttaacggaacggggtccggggttacggggaaccgacggacggaaacgtaccgtaaccgtccgggcccccgttagttaaacgttcggttccgtttaaccggggaaccgtttaaccgggggaaaccctaaacggggtttacccaaccccggtttaaccgtaaccgggttacaaacccccggg

SEQ ID NO: 381650 - DNA, 601 bp, Homo sapiens
  misc_feature: GZ8MTXP02HAKA8.13.76.G10.1.454.CMB.2.raw
  modified_base (390)..(390): a, c, t, g, unknown or other
  modified_base (396)..(396): a, c, t, g, unknown or other
  modified_base (406)..(406): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctcgtgggttcaccgtcagtcacacctacatgagctgggtccgccaggcctccgaggggaggggctggagtgcgtcttcttttattatagtagtggtataccatactcgcagactcgtggcggggcattcaccatcnccaganaacatcaaanacacgtcttgtttctacaaatgaaactacgacctaggaagacgacccgtagacgaaccgaccgggtaccgttagttaacttaccgtgtcggacggaggtaggacggttacgggggacccctaaaacggtaaccgttaccgtaacgcgttaaagtcgggtaccgtcggggacggggacccgaacggggtaaccccg

SEQ ID NO: 381651 - DNA, 643 bp, Homo sapiens
  misc_feature: GZ8MTXP02FP3TO.13.76.G10.1.454.CMB.2.raw
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataaattggcagataaatatacttctgtatcagcagagtcaggccagtcccctgtgctggtcatctatcaagatgccaagccggccctcgaggggacctccccgtgacgcgatttcctctcgggcctaccaaactcgtacggggaaactcgacgcccactcctacgacccatccgacggcccggggaacccagggtcctaagtcgggtaagttggaacgggtccgtagtaaccgtttaagtttaaccgtcgttacgacggggtacggttacgggggaacaacggcgaaacggccgtaaccgttcggccccgtacgttaacgttccgttaccggttaccggggtaaaccgttcgggggaaaccccgtaaacggggttaccccgtaacccgttacccgttaaacggttacccgaaaaccccggg

SEQ ID NO: 381652 - DNA, 638 bp, Homo sapiens
  misc_feature: GZ8MTXP02H1720.13.76.G10.1.454.CMB.2.raw
  modified_base (333)..(333): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtccctgagactctcctgtgcagcctctgggttcaccgtcagtcacacctacatgagcgtgggtcccgccaggctccggaggggaggggcgtggagtgcgtcttntttttattatagtagtggtagtacatacctcgacagtaccgtccgtgggacggggcctagttccacctatcctcccgaagaagaacctaagttaccaaaggaactaccggtcttagtttcctaacaaatcgaaacgtcgacctaggaacgaacggtcccgaagtcgaaccgacgggtccgttaggttacttacgtggtacgcggaaggtagacgtcgggggaaccccaacgggtaacgtttaaccacggtaaccgtacgtacggggaccgttacggaccgggggacccgaaaagggggacccccg

SEQ ID NO: 381653 - DNA, 530 bp, Homo sapiens
  misc_feature: GZ8MTXP02JG9GO.13.76.G10.1.454.CMB.2.raw
  modified_base (382)..(382): a, c, t, g, unknown or other
  modified_base (387)..(387): a, c, t, g, unknown or other
  modified_base (422)..(422): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggtcaccgtcagtcacacctacatgagcgtgggtccgccaggctccgaggggaggggctggagtgcgtcttcttttattatagtagtgtatacatactcgcagactcgtggagggcctatcacatcncaganacatccaagaacacgctgtttctacaaatgaaacngcctagagagccgatcgacgacggccgtgtacttacgtgtgcgagagacgtcggggacccagtaacgttacacgtctagtcggacgtcgtacggggaccaaggacccg

SEQ ID NO: 381654 - DNA, 627 bp, Homo sapiens
  misc_feature: GZ8MTXP02GPB5E.13.76.G10.1.454.CMB.2.raw
  modified_base (451)..(451): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtgggtcccgccgaggcctccgaggggaacggggctggagtgcgtcttcttttatttagtagtagtggtatacctatactccgcacgacctccggtggacggggccattccacctatcctccagagactataccaaagacacgcttgtttctacaaatgaaacngtacctgaagacgccgtaagtcggaaccgacccgggtcggttacttacgtttacgtggttacggcggaaaggtaggaacgttccgggggacccctaacgggtaaaccgtttacctaccggcttaaggtcggtaaccggttccgggtacgggggaacccgtaaacgggggaaccccg

SEQ ID NO: 381655 - DNA, 639 bp, Homo sapiens
  misc_feature: GZ8MTXP02HSFKZ.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtcgggtcccgccgaggcctccggaaggggaacggggcgtggagtcgcgttctttctttttaattagtaagttagtaggttagtacctatacctcgcacgtaccgtcggtggacggggcctacttccgacctatcctaccgaagaacgaactaaacgtaccaaaggaacctacggtactttcgtttacttaacaaaattcgaaaactcgtaccttaggaacgacgaccgatacggaaccgacgggtccgtagttaattacgtgtagacggagtagacgtcgggggacccaacggtaaccgttacacggtaacttcgacgggtaccgtcggtacgggaccgtaaacggaccccg

SEQ ID NO: 381656 - DNA, 663 bp, Homo sapiens
  misc_feature: GZ8MTXP02JP8UC.13.76.G10.1.454.CMB.2.raw
  modified_base (254)..(254): a, c, t, g, unknown or other
  modified_base (411)..(411): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaagtgcccagtgtgaggtgcagctggtggagtctggaggaggcttgatccagccgtggggggtccctgagactctcctgtgcagcctntgggttcaccgtcagtcacacctacatgagcgtcgggtccgccgaggcctccgaggggaaggggctggagtgcgtcttctttttattatagtgtggtagtaccatactccgacagactccgtgggacggggccgtattccacctatctaccaggtanacctaattccaaagaaccacgtcttagtttactaacaaaattcgaaaactcgtccctaagggaacgacggccccgtaagtcggaaccgacccgggtccggttaagttaatttaccgtggtacggtaccggaaggaggtaaacgggttcccgggggaccccctaaacggggttaaccgttaacccgtacggtaaccttaggtaccgggtaaccggtccgggtcgggggaaccccgaaacgggggtaacccccg

SEQ ID NO: 381657 - DNA, 737 bp, Homo sapiens
  misc_feature: GZ8MTXP02HI7H4.13.76.G10.1.454.CMB.2.raw
  modified_base (247)..(247): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtctggaggaggcttgatccagccgtgggggtccctgacgactctcctgtncagcctgtgggttcaccgtcacgtcacacctacatgagcgtcgggtcccgccgacggcctaccggaggggaacggggcgtgggagtggtcgttctttactttttattagtaggtaggtggtagtaccattaccgtccgacacgtaccgtccgggtaggacgggggtacctactttacccacctactacctacccgaaagtacaaactaaaccttccgaaaagtaaccgtaccgtctttacggtttttacctaaacctaaaagttacgaaaaccgtcgtacccgttaggaaacggacggaacccgtaagtcggaaacccggtaccgggtacccgtttagttaaacttttaccgggaggtacggacggaagggtacgggtaccggtacccgggggaaacccctaaacggttaacccggttaaccgtacggtaacgttacggtaccgggtaccggttaccggggaccggggaaacccggtaaacgggaccccg

SEQ ID NO: 381658 - DNA, 554 bp, Homo sapiens
  misc_feature: GZ8MTXP02GEZ7E.13.76.G10.1.454.CMB.2.raw
  modified_base (362)..(362): a, c, t, g, unknown or other
  modified_base (432)..(432): a, c, t, g, unknown or other
  modified_base (443)..(443): a, c, t, g, unknown or other
  modified_base (483)..(483): a, c, t, g, unknown or other
tcagtcacgtactacacgaccggtgctcgatttagtcactcatacagggggggaggaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttggatccagccgtggggggtccctgagactctcctgtgcagcctctgggtcaccgtcagtcacacctacatgagcgtcgggtcccgccaggctccgaggggaaggggctggagtgcgtcttctttattatagtagtggtatacatactcncagactcgtggagggccagttccacatctccaagacgaactaatacccaaagaacacgcttagtttctanaaaatgaaacngcctagagcgaccgatacgacgacgggtctagtattacgngtgacgagagacgtcgggaccaacgtaacgtcaacgctaagtcggacgtcgtacggggaccaaggggaccc

SEQ ID NO: 381659 - DNA, 700 bp, Homo sapiens
  misc_feature: GZ8MTXP02JTOHX.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgtcagctggtggagtctggaggaggcttgatccagccgtgggggtccctgagactctcctgtgcagcctcgtggttcaccgtcagtcacacctacatgagcgtcgggtcccgccagggcctccggaggggaaggggcgtgggagtggcgttcttcttttatttatagtagtggtagtacatactcgacagccgtccggtggacggggccgtattccgacctactcccgtacgaaggaacgtaacctaaacgttaccgaaaacgtaaccgtaaccgttcgtttacgtttacctaaacgtaaaagtaccgaaaacgacgttcccgtaaaggacgggtaaaccgacccgaagttacggaacccgggtacccggtccgttaagtttattaccggttggacggacggtaaacggacggtacgggtcccgggggaaaccccctaacggttaaaccggttaacgaaccggtacgttacgggtacgggtacccggttacggggacgggggtaaaccccgg

SEQ ID NO: 381660 - DNA, 591 bp, Homo sapiens
  misc_feature: GZ8MTXP02IX6CD.13.76.G10.1.454.CMB.2.raw
  modified_base (450)..(450): a, c, t, g, unknown or other
  modified_base (490)..(490): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtgggtcccgccaggcctaccggaggggaggggctggagtgcgttcttcttttatttatagtagtggtagtaccatactcgcagtacctcgtggacggggcctattccacctatcctcagacgacaacttacaaagaccacgtcttgtttctacaaatgaacngacctagagacgcgatcgacgacggccgtagtacttacgngtcgacggagagtacggtcgggggacccctaacggtaaccgttaccgtaacgtcgtaggtacggtacgttccgggacggggtacccgaacggggtaccccg

SEQ ID NO: 381661 - DNA, 648 bp, Homo sapiens
  misc_feature: GZ8MTXP02H5GYM.13.76.G10.1.454.CMB.2.raw
  modified_base (296)..(296): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggacagataaatactacttcctgtatcagcagaagtcaggccacgtcccctgtgctggtcatctatcaaagntcgaccgaagccggaccctcgagggtactcccccgtagacgtcgtatttccacgtcggcctaccaacttccgtagggaacctcgacgtcccactcgtacgaccctactccgacgggacccggaaccccgtaggtcctaaagtgggaatacgggtaggtaccgtagtaacgtttaacgtacgttcggaccgtaagggtccggtacgggaacgaacggccgaaacgcccgtaacgtccggtaccccgtgttaacgttcggttaccgtaaccgggtaaccggtacgggaaacccggtaaacgggttaccctaaacccggtaccgttaaccggtaccgtaacccggaaacccccgg

SEQ ID NO: 381662 - DNA, 591 bp, Homo sapiens
  misc_feature: GZ8MTXP02G5XB3.13.76.G10.1.454.CMB.2.raw
  modified_base (443)..(443): a, c, t, g, unknown or other
  modified_base (451)..(451): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagctgggtccgccaggctccgaggggaggggctggagtgcgtcttcttttattatagtagtggtagtaccatacctcgcagtactccgtggaggggccattccaccatctcccagagaacaattccaaagaaccacgtcttgtttctacaaatgaaacngcctgagngccgatcgacacggccgtagtatacgtgtcgacgaggagacggtaccgggggacccctaacggtaaaccgtttacgtaaccgtcgttaacggtcggggtaaccggtcggtacgggggacccgaaacgggggtacccccgg

SEQ ID NO: 381663 - DNA, 585 bp, Homo sapiens
  misc_feature: GZ8MTXP02JQXT3.13.76.G10.1.454.CMB.2.raw
  modified_base (400)..(400): a, c, t, g, unknown or other
  modified_base (420)..(420): a, c, t, g, unknown or other
  modified_base (440)..(440): a, c, t, g, unknown or other
  modified_base (481)..(481): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtgggtccgccaggctccgaggggaggggctggagtgcgtcttctttttattatagtagtggtagtaccatactccgcagactccgtggaggggccgattcaccatctccaganacaattccaaagaacacgtntgtttctacaaatgaaaccngcctaggagacgacgatcgacgaccggtcgtagtacttcgnggtacgacgaggacggacgggtaccggggacccctaacggtaaccgttacgacgtaacgttacggtacgggtaccgtcgggacggggaaccgaaacgggtcccg

SEQ ID NO: 381664 - DNA, 750 bp, Homo sapiens
  misc_feature: GZ8MTXP02JB0I6.13.76.G10.1.454.CMB.2.raw
  modified_base (249)..(249): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcngcctcgtggtccaccgtcagtccacacctacatgacgcgtcgggtcccgccgacggcctccggaggggaaggggcgtgggagtgtcgttctttactttttatttagtagttaggtaggttatacctactactccgacacgaccgttccggtgggacgggggtccctagttacccaacccgtacttccgtacccgaaggaactaaacctaaaccgtttacccgaaaaggaaaaccctcgtacccgtttagttttacccttaaacaaaagttacgaaaccacggtacccgtagggaacgaccgtacccggtaataccgggaaccgtaccggggtaccgttagttaacgttaccgtgggtacgacgggtaaggacgggtaacggggttaccggggaacccccgtaaaacggttaaaccccggtttaacgtaccggtaacgttacggttacggggtaacccgggttcggtaccggggggaaaccccgaaacgggggtaacccccg

SEQ ID NO: 381665 - DNA, 711 bp, Homo sapiens
  misc_feature: GZ8MTXP02JNER9.13.76.G10.1.454.CMB.2.raw
  modified_base (602)..(602): a, c, t, g, unknown or other
tcagtcacgtactacacgaccggtgctcgatttagtcactcatacagggggggagaggagcccagcactgggattccgaggtatttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtggggttcaccgtcagtcacacctacatgagcgtcgggtcccgccgaggcctccggaaggggaacggggcgtgggacgtggccgtttctttctttttaagtttagtagttaggtaggttaacgtaacctaacgttacctcccggactaacggtacccgttccgggtggggacgggggaccctaactttaccgaaccctacttccctacccgaaagaccgaaactaacttaccaaaaggaaccctacgtcctttacgttttacctaacaaaagttcgaaaactcgtacccgaggaacgacgacccggataccggaaccgaccggggtccttaggttaactttacgggnggtacggacggaggacggtacgggtaccgggaaacccgtaaacgttaaccgttacgacgtaacgttacggtaccgggacggtacgggaccgggaaccggaacggacccg

SEQ ID NO: 381666 - DNA, 583 bp, Homo sapiens
  misc_feature: GZ8MTXP02GC39I.13.76.G10.1.454.CMB.2.raw
  modified_base (360)..(360): a, c, t, g, unknown or other
  modified_base (485)..(485): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggtcaccgtcagtcacacctacatgagctgggtcccgccgaggcctccgaggggaggggctggagtgcgtcttcttttattatagtagtggtagtaccatacnccgcagacctcggtggacgggggccattccaccatctaccagagaccaattccaaagaacacgtcttgtttacctacaaatgaaacagcctgagacgaccgatcgaccacggccgtgtattacgnggtagacgagagacggtcgggacccctaacggtaaaccgttacgtacgaaccgttagacgggtaccgtcggtacgggggaccctaacggggaaccccg

SEQ ID NO: 381667 - DNA, 646 bp, Homo sapiens
  misc_feature: GZ8MTXP02HZH3R.13.76.G10.1.454.CMB.2.raw
  modified_base (362)..(362): a, c, t, g, unknown or other
  modified_base (366)..(366): a, c, t, g, unknown or other
  modified_base (457)..(457): a, c, t, g, unknown or other
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttccaccgtcagtcacacctacatgagcgtgggtccgccaggctccgaggggaaggggctggagtgcgttcttctttttattatagtagtgtacgtacatacnccgnacgactcggtgagggccattccacatcctacagacgaactaacttacccaaagtaaccacgtctttagtttacttacaaaagttcgaaacncgtcccgttaggaacgacggacccgtaagtcggaacccgtacggggtacccgtttaggtaaactttaccgtgggttacgaccggaaaggacgtacggggttccggggacccctaaaacggtaaccgtttaccaaccggtcctttaaagccggggtaaccgttcgggtacgggggaacccaaaccggggg

SEQ ID NO: 381668 - DNA, 614 bp, Homo sapiens
  misc_feature: GZ8MTXP02FE7FY.13.76.G10.1.454.CMB.2.raw
  modified_base (366)..(366): a, c, t, g, unknown or other
  modified_base (456)..(456): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctattttaaaaggtgcccagtgtgaggtgcagctggtggagtcgtggaggaggcttgatccagccgtggggggtccctgagactctcctgtgcagcctcgtgggtcaccgtcagtcacacctacatgagcgtcgggtcccgccgaggctccgaggggaaggggctggagtgcgtcttcttttatttatagtagtggtagtaccatacncgcagacctccggtgacggggccattccacatcctacaagacaactaattaccaaagaacctacgcttgtttactacaaaatgaaaaccncgacgagacgacgacgagtccgacgtacggtcgttagtattacgtggacggacggaaggacggtacgggtacccggggaaccctaaacggttaaccgtactacggtaacgtaacggtacgggaccggtcgggtaacggggacccgaacggggaccccg

SEQ ID NO: 381669 - DNA, 624 bp, Homo sapiens
  misc_feature: GZ8MTXP02H9CPJ.13.76.G10.1.454.CMB.2.raw
  modified_base (508)..(508): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctctgggttcaccgtcagtcacacctacatgagctggtccgccaggctccgagggaggggctggagtgcgtcttctttttattatagtagtggtagtactatactccgcagacctcgtgggagggccgacttccaccactctacccgaagagaacaaacttcccaaagtaaaccacgtcttgtttacctacaaatgaaacaacgcctagagacgcccgaatacgaccgaccgggtccgttaggtactttaaccgnggttcgacggaaggaacgagggttacgggggaaaccctaaccgggtaaaaccgtttacaacccggtctaaggtcgggtaaccgttcggtaccgggggaccaaacgggggacccccg

SEQ ID NO: 381670 - DNA, 619 bp, Homo sapiens
  misc_feature: GZ8MTXP02H3HZK.13.76.G10.1.454.CMB.2.raw
  modified_base (484)..(484): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtcgtgggaggaggcttgatccagccgtggggggtccctgagactctcctgtgcagcctcgtgggttcaccgtcagtcacacctacatgagcgtcgggtccgccgaggcctaccggaggggaaggggcgtggagtgcgtcttcttttattatagtagtggtagtaccatactcgcagactccgtgacggggcacgttcacatctcagtagactaattccaaagaccacgtacttgtttacctataaagtacgaacaacgtcctaggagacgacccgatacggaaaccnccgggtaccgtggttaatttacgtgtcggacggtaaggaggacgtaccgggggaaccccaaccggtaaacgttaaccgtacgtccgtaagtacggggtaccgtcggtacgggggacccgaaacgggaacccccgg

SEQ ID NO: 381671 - DNA, 557 bp, Homo sapiens
  misc_feature: GZ8MTXP02FT8TC.13.76.G10.1.454.CMB.2.raw
  modified_base (442)..(442): a, c, t, g, unknown or other
  modified_base (500)..(500): a, c, t, g, unknown or other
  modified_base (535)..(535): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtggttcaccgtcagtcacacctacatgagcgtgggtcccgccaggcctccgaggggaggggcgtgggagtgcgtcttcttttattatagtagtgtagtacatactcgcagctcgtggacgggccgattcaccatcctcagagaacaattaccaagaccacgtcttgtttactacaaaatgaaacngccctagaacgagacccgatcgaaccgacgggccgttagtattacgtgtgcgagacgngtcggggaccaacggtacgttaacgtacgactagnggacgtcggtcggggaacccgg

SEQ ID NO: 381672 - DNA, 706 bp, Homo sapiens
  misc_feature: GZ8MTXP02JBG4G.13.76.G10.1.454.CMB.2.raw
  modified_base (544)..(544): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatccagccgtgggggtccctgagactctcctgtgcacgcctcgtcgggttccaccgtcagtcacacctacatgagtcgtcgggtccgccgaggcctaccggaaggggaacggggcgtgggagtcggtccgtttcctttactttttaagtttagttaggttaggttagggttaagttaacccgtaacttaccgtcccgacgacgtaccgttcccggtggggacggggtcccgtacttacccgacctactccctacccgaaagtaacgaaacctaaacttacccgaaaagtaaacctacgtccttagttttaccaactaaaatcgaaaacncgtaccgtaggacgtacgcccgaagtccggaccgaccgggtaccgttagttaacgtttacgtagggtcgacgtaaaggacgtacgggtccggggaaccctaacggtaaaccgttacgacgtcgtagtcggtacgtccggtacggggacccaacggtaccccg

SEQ ID NO: 381673 - DNA, 627 bp, Homo sapiens
  misc_feature: GZ8MTXP02JYK15.13.76.G10.1.454.CMB.2.raw
  modified_base (372)..(372): a, c, t, g, unknown or other
  modified_base (486)..(486): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagctgggtcccgccaggctccgagggaggggctggagtgcgtcttcttttattatagtagtggtagtaccatactccgcagacctcgnggacggggcgattccaccgtatcctccaagacgaacctaagttacccgaaaagaaccacgtcttagttttactacaaatgaaaacctcgacctggaacggacgacccgggtaanacggaccgtaccgggtcgttagttaacgttacgtggacggacggtaaggacggaccggtaccggggaaccctaaacggtaaccgttacgaccgtcgtacgggtacggtaccggtacgggacggggaaccgaaccgggcccg

SEQ ID NO: 381674 - DNA, 676 bp, Homo sapiens
  misc_feature: GZ8MTXP02JJS1E.13.76.G10.1.454.CMB.2.raw
  modified_base (514)..(514): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatccagccgtgggggtccctgagactctcctgtgcagcctcgtggtcaccgtcagtcacacctacatgagcgtcgggtccgccgaggcctccggaggggaacggggcgtagggaggtcggtccggttctttcgtttttaatttagtaggttaggtaggtaacgtacctactacctccgactacggtaccgttccgggtggggacggggtcccgtattcccacctactcctacccaaggtaactaccaaacttacccgaaaaggaaccctacggtcttagtttcctaacaaatcgaaacncgcctaggacgtacgaccgatacgacgacgggtccgtagttacttacgtgtaggacggtaggaggacgggtaccggggtaccctaacggtaaaaccgttactacggtcgtaacggttcggaaccgggttcggaacgggggacccgaaacggggtaacccccg

SEQ ID NO: 381675 - DNA, 802 bp, Homo sapiens
  misc_feature: GZ8MTXP02IWNHH.13.76.G10.1.454.CMB.2.raw
  modified_base (250)..(250): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtctggaggaggcttgatccagccgtgggggtccctgagactctcctgtgcngcctcgtggtcaccgtcagtcacacctacatgacgcgtcgggtcccgccgaggcctccggaaggggaacggggcgtagggagtcggtccgtttcgtttctttttaatttaagtaaggttaggttaggttaacgtaacctaacttacccgtccggactaacggtacccgttccggtcggggacgggggtaccccgtactttacccaaccctaacttccgtaacccgaaaggtaacgtaaaaccctaaactttacccgaaaaagtaacccgtaaccgtcctttagttttacccttaaacaaaagttcgaaaacccacggtacccgtaggtaaacggaccgacccggtaaagtaccggaaacccgtaaccgggtacccggttaggtttaaactttaccgttggtaaccggacggtaaacgggaacggtacgggttacccgggggaacccctaaaaccgggttaaaccgtttaaccgttaccggaacgttttaacggacggggtaacccggtttcgggaccccgggggtaaccgtaaaaccgggggtaacccccgg

SEQ ID NO: 381676 - DNA, 591 bp, Homo sapiens
  misc_feature: GZ8MTXP02FWTLW.13.76.G10.1.454.CMB.2.raw
  modified_base (500)..(500): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccaggccgtgggggtccctgagactctcctgtgcagcctctgggttcaccgtcagtcacacctacatgagcgtggggtcccgccgaggcctaccggaggggaaggggctgggagtgcgtcttcttttattatagtagtggtagtacatactcgcagctcgtggacggggccattcacatcctccagacgacaacttaccaaagaccacgtcttgtttactacaaaatcgaaacacgtcctagacgacgcccgatcggacgaccggtccgtagtacttacgngtacggcgaaggaggtacggtccggggaccccaacggtaaaccgttaacgacgtactacggtcgggaccgttacggacggggtaaacccgg

SEQ ID NO: 381677 - DNA, 609 bp, Homo sapiens
  misc_feature: GZ8MTXP02JGW15.13.76.G10.1.454.CMB.2.raw
  modified_base (439)..(439): a, c, t, g, unknown or other
  modified_base (449)..(449): a, c, t, g, unknown or other
  modified_base (471)..(471): a, c, t, g, unknown or other
  modified_base (488)..(488): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctcgtggggttcaccgtcagtcacacctacatgagcgtgggtccgccgaggctccgaggggaggggctggagtgcgttctcttttattatagtagtggtagtaccatactccgcagactccgtggacggggccagttccactatcctaccaagagaactaacttccaaagaccacgtctgttctanaaaatgaacngcctagagagccgatcggaacncggtctagtacgttacngtacgacgagacgtacgggtacggggaccccctaaagggtaacccgttacaacccgggtaattacggtacggggtaaccggttaccggacgggggaacccctaaaacggggggtaaccccg

SEQ ID NO: 381678 - DNA, 628 bp, Homo sapiens
  misc_feature: GZ8MTXP02GNQMX.13.76.G10.1.454.CMB.2.raw
  modified_base (460)..(460): a, c, t, g, unknown or other
  modified_base (486)..(486): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtgggttcaccgtcagtcacacctacatgagcgtcgggtcccgccgaggcctccgaggggaaggggcgtggagtcgcgttcttcttttatttatagtagtggtagtaccatactccgcagacgttccgtggacggggcctattccaccatcctccaagacaacaattccaaagaaccacgtcttgtttacctacaaatcgaaacngcctagacgagaccgatacggaaccncgggtccgttagttaacttaccgtgggtcgacggaagaaggtaccgtaccgggggacccctaaacgggtaaaccgtttaccgaacggtccgttaaggtccgggacgttccgggacgggggaacccctaagggggaacccccg

SEQ ID NO: 381679 - DNA, 552 bp, Homo sapiens
  misc_feature: GZ8MTXP02JJE2U.13.76.G10.1.454.CMB.2.raw
  modified_base (254)..(254): a, c, t, g, unknown or other
  modified_base (362)..(362): a, c, t, g, unknown or other
  modified_base (364)..(365): a, c, t, g, unknown or other
  modified_base (427)..(427): a, c, t, g, unknown or other
  modified_base (435)..(435): a, c, t, g, unknown or other
  modified_base (475)..(475): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctntgggtcaccgtcagtcacacctacatgagcgtcgggtcccgccgaggcctccggaggggaaggggcgtggagtggcgtcttcttttattatagtagtggtatacatcncnngactcgtgcgggcatccacatctcagacgacaatccaagacacgctgtttctacaatgaacngcctgagngccagtcgacacggtcctagtacttacgtgtgacgaggtnaacggtcgggaccctaacggaaacgttcgaacgcgttaagtcgggaccgtcggtacggggaccgtaacgggaccccg

SEQ ID NO: 381680 - DNA, 664 bp, Homo sapiens
  misc_feature: GZ8MTXP02I4GCJ.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagcgtcgggtcccgccgaggcctccgaggggaaggggctggagtgcgtcttcttttattagtagtagtggtagtaccatacctccgcagactccgtggacggggccgtattccacctactctaccaagacgactaaattacccgaaagaaccacgtccttacgtttaccttaacaaaatcgaaaacacgacctaggacgacgacccgaagtacggaccgtaccgggtccgttagtaactttacgtggtacggacggtaaggacggacggtaccgggggaaccccctaaacgggtaaaaccgtttacccgtaaccggtaacgttaaacggtcggggtacccggtacgggtaccgggggaacccgaaacgggggtaacccccgg

SEQ ID NO: 381681 - DNA, 546 bp, Homo sapiens
  misc_feature: GZ8MTXP02IHUEG.13.76.G10.1.454.CMB.2.raw
  modified_base (363)..(363): a, c, t, g, unknown or other
  modified_base (402)..(402): a, c, t, g, unknown or other
  modified_base (430)..(430): a, c, t, g, unknown or other
  modified_base (435)..(435): a, c, t, g, unknown or other
  modified_base (472)..(472): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtcccgccaggctccgagggaggggctggagtgcgtcttctttttattatagtagtggtagtaccatactccgnagacctccgtggacggggccgattccaccatctccaganacaatccaaagacacgcttgttcctaanaaatnaaacagcagagacgcgatcgacacggctagtattagngtgacgagagacggtaccgggaccaacgtaaacgttcacgtgtacgcggacgtcgacggggaccgaaacggccg

SEQ ID NO: 381682 - DNA, 627 bp, Homo sapiens
  misc_feature: GZ8MTXP02IUBEY.13.76.G10.1.454.CMB.2.raw
  modified_base (383)..(383): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtccctgagactctcctgtgcagcctcgtgggttcaccgtcagtcacacctacatgagcgtgggtcccgccgaggcctccgagggaggggcgtggagtgcgttcttctttttatttatagtagtaggtagtaccatactccgcacgaccttccgngggacggggccgtattcaccatctccagagactaatccaaagaaccacgtcttgttttactacaaatcgaaacacgtcctaggagacggcgagtacgaacgtacgggcgttagttacgttacgtggtacggacggaaggaaggtacggtacgggggacccctaacgggtaaaaccgtttacctaacggtctaacggtacgggtaccgttaccggtcgggggacccgtaaaacggggtacccccg

SEQ ID NO: 381683 - DNA, 691 bp, Homo sapiens
  misc_feature: GZ8MTXP02HWA4X.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtggttcaccgtcagtcacactacatgagcgtcgggtccgaccgaggcctaccggaagggggaacggggtccgtgggaggtcggtccggtttctttcgtttttaatttagttagttaggtggttagtaccattaccgtccgacaggtaccgttccggtcgggacgggggtaccctattacccgaacctacgtcctacccgaagtaacgaactaaacttacccgaaagaaccctacggcctttagtttacctaacgaaaatcggtaaaaccgcgtaccgtaaggaacgtaccgaccgtacgtacgacgtaccggtcgttagtacttacgtgtacggacggagtacggacggtcccggaaccgtaacgtaaccgttacgtacgtaacgttcggtaccggtcggtaccgggaccggggaacggtaaccggtaaccccgg

SEQ ID NO: 381684 - DNA, 556 bp, Homo sapiens
  misc_feature: GZ8MTXP02HVBOD.13.76.G10.1.454.CMB.2.raw
  modified_base (382)..(382): a, c, t, g, unknown or other
  modified_base (387)..(387): a, c, t, g, unknown or other
  modified_base (428)..(428): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggttcaccgtcagtcacacctacatgagctcgggtccgccgaggcctccgaggggaaggggctggagtggcgtcttctttttattatagtagtggtagtacatactcgcagactcgtgagggcntcacntctcagacacaattccaagaaccacgctgtttctacaatanaacagcctagagacgccgatcgacacggtcgtgtattacgtgtgacgagagacgtacggggacccaaggtaaccgtaactacgtcgtaagtacggtacggttcgacgggggaccgaacgggaccccgg

SEQ ID NO: 381685 - DNA, 539 bp, Homo sapiens
  misc_feature: GZ8MTXP02F2K9K.13.76.G10.1.454.CMB.2.raw
  modified_base (386)..(386): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagctggtccgccaggctccgaggggaagggctggagtgcgtcttcttttattatagtagtcgtagtacatactcgcagctccgtggaggggccgattcacntctcagagacaacttccaaagacacgtctgtttactacaaatcgaaacagcctagagacgccgagtgacgacggccgtgtattctgtcgacgagagacggtcggggaccacgtaacgttaacgacgactagtcggacgtcggacgggaacccg

SEQ ID NO: 381686 - DNA, 642 bp, Homo sapiens
  misc_feature: GZ8MTXP02I00V9.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtgggttcaccgtcagtcacacctacatgagcgtcggggtcccgccgaggcctccggaaggggaacggggcgtagggagtggccggtttctttctttttaatttagtagtagttaggtagtacctacttaccgtccgacacgtaccgttccggtgggacggggccgtattccaacctatcctaccaagacgaaacctaattacccaaagtaaaccacgtccttagttttacctaacaaaagtcgaaaacctcgccttaggaacgacggacccgagtacgacgaccggtccgttagttacttacgtgacgacgagtaggacgtcggggaccccaacggtaaaccgttcacgctagtacggacgttcggacggggaccaacggtacccg

SEQ ID NO: 381687 - DNA, 589 bp, Homo sapiens
  misc_feature: GZ8MTXP02F42XO.13.76.G10.1.454.CMB.2.raw
  modified_base (292)..(292): a, c, t, g, unknown or other
  modified_base (338)..(338): a, c, t, g, unknown or other
  modified_base (393)..(393): a, c, t, g, unknown or other
  modified_base (485)..(485): a, c, t, g, unknown or other
tcagtcacgtactacacgaccggtgctcgatttagtcactcatacagggggggagaggagcccagcactgggattccgaggtatttccattcggtgatcagcactgaacacagaggactcaccatggagttttggctgagctgggttttccttattactatttaaaggtgtccagtgtgaggtgcagttggtggagtctggaggaggcttggtccaggccgggggggtcctggagactctcatgtgcggcctctgggctcaccgtcaacaccaactacatgagctgggtccnccaggcctccgaagggaagaggccggagtggtctcgagtttattanggtcgacggtgccactattctacgcagactccggtgacggggccgttcaccatcnccagagacaatcaagacacggtatatcttacaatgaacgacctagagagtcgaggacacggccggtactacgtaactggtagacgaaagtanagacagacggacgggaccccgtaaggtcggggaccgtggggtaggtacggggttcttaacgtttcgaacgttcggcggttcggggacccacgggggtaaccccg

SEQ ID NO: 381688 - DNA, 576 bp, Homo sapiens
  misc_feature: GZ8MTXP02HR1UX.13.76.G10.1.454.CMB.2.raw
  modified_base (237)..(237): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtcgtccgtgtccccaggacagacagccagcatcacctgctctaggaaataatggacagataaatntactctgtatcagcagagtcaggccacgtccctgtcgctggtcatctatacaagtactcgaccaaggccggaccctagacgggtactcccccgtagacgtcgtatttctcgtcggcctaccgtaaactcgtacggtaaactcgacgcccactctacgaccagacgacggcccgggaccagtacctagtaggatggaggtctacggtactagtttaccggtagtacggacggtacggtacggacagacgtacgcgtacgtccgtccgtacgtacgttcgtaccgtacggtaacgtacggaaccgtacgtaccgtaccgtacgtacgaccgaaccgacccg

SEQ ID NO: 381689 - DNA, 615 bp, Homo sapiens
  misc_feature: GZ8MTXP02F3Y13.13.76.G10.1.454.CMB.2.raw
  modified_base (368)..(368): a, c, t, g, unknown or other
  modified_base (396)..(396): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggaggaggcttgatccagccgtgggggtccctgagactctcctgtgcagcctcgtgggttcaccgtcagtcacacctacatgagcgtcgggtcccgccaggcctccggaggggaacggggcgtggagtgcgttcttcttttattagtagtagtggtatacatacncgcagactcgtggacgggcattccaccntcaccagacgacaataccaaagaaccacgtctttgtttactacaaaatcgaaacacgaccgtagacgacgaccgataccggacgaccggtccgttagttacgttacgtggtacgacggaagaggacggttccgggggacccctaaaccgggtaaccgtttaccgacgaacgttacggtacgggtaccgtcggtacgggggacccaaacggggtaccccg

SEQ ID NO: 381690 - DNA, 595 bp, Homo sapiens
  misc_feature: GZ8MTXP02I5QME.13.76.G10.1.454.CMB.2.raw
  modified_base (400)..(400): a, c, t, g, unknown or other
  modified_base (441)..(441): a, c, t, g, unknown or other
  modified_base (489)..(489): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgccaggctccgagggaggggctggagtgcgtcttcttttatttatagtagtggtagtacatactcgcagacctccgtggacggggccgtattccaccatctccaganacaatacccaaagaaccacgcttgtttctacaaatgaaacngcctagagacggcccgagtcgaccgacgggtccgttagtactttacgnggttcgacggagacggacggtccgggggacccctaacggtaaaccggttacctaacggccgttagtacggggacgtcggtacgggggacccaaacggggtaccccg

SEQ ID NO: 381691 - DNA, 597 bp, Homo sapiens
  misc_feature: GZ8MTXP02GN5KA.13.76.G10.1.454.CMB.2.raw
  modified_base (371)..(371): a, c, t, g, unknown or other
  modified_base (396)..(396): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtgggtccgccaggctccgaggggagggctggagtgcgtcttcttttatttatagtagtggtagtaccatacctcgcagactcgnggacgggcgtatcaccatctcaganacaatccaaagacacgcttgtttacctacaaaatcgaaaactcgacctaggaacgacgacccggtaatacggacccacgggggtccttaggttaacttacgtgggtacgacggtaaggaggtacgtccgggggaccccaacggtaaacgttcgaacgtcgtagtcgggacgttcggacggggacccgtaaaggggaccccg

SEQ ID NO: 381692 - DNA, 588 bp, Homo sapiens
  misc_feature: GZ8MTXP02G8ZZJ.13.76.G10.1.454.CMB.2.raw
  modified_base (445)..(445): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcgtgggtttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgccaggcctccgaggggaaggggctggagtgcgttcttctttttattatagtagtggtagtaccatacctccgcagactccgtggacggggcattcaccatcctccagagaaccaataccaaagaaccacgtctgtttctacaaatgaaacncgcagagacgacgatacgacgacggtcgtagtacttcgtgtcggacgaggacgtacgggtaccggggaccctaaacggtaaccgttacgtaacgtaacgtacggtacgggtacgtcgggacggggaacccgtaacgggacccg

SEQ ID NO: 381693 - DNA, 622 bp, Homo sapiens
  misc_feature: GZ8MTXP02JP8EY.13.76.G10.1.454.CMB.2.raw
  modified_base (294)..(294): a, c, t, g, unknown or other
  modified_base (364)..(364): a, c, t, g, unknown or other
  modified_base (437)..(437): a, c, t, g, unknown or other
  modified_base (448)..(448): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgtgctattttaaaaggtgcccagtgtgaggtgcagctggtggagtctggaggaggcttgatccagcctggggggtccctgagactctcctgtgcagcctctggggttcaccgtcagtcacacctacatgagctgggtcccnccaggcctccgaggggaaggggctggagtgcgtcttcgtttttattatagtagtggtatacatactccgnagactcgtggacggggccattccacatcctccagacaacaacttccaaagaacacgtcttagtttaccctaanaaatcgaaacncgtctaggacgacgccgagtacgaccgtaccggtacgttagttacgttacgtaggtacgacggaagacggacgggtacccggggaacccctaaaccggttaaaccgttaccgtaccggtaacgtacggtacgggtaccggttcgggaccggggaacccgaaacggggtaccccg

SEQ ID NO: 381694 - DNA, 531 bp, Homo sapiens
  misc_feature: GZ8MTXP02F5M4Q.13.76.G10.1.454.CMB.2.raw
  modified_base (369)..(369): a, c, t, g, unknown or other
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggcagataaatatacttcctggtatcagcagaagtcaggccagtcccctgtgctggtcatctatcaagatgccaagccgcctcgagggcctccctgagcgattctctggcctccaaactcgtgggaactcgacgccactccngacccatcagccgggacccaggctactggaagtgaagggctagactagttaccagtcagggcgtgggacaggcaagcactcggacccgtactacgttcgtaccgttacggaacgttcggggaaccctaacgggtaccaccggtcctaaacggtcaaacccgg

SEQ ID NO: 381695 - DNA, 613 bp, Homo sapiens
  misc_feature: GZ8MTXP02JCLX8.13.76.G10.1.454.CMB.2.raw
  modified_base (293)..(293): a, c, t, g, unknown or other
  modified_base (387)..(387): a, c, t, g, unknown or other
  modified_base (396)..(396): a, c, t, g, unknown or other
  modified_base (399)..(399): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagctgggtccncaggctccgagggagggctggagtgcgtcttcttttattatagtagtggtagtacatactcgacagactcgtgcggggcatcgcatctccaganacaatcaanacncgctagttctacaatgaaacagccgtagaagacgacccgaatacgaacccgtacgggtcccgtagttaactttacgtggtacgacggaaggaaggaccggttaccgggggaaccccctaacgggtaaaaccgtttacccgaaaacgggtcctaaaacggttcggggaaacccgtttccgggacgggggaaccccggtaaaaggggaacccccgg

SEQ ID NO: 381696 - DNA, 612 bp, Homo sapiens
  misc_feature: GZ8MTXP02GCO6V.13.76.G10.1.454.CMB.2.raw
  modified_base (296)..(296): a, c, t, g, unknown or other
  modified_base (395)..(395): a, c, t, g, unknown or other
  modified_base (401)..(401): a, c, t, g, unknown or other
  modified_base (419)..(419): a, c, t, g, unknown or other
  modified_base (442)..(442): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctggggtcccnccaggctccgaggggaggggctggagtgcgtcttctttttattatagtagtggtagtaccatactccgcagacctcgtggaggggcctattcaccatcnccaganacaatccaaagacacgtnttgtttactacaaaatgaaaccncgctaggagacgccgatcgaccgaccgggtcgtagttacttacgtgtacggacggaaggaggtacggtccgggggaacccctaaacggtaaacccgtttaccgtaacgtaaccgttaaggtcggggtaaccggttccggacgggggaaccccgaaacgggggtacccccg

SEQ ID NO: 381697 - DNA, 723 bp, Homo sapiens
  misc_feature: GZ8MTXP02JGP1F.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgactccgaggccgtggggggtccctgacgtactctcctgtcgcacgtcctcgtcggggttccaccggtcacgtccacacctacatgacgcgtcgggccgccgaggcctaccgggaggggacggggcgtaggagtcgtcgtttctttcttttattagtaggtagtaggtacgtacctactaccgtccgcacgtaccgtcggtcgggacggggcctacttccacctactcctaccgaaaggactaaaccctaacgttacccgaaaacggtaacccgtaccggttacctttaggtttttacccctaaaagtaaacgtacgaaaccgtacggtacgtacgggaacgaccggaccgtaagaccggaccggtaccggtcgttagttacttacggtggacggacggtacggacggtaccgggtacccggggtaacccctaaacggttaccgtaacgtacgtcgtaacgggtacgggtaccggttaccgggaaccggggacccggtaaacggtacccg

SEQ ID NO: 381698 - DNA, 654 bp, Homo sapiens
  misc_feature: GZ8MTXP02F7DMD.13.76.G10.1.454.CMB.2.raw
  modified_base (516)..(516): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtctgggaggaggcttgatccagccgtggggggtccctgagactctcctgtgcagcctcgtgggtcaccgtcagtcacacctacatgagcgtcgggtccgccgaggcctaccggaggggaggggcgtggagtcggcgttctttcgttttatttagtagtagtaggtacgtacctatacctccgacgtacgtaccgttcgggtggggacgggggcccgtaattacccgaacctactacctacccgaaagacgtaaacctaaacttacccgaaaaggaaacctacgtctttacgtttaccttaacaaaaactcggaaaaccncggtaccctaggagacgaccgaataccggacgacggtccgtattatacgtgagcgaggacgacggtcgggaccccaacggtaaaccgttactacggcgtagtcgggtacgttcggacgggggaccgaacgggtacccg

SEQ ID NO: 381699 - DNA, 629 bp, Homo sapiens
  misc_feature: GZ8MTXP02JBIVY.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacagtgggctgggtcccgccaggcctccgaggggaagggctggagtgcgtcttcttttattatagtgtggtagtacatacctccgcacgtactccggtcggcgggggcctattccacccgtatcctccaagaacgaactaaacttacccaaagaaccacgtacttcgtttactacaaattcgaaacagtcctaggacgtacgacccgatcgaacgacgggtccgtagtacttacgtgtgcgaagacggagtcgggggaccccaacggtaaccgttaacgtaaccggtcttaaggtacgggtaccggttacggaccgggggacccgaaaacgggggtcccctaaacccgggg

SEQ ID NO: 381700 - DNA, 714 bp, Homo sapiens
  misc_feature: GZ8MTXP02HO4A1.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggtagttttggctgagcttgggttttccttgttgcttattttaaaaggtgcccagtgtgaggtgcagcgtggtggagtcgtgggaggaggtcttgatccgacggccggtcgggggtccctgacgtacttccttcctgtgcacgtccctcgttcgggttccaccgtcacgtccaccacctacatgacgcgtcgggtcccgccgaggcctaccggaaggggacggggcgtgggagttcggtcgtttctttactttttatttagttagttaggtaggtacgtaccgtactaccgtccgcagtaccgtcggtgggacggggccgtattccgaacctacgtcctaccgaagacgaactaactaccgaaagaacctacgtctttacgtttactaacaaagtcgaaacgtacgcctaggaacgacgaccgaatcgaaccgacggtaccgttagttacttacgtgtcggacggaaaggtacgacgggttaccgggggacccctaaacgggtaaaccgtttaccgtaacggtaaccgttaaggtaccggtaaccggttccgggtaaccgggggaacccggtaaacggggtaacccccgg

SEQ ID NO: 381701 - DNA, 549 bp, Homo sapiens
  misc_feature: GZ8MTXP02JR7YI.13.76.G10.1.454.CMB.2.raw
  modified_base (479)..(479): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctctgggttcaccgtcagtcacacctacatgagctgggtccgccaggctccgaggggaaggggctggagtgcgttctctttttattatagtagtgtagtaccatactcgcagacctcgtggacggggccattcacctatcctccagagaacaattaccaaagaacacgctgtttctacaaatgaaacagcctagagacgtccgatcgacgacggccgtgtattacngtgacgagagacgtcggggacccaaggacctactacggctagtcggacttcggcgggaccgaaggacccg

SEQ ID NO: 381702 - DNA, 568 bp, Homo sapiens
  misc_feature: GZ8MTXP02GCYKU.13.76.G10.1.454.CMB.2.raw
  modified_base (390)..(390): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggttcaccgtcagtcacacctacatgagctgggtccgccaggctccgaggggaaggggctggagtgcgtctcttttattatagtagtggtagtacatactcgcagactccgtgacggggccattcaccatcnccaagagaacaacttaccaaagaacacgcttagtttctacaaaatcgaaactagcctagagacgacccgaatcgaccacggccgtagtattacgtgtgcgagaggagtcggggaccctaacggaaaccgttacgaacggcttacgcgggtacgtcgtcgggggaccaacggggacccg

SEQ ID NO: 381703 - DNA, 586 bp, Homo sapiens
  misc_feature: GZ8MTXP02GEEVV.13.76.G10.1.454.CMB.2.raw
  modified_base (282)..(282): a, c, t, g, unknown or other
  modified_base (462)..(462): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtggggggtccctgagactctcctgtgcagcctcgtgggtcaccgtcagtcacacctacntgagcgtgggtccgccaggcctccggaggggaaggggctagggagtcgcgttcttacttttatttatagtagtggtagtacatactcgcacgactcggtggacggggcctagttccacctatcctaccagacgaacaacttaccaaagaacctacgcttcgtttctaacaaatcgaaacngacctgaagacgccgatcgaaccgacggtccgttagttacttacgtggtcgacggagaggcggtaccggggaccaacggtacgttacacgctacggcgacggtcgacgggacgaacggtacccg

SEQ ID NO: 381704 - DNA, 665 bp, Homo sapiens
  misc_feature: GZ8MTXP02JFYRH.13.76.G10.1.454.CMB.2.raw
  modified_base (393)..(393): a, c, t, g, unknown or other
  modified_base (477)..(477): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtcgggttcaccgtcacgtcacacctacatgagcgtcgggtccgccagggcctaccggaagggggaacggggcgtggaggtcgtccgttctttacttttatttagtagttaggtggtagtacatactccacagactcgnggacggggcctattcaccatcctacagagaactaaacttccaaagaaccacgtcctttagttttacctaacaaaatcgaaaccngtccgtagacggacgccggaatcggaaccgaccgggtccgttagttactttacgtggtacggaccggtagaacggtaccgggtaccgggggaaccccctaaacgggtaaacccgttttaccgaccggtaacgttaacggttccgggacggttaccggacgggggaaccccaaaacgggggtacccccg

SEQ ID NO: 381705 - DNA, 576 bp, Homo sapiens
  misc_feature: GZ8MTXP02HL4B5.13.76.G10.1.454.CMB.2.raw
  modified_base (330)..(330): a, c, t, g, unknown or other
  modified_base (388)..(388): a, c, t, g, unknown or other
  modified_base (396)..(396): a, c, t, g, unknown or other
  modified_base (437)..(437): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtggttcaccgtcagcacacctacatgagctgggtccgccgaggcgtccgaggggaaggggctaggagtgcgttnttcgtttttattatagtagtggtagtacatactcgcagactcgtgaggggcatcacanctacaganacaataccaaagaacacgcttgtttactacaaaatgaaacngacctagagagccgaatcgaacgacggcgtagttaacttagtgtagacgagagacgtacgggggaccctaaacggtaaacggtttacaacggtaactagtacgggtacgtcggacgggaaccgaaaacggggaaccccg

SEQ ID NO: 381706 - DNA, 633 bp, Homo sapiens
  misc_feature: GZ8MTXP02G8NKP.13.76.G10.1.454.CMB.2.raw
  modified_base (318)..(318): a, c, t, g, unknown or other
  modified_base (331)..(331): a, c, t, g, unknown or other
  modified_base (420)..(420): a, c, t, g, unknown or other
  modified_base (448)..(448): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaagtgcccagtgtgaggtgcagctggtggagtctggaggaggcttgatccagccgtgggggtccctgagactctcctgtgcagcctcgtgggttcaccgtcagtcacacctacatgagcgtgggtccgccaggctccgaggggaaggggcgnggagtgcgtcttnttttattatagtagtggtatacatactccgcagacctccgtgggacgggggcctattccaccatcctacccagagaccaataccgaaanaacacgtctgtttactacaaatgaaacngcctagagacggccgaagtcgacgacgggccgttagtacgtttacgtggtacgacggaaggtacggtacggttaccgggggaacccccaaccgggttaaaacccgtttacccgtaaggtaacccgttaaggtcgggggtaacccgttccgggtacgggggaaccccgaaaagggggtacccccgg

SEQ ID NO: 381707 - DNA, 620 bp, Homo sapiens
  misc_feature: GZ8MTXP02GVF2D.13.76.G10.1.454.CMB.2.raw
  modified_base (171)..(171): a, c, t, g, unknown or other
  modified_base (323)..(323): a, c, t, g, unknown or other
  modified_base (509)..(509): a, c, t, g, unknown or other
  modified_base (524)..(524): a, c, t, g, unknown or other
  modified_base (538)..(538): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctctatgagctgactcacgcccaccctnagtcgtccgtcgtcccaggacagacagccagcatcacctgctacgtaggaaaattaagtggacaagtaattaaatacttacttcgtaggtactacgaagtacaaggaacgtccgacggtccctacgttcccctggtcgcttggtacatctanacaagtactcgaccgacggccgacctacggacggtactcccccgtagacgtcgtacttcgtcgtcgtccctactaacgtcgtacggacctacgaccgaccctactccacgacctacgaccggaacggacccggtaccgagtacgtaggagagtggacgtacgttacgtacttatacgggtgaccgngggtacggtagaacnggacgtacgtaccncgtccgtactacgtacggtacgttaccggtacggtacgtacggtaaccgtacggtaccacgtacgacgaccgaccgaacccg

SEQ ID NO: 381708 - DNA, 551 bp, Homo sapiens
  misc_feature: GZ8MTXP02FUF8W.13.76.G10.1.454.CMB.2.raw
  modified_base (267)..(267): a, c, t, g, unknown or other
  modified_base (297)..(297): a, c, t, g, unknown or other
  modified_base (358)..(358): a, c, t, g, unknown or other
  modified_base (360)..(360): a, c, t, g, unknown or other
  modified_base (366)..(366): a, c, t, g, unknown or other
  modified_base (386)..(386): a, c, t, g, unknown or other
  modified_base (391)..(391): a, c, t, g, unknown or other
  modified_base (409)..(409): a, c, t, g, unknown or other
  modified_base (422)..(422): a, c, t, g, unknown or other
  modified_base (432)..(432): a, c, t, g, unknown or other
  modified_base (449)..(449): a, c, t, g, unknown or other
  modified_base (464)..(464): a, c, t, g, unknown or other
  modified_base (515)..(515): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaaggtgcccagtgtgaggtgcagctggtggagtctgaggaggcttgatccagcctggggggtccctgagacctctctgtgcagcctcgtgggtcaccgtnagtccacacctacatgagcgtcggggtccncaggctccgaggggaacggggcgtggagtgcgtctctttatttatagagtgtagacatacncncagacncgtgcggggcatccacatcncaganacaataccaagaacacgnttgtttacctaanaaagtcaacncgcagagacgtaccgancgacgaccggtcgtntatacgtgacgacgaagagacggccggggacccaaacgtaaccgtacacgntacggtcggacgtcggacgggaaccgacggtacccg

SEQ ID NO: 381709 - DNA, 570 bp, Homo sapiens
  misc_feature: GZ8MTXP02H4XWK.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgccaggctccgagggaggggctggagtgcgtctctttttattatagtagtggtagtacatacctcgcagactccgtggaggggcattcaccatcctccagagacaattccaaagacacgtctgtttactacaaatcgaaacagcctgagacgcgaatcgacacggtccgtgttacttacgtgtcgacgagaggtacgtcgggggaccctaacggaaaccgtttacacggtaactacggtacggaccggttcgcgggggtacccaaagggggaccccg

SEQ ID NO: 381710 - DNA, 745 bp, Homo sapiens
  misc_feature: GZ8MTXP02HFKFF.13.76.G10.1.454.CMB.2.raw
  modified_base (250)..(250): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtccctgagactctcctgtgcngcctcgtgggttcaccgtcagtcacacctacatgagcgtcgggtcccgccgaggcctccggaaggggaaggggcgtggagtgcgttcttcttttattatagtagtggtatacatactcgcagacctcgtggacggggccgtagttccacctactcctacccgaagaacgtaaacctaaacgtttacccgaaaacgtaaacccgaaccgttaccgtttacggtttttaccctttaaacaaaaacgttacggaaaaaccctaccggtcccgttaagggtaaaccggaaccggtaccccgggaaattaccgggaaacccgtaccgggggttaccccgttaaggtttaacttaaccgttgggtacggtacgggtaaaggaacgggtacgggtacccgggggaaccccctaaaccggggtaaaccgtttaccgtaaccggtccgttaaaggtccgggtaccgttaccgggtcgggggaacccgaaaacgggggtaccccg

SEQ ID NO: 381711 - DNA, 568 bp, Homo sapiens
  misc_feature: GZ8MTXP02GJPV7.13.76.G10.1.454.CMB.2.raw
  modified_base (284)..(284): a, c, t, g, unknown or other
  modified_base (294)..(294): a, c, t, g, unknown or other
  modified_base (384)..(384): a, c, t, g, unknown or other
  modified_base (434)..(434): a, c, t, g, unknown or other
  modified_base (442)..(442): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgancgtgggtccnccaggctccgagggaggggctggagtgcgtctcttttattatagtatggtatacatactcgcagactccgtgaggggccattcaccatcnccagagaacaattccaaagaacacgcttagtttcttacaaaattgaaacngcctgagngacccgatgacacggccgtgtattactgtcgcgagacgagtcgggggacccctaacggtaaaccgtttacgaacggccttaagacggggaccgttcggtacgggggacccaaagggggaacccccg

SEQ ID NO: 381712 - DNA, 578 bp, Homo sapiens
  misc_feature: GZ8MTXP02IYNY1.13.76.G10.1.454.CMB.2.raw
  modified_base (170)..(170): a, c, t, g, unknown or other
  modified_base (235)..(235): a, c, t, g, unknown or other
  modified_base (271)..(271): a, c, t, g, unknown or other
  modified_base (289)..(289): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctctagaaataatggacagataaatntacttctgtatcagcagagtcaggccagtcccctgngctggtcatctatcaagntcgaccaagccgcctgaggctcccccgtgacgcgtattctcgtcggcctccaaacgtcgtagggaacctcgaacgccctaactctcgaccagtccgacggacccgggaccccaggtccttaagcggatacggaggtctaggtacttagttaccgtgtaccgagggtccggtagggacaggacacgcctaacgtccgacccgtcttacgtcggttaccgttacggaaccgttacggggaaacccgtaacggtacccgtaccggttacctaacgaccgaaccgaacccccg

SEQ ID NO: 381713 - DNA, 656 bp, Homo sapiens
  misc_feature: GZ8MTXP02HS6NL.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtggttcaccgtcagtcaccacctacatggacgcgtcgggtcccgccgaggcctaccggaggggaaggggcgtggaggtcggtcgttctttcttttatttagtagttaggtggtagtacctatacctccgcagtacctcggtgggacggggccgtattccgaccacgtcctacccaagaacactaaacttacccgaaagtaacccacgtctttcgtttactacgtaaatacggaaacacgtccgtaggacgacgacccgatcgaaccgacgggtccgttagttacgttacgtggtagcggtaagtacggacggtccgggggaacccaaccggtaaccgtttaaccgacgtaacgtacgtacgggtaccggtcggtaccggggaaccgtaacggggtaacccg

SEQ ID NO: 381714 - DNA, 577 bp, Homo sapiens
  misc_feature: GZ8MTXP02GF4GH.13.76.G10.1.454.CMB.2.raw
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataatggacagaataaatatacttcctggtatcagcagaagtcaggccagtcccctgtgctggtcatctatcaagatgccaagccggcctcgacgggactcccccgtgacgcgtattctcgtggcctccaaactcgtacggaactcgacgccactctacgaccatcgacgccggacccaggcctagtacggagtaggacggtctacgtacttattacgtagtaccgagggtacggtagggaacagccgaagcctaaccgtcggccccgtagtacgttcgttaccgttacggaaccgttacgggaaccgtaacgggtaccaacccggttaccgtaacggttccgaacggaaacccccg

SEQ ID NO: 381715 - DNA, 550 bp, Homo sapiens
  misc_feature: GZ8MTXP02GVTYH.13.76.G10.1.454.CMB.2.raw
  modified_base (234)..(234): a, c, t, g, unknown or other
  modified_base (287)..(287): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagaggtcacatctcctgcacgtgggancagctccaacattgggcacattatgatgtacactggtacagctagttccaggngcaggtcccagactcctacatacaatacgtaacaacaatccggccgcgacggggtccctgaccgattctctggctccgagtctcggcacctcacgccctccctggtcactcacgttcgggcttccgaggtcgtggacggatcggaggctaggtatttagtttctgtcctacgtacccttattcgaacgacgcgaacgtccgtaggaacgttcggtccgtttacgggttacggtttccgggggtaccgggggaccctaccgggg

SEQ ID NO: 381716 - DNA, 513 bp, Homo sapiens
  misc_feature: GZ8MTXP02IABPT.13.76.G10.1.454.CMB.2.raw
  modified_base (292)..(292): a, c, t, g, unknown or other
  modified_base (331)..(331): a, c, t, g, unknown or other
  modified_base (418)..(418): a, c, t, g, unknown or other
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataatggcagataatatacttctggtatcagcagagtcaggccagtcccctgtgctggtcatctatcaagntgccaacgccgccctcgagggactccctgacgcgattcnctggcctccaactcgtgggaactcacgcccactctacgaccagtcagcccgggaccaggctagtggatgaggctagacttattacgngtacgaggtcgtagggacagcagcacgtcgcccgtctacgtcgtacgtcggaacgtcggggaacctaacggtccaccgtccgttaacgcgaaccg

SEQ ID NO: 381717 - DNA, 520 bp, Homo sapiens
  misc_feature: GZ8MTXP02IZ6KQ.13.76.G10.1.454.CMB.2.raw
  modified_base (236)..(236): a, c, t, g, unknown or other
  modified_base (367)..(367): a, c, t, g, unknown or other
  modified_base (465)..(465): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggacagataaatntacttctggtatcagcagaagtcaggccagtcccctgtgctggtcatctatcaagatgaccaagccggccctcgagggactccccctgacgcgtattctcgtgctccaactctggaactcgagcccactcncgaccatccgagaccggacccaggcctaagtcggatggaggtctagtaaccttagttacgtgtaccgagggcggtgggacaggcagccactcgcccgntacgtcgttcgtacgacgtggaaccgaggtccaccggtccacgtccgacgacccg

SEQ ID NO: 381718 - DNA, 561 bp, Homo sapiens
  misc_feature: GZ8MTXP02I2VW2.13.76.G10.1.454.CMB.2.raw
  modified_base (250)..(250): a, c, t, g, unknown or other
  modified_base (496)..(496): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcngcctcgtgggtcaccgtcagtcacacctacatgagcgtcgggtcccgccaggctccgaggggaacggggctggagtgcgtcttcttttattatagtagtggtagtaccatactcgcagactccgtggacgggcctagttccaccatcctaccagacgacaattaccaaagaccacgtcttgtttactacaaatgaaacagcctagacgagccgatcgacacggccgtagtacttagtgtgacgagngacgtcggggacccacgtaaccgttacgacgcgtagcggtacgtcgtcgggaccgaaggtacccg

SEQ ID NO: 381719 - DNA, 572 bp, Homo sapiens
  misc_feature: GZ8MTXP02GTU5O.13.76.G10.1.454.CMB.2.raw
  modified_base (170)..(170): a, c, t, g, unknown or other
  modified_base (245)..(245): a, c, t, g, unknown or other
  modified_base (338)..(338): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctctgaaataatggcagataaatatacttctggtancagcagaagtcaggccagtcccctgtgctggtcatctatcaagatcgaccaagccggccctagacgggtactcccccgtagacgcgtattccngtcgcctcctaactccgtagggaacctcgacgccctacgtcctacgacccatccgacgggacccgggacccctagggtaccctaggtacggagtaggacgtctacggtacttattacggtgtacggagggtacggtagggacagcgtacgacctacgtcggccgtctacgtcgttccgttacggaacgttcgggaaccgacggttaccaccgttacaacgtccgaacgaccccg

SEQ ID NO: 381720 - DNA, 667 bp, Homo sapiens
  misc_feature: GZ8MTXP02HFY6K.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgatctgggttttccttgttgctattttaaaaggtgcccagtgtgaggtgcagcgtgggtggagtctgggagggaggcttgatccagccgtggggggtccctgagactctcctgtgcagcctcgtgggttcaccgtcagtcacacctacatgagcgtcgggtccgccgaggcctccggaggggaggggctggagtgcgtctttcttttattatagtagtggtagtactatactcgacagtacctcggtgggacggggccgtattccgacctatcctaccaagacgaacctaacttacccgaaaagaacctacgtcctttacgtttaccttaacaaaagttcgaaacagtccctaggaacgacgcccggaatacggaccgaaccgggtcgtacggttaattaccgtgtacgacggagtacggacggttacccgggggaacccctaaacgggtaaaccgttaaccgtacggaacgttaacggtacggggacccggttcggtacgggggaaccccgtaaacggggtacccccgg

SEQ ID NO: 381721 - DNA, 573 bp, Homo sapiens
  misc_feature: GZ8MTXP02GHO03.13.76.G10.1.454.CMB.2.raw
  modified_base (356)..(356): a, c, t, g, unknown or other
  modified_base (384)..(384): a, c, t, g, unknown or other
  modified_base (479)..(479): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggtcaccgtcagtcacacctacatgagcgtgggtccgccgaggctccgaggggaggggctggagtgcgtcttctttattatagtagtggtagtacatacncgcagactcgtgagggcgatcaccatcncagagaactaactccaaagaaccacgcttagtttacttacaaatcgaaacagcctggagacgccgatacgaacgacgggtccgtagtacttacgnggtacgacggagacggaggtaccggggaccctaacgggtaacttacgacggtctagtacggacggttcggcgggggaaccaacggggaaccccg

SEQ ID NO: 381722 - DNA, 532 bp, Homo sapiens
  misc_feature: GZ8MTXP02JJQEN.13.76.G10.1.454.CMB.2.raw
  modified_base (170)..(170): a, c, t, g, unknown or other
  modified_base (235)..(235): a, c, t, g, unknown or other
  modified_base (273)..(273): a, c, t, g, unknown or other
  modified_base (459)..(459): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctctggaaataattggcagataaatntacttctggtatcagcagaagtcaggccagtcccctgnctggtcatctatcaagatgccaagcgccctcagggactcccccgtagacgcattctctggcctccaactctagagtaactcagcccactctcgaccatccgagccggaccacggctagtcggaatcggaaggtctaggaacttacgttaactggtacgtacggcggtagggacaggacacggaccncgtacgcccgtcttactcgtacgttacggacgtaaggaacctacggtacacccgttcgaacgtaccgaacccg

SEQ ID NO: 381723 - DNA, 686 bp, Homo sapiens
  misc_feature: GZ8MTXP02IXZVC.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggaggaggcttgatccagccgtgggggtcctgagactctcctgtgcacgcctcgtgggtcaccgtcagtcaccacctacatgagcgtcgggtcccgccgagggccgtcccggaagggggaacggggcgtagggaggtcggtcggttcctttcgtttttaattttagtaaggttacggttaggtagtactatacctccgacaacgtccgtccggtagggacggggccctacttccaacctatcccgtaccagaacgaaacctaacgttaacccaaaaggtaaccctacggtcctttacgtttacctaactaaaagttcggaaaccacggtccttaggacggtaccgacccggtaagtcgaaccgaccgggtccgtttagtaactttacgtggtacgacggaaggacggtacggtccgggggaaccctaacggtaaaccgttaacgacgtctaacggtcgggaccgtcggtacggggaaccg

SEQ ID NO: 381724 - DNA, 608 bp, Homo sapiens
  misc_feature: GZ8MTXP02G13TT.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctcgtcggttccaccgtcagtcaccacctacatgagcgtcgggtccgccgaggccgtccggaggggaaggggcgtggagtgcgtcttcttttattagtagtagtggtagtaccatactcgcagacctcgtggacggggccgtattccaacctacgtcctaccgagaacgaactaaacttacccaaaagaaccacgtcttagttttacctaacaaaatcgaaacagcctagagacgccgaatcgacgacggtcgtagttacttacgtgtcgacgaggagacggtcgggggaccctaaccggtaaacttacgtacgaacgtagtcggacgttcggacggggaccgaaacgggacccg

SEQ ID NO: 381725 - DNA, 582 bp, Homo sapiens
  misc_feature: GZ8MTXP02H0R86.13.76.G10.1.454.CMB.2.raw
  modified_base (447)..(447): a, c, t, g, unknown or other
  modified_base (489)..(489): a, c, t, g, unknown or other
  modified_base (497)..(497): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctggggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagctcgggtccgccaggcctccgaggggaggggctggagtgcgtcttcttttattatagtagtggtagtacatacctcgcagacctcgtggacgggcctattccgacctatcctccagagaaactaactcaaagaactacgcttgtttactacaaatgaaacngcctagagagccgatcgaccgacggtcttgtaattacgtgtnacggaagnggacgtcgggggacccttaacgggaactttaccgacggtcctaaggtcgggacggttcgtacgggggacctaaaacggggccccg

SEQ ID NO: 381726 - DNA, 715 bp, Homo sapiens
  misc_feature: GZ8MTXP02H7TDV.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtgggaggaggcttgatccagccggtcgggggtccctgagactctcctgtgcagcctcgtgggttcaccgtcacgtcaccacctacatgacgcgtcgggccgccgaggccgtaccggaggggaacggggcgtagggagtcggtccgtttctttacttttttaagtttagttaaggtttaggttaggttaacgtaccctaacgttacccgtccgaccgtacggtaccgttccgggtcggggtaccgggggtacctacgtttacccaacctaccgtacctacccaaaggaacgaacctaaacttacccgaaaacgaaccctaccgttcctttacgttttacctaacgtaaagtacgaaactcggtaccgtaggacgacgacgagtacgaaccgtcggtccgtagttacttacgtggtacgacgtaaggacggacggtaccggggaccctaaacggtaacgttccgaacgtcgtaggtacggtacggtacggtaccggggaaccgtaacggaccccg

SEQ ID NO: 381727 - DNA, 531 bp, Homo sapiens
  misc_feature: GZ8MTXP02FWPJD.13.76.G10.1.454.CMB.2.raw
  modified_base (293)..(293): a, c, t, g, unknown or other
  modified_base (430)..(430): a, c, t, g, unknown or other
  modified_base (500)..(500): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccnccaggctccgagggaggggctggagtgcgtctcttttattatagtagtgtagtacatactcgcagactcgtgagggccgattcacatctccagagacaatccaagaacacgctgttctacaaatgaaacagcctganagccgatgacacggcgtagtattacgtgtgcgagagagtcggggacccacgaaccgttactacggcttangggacgtcggtacggggaccgaaggaacccg

SEQ ID NO: 381728 - DNA, 807 bp, Homo sapiens
  misc_feature: GZ8MTXP02G5GO6.13.76.G10.1.454.CMB.2.raw
tcagtcacgtactacacgaccggtgctcgatttagtcactcatacagggggagcctgggcctcaggaagcagcatcggaggtgcctcagccatggcatggatccctctcttcctcggcgtccttgcttactgcacaggatccgtggcctcctatgagctgactcagccaccctcagtgtcccgtgtccccaggacagacacgccagcatcacctgctctaggaaataattggcagataaatatacttcctgtatcagcagaagtccaggccacgtcccctgtgcctggtcatctatacgaagtactcgaccgaacggccgggccctacggtacggggaacccttcccccgtaggacggtaccggttaactttcccgtaccgtcggggtaccctttaccccgaaaaccgttcggttaaccgggggaaaccttcgaacccgaccctaaacctcccgttacgaccctaacttacccggacgggacccccggggaccccgaagggggtacccttaacggtcggggaaagttcgggaaaccgggtccgttaacggtaaacctttacgtttaaacccgtcggtttacccggaaaggggttccggggttaacggggaacccgtaaagggcccgtaaacggacccggtaacccgtttaccggggccccccgggttaatttaaaccgggttccgggttaacccgggttttaacccggggaaaaccggtttaaccgggggaaaccccggtaaaaccgggggttaccctaaaacccccgggttacccggtttaaaacggtccccggtaaaaccccggg

SEQ ID NO: 381729 - DNA, 568 bp, Homo sapiens
  misc_feature: GZ8MTXP02HSQXI.13.76.G10.1.454.CMB.2.raw
  modified_base (446)..(446): a, c, t, g, unknown or other
  modified_base (479)..(479): a, c, t, g, unknown or other
  modified_base (487)..(487): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccgaggcctccgaggggaacggggctggagtcgcgtctttacttttagtttatagtagtggtataccgatactccgcagacctcgtgacggggccattccaccatctcccagacgacaattaccaaagaacacgtcttgtttactacaaatanaaactgcctaggagagccgatgacacggccgtntattacgngtcgacgagagacggtccggggacccaacggtacgttacacgtaacgtagtacggtacgtcggacgggaccgaacggaccg

SEQ ID NO: 381730 - DNA, 559 bp, Homo sapiens
  misc_feature: GZ8MTXP02GGSAC.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctggtccgccaggcctccgaggggaaggggctgggagtgcgtctcttttattatagtagtgtagtacatactcgcagctccgtggacggggccgattcactatcctcagagacaattaccaaagacagcttgttctacaaatcgaaacagcctagagacgcccgatcggactaccgggctaggtacttacttcggagcggaaggtacgagtcgggggaccccaacggtaaacggttaacacgctaggtcggacgtcggtcggggaacccgg

SEQ ID NO: 381731 - DNA, 694 bp, Homo sapiens
  misc_feature: GZ8MTXP02IEVB4.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctattttaaaaggtgcccagtgtgaggtgcagctggtggagtcgtgggaggaggcttgatccagccgtgggggtccctgagactctcctgtgcagcctcgtgggttcaccgtcagtcacacctacatgagcgtcgggtccgccgaggcctccggaggggaaggggctagggagtgtcgtttctttctttttaatttataggttagtaggtagtacccaacttaccgtccgcaacggtacccgttccgggtggggaccgggggtcccgtaactttacccacccgtactcctacccgaagacgaaccctaaattacccgaaaagaccaccgttcctttagttttacccttaacaaaatcgaaaaccaccggtaccgttaggaacgaccggaccgaagttccgaaccgtacgggtcccgtttagttactttacgtggtacgacggtagacggacggtacgggggacccctaacgggtaaccgtttacaacggtccgttaggcggtacgttccgggacgggacccgaaacggggaccccg

SEQ ID NO: 381732 - DNA, 650 bp, Homo sapiens
  misc_feature: GZ8MTXP02JJHR9.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggtcaccgtcagtcaccacctacatgagcgtcgggtccgccgaggccgtccggaggggaacggggcgtgggagtgcgtcttcttttattagtagtagtggtagtacatactccgacagacctcgtggagggccagttccaccgatcctcaagagaactaaacttccaaaggaaccacgtacctttacgtttaccttacaaagtacgtaaaccagtcccgtaaggaggaacgtcccggaagtacgacgtaacccggggtccgttagttaacgtttacgtggtggtaccggaggtacggacggtaccgggggacccctaacgggtaaaccgttaccgacgtaaccgtaggtacgggtaccggtcggtacggggaacccgaaaggggtaacccccg

SEQ ID NO: 381733 - DNA, 680 bp, Homo sapiens
  misc_feature: GZ8MTXP02HJIWX.13.76.G10.1.454.CMB.2.raw
  modified_base (361)..(361): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtgggtccgccgaggcctccgagggaaggtctggagtgcgtcttcttttattatagtagtggtagtaccatacnccgcacgacctcggtgggacggggccgtactccgaccagtcctacccgaagtacgacctaaattcccaaaaggtaaacccacggtcctttacgtttacctttaacaaaacgttcgaaaacctaccggtcccgttaggtaaacggacggaccccgtagtacggaacccgtaccgggtcccggttaggttaacttttaccggtagggtacgacggaaggacggtacggtacccggggaacccctaacggtaaaccgttaccgtacgtcgttacggtacgggtaccggtcgggtaccgggggtaacccgaacggggtacccg

SEQ ID NO: 381734 - DNA, 572 bp, Homo sapiens
  misc_feature: GZ8MTXP02HO7G8.13.76.G10.1.454.CMB.2.raw
  modified_base (170)..(170): a, c, t, g, unknown or other
  modified_base (284)..(284): a, c, t, g, unknown or other
  modified_base (290)..(290): a, c, t, g, unknown or other
  modified_base (414)..(414): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctctaggaaataatggcagataaatatacttctgtatcagcagagtcaggccagtcccctgtgctggtcatctancaaagntgaccaagccggaccctgacggggtactcccccgtgacgcgtattctcgttggcctaccaactctacggggaacctcgacgcccactctacgaccaatcgacgccggggacccagggacctagnggatagggacggtactacggtaacttatttacgagtcgaggtcggtacggggacaggccaaggccgacgtccggacccgcgttagtcgtttaccgtaccggtaacgtacgggaaccgtacggtacctaccggtactttaacggacgacgaaacccccg

SEQ ID NO: 381735 - DNA, 623 bp, Homo sapiens
  misc_feature: GZ8MTXP02IOAP4.13.76.G10.1.454.CMB.2.raw
  modified_base (387)..(387): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtggttcaccgtcagtccacacctacatgacgcgtcggtcccgccgacggcctaccggaggggaaggggcgtggagtcgcgttcgtttctttttatttagtagttagtggtagtacatactcgcagacgtcgnggacggggcgtacttccacctactctccaagacgaactaacttaccaaagaacctacgtctttacgtttacttaacaaagtacgaaacgtacgtaccgtaggaacgacgacccggataccgaaccgacggtaccgtagttacttacgtgacgacgaggtacgcgtaccggggaccctaaacggtacgttacacgaacgtagtacggtacgtcggtacgggaccgaacgggtacccg

SEQ ID NO: 381736 - DNA, 576 bp, Homo sapiens
  misc_feature: GZ8MTXP02HBTXQ.13.76.G10.1.454.CMB.2.raw
  modified_base (295)..(295): a, c, t, g, unknown or other
  modified_base (329)..(329): a, c, t, g, unknown or other
  modified_base (361)..(361): a, c, t, g, unknown or other
  modified_base (382)..(382): a, c, t, g, unknown or other
  modified_base (385)..(385): a, c, t, g, unknown or other
  modified_base (390)..(390): a, c, t, g, unknown or other
  modified_base (430)..(430): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtctggaggaggcttgatccagccgtggggggtccctgagactctcctgtgcagcctcgtgggttcaccgtcagtcacacctacatgagcgtgggtccnccaggctccgagggaagggctggagtgcgtcttnttttattatagtagtggtagtaccatactcgnagactcgtgaggggcatcacntcncaganacaatcaaagaacacgtctgtttactacaaaatcgaaacngcctagaagagacccggaagcgaaccgacggtcgttagttacttacgtgacgacggaagaggacggtccgggaaccctaaacgtaaccgttacgtacgaacgtacggtacggtaccgtacggaccggggaaccgaaacgggacccg

SEQ ID NO: 381737 - DNA, 600 bp, Homo sapiens
  misc_feature: GZ8MTXP02FQZVE.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtgggtccgcaggctccgaggggagggctggagtgctcttcttttattatagtagtggtagtacatactccgcagcctccgtggacgggggccgattaccaccatcctcccgaagaacgaactaaacttcccgaaaagaaccctacggtcctttgtttacccttacaaaacgttcgaaaacctacgggaccctaggaaggacgcccgaatcgaccgtacggccgttagtattacgtgtgaccgagacgagtccgggggccaacggtaacgttaacgacgcgttaagcgggtacctcggtgggggaaacccg

SEQ ID NO: 381738 - DNA, 638 bp, Homo sapiens
  misc_feature: GZ8MTXP02GO5OT.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtcgggtcccgccgaggcctccggaggggaggggctggagtgcgttcttcttttatttatagtagtggtataccatactcgcagactcgtggacggggccattccacctatcctacccgaagacgtaaacctaattacccgaaagtaacccacgtctttacgttttacctaacaaaagttcgaaaacctcgcctagacgacgccgatccgacgaccggtcgttagtacttacgtgtacggacgtaggaaggtacggtaccgggggacccctaaacggtaaccgttaaccgtaccgaacgttaacggtcgggtaacccgttcgggacgggggacccgaaacggggtaccccg

SEQ ID NO: 381739 - DNA, 654 bp, Homo sapiens
  misc_feature: GZ8MTXP02H5BXY.13.76.G10.1.454.CMB.2.raw
  modified_base (489)..(489): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgccagtgtgaggtgcagctggtggagtctgggaggaggcttgatccagccgtggggggtcctgagactctcctgtgcagcctcgtgggttcaccgtcagtcacacctacatgagcgtcgggtcccgccgaggccgtaccggaggggaaggggctgggagtcgcgttcttactttttattagtagttaggtggtataccgtatacctccgactacgtaccgtcggtggacgggggtcctacttaccacctactctacccgaagacgaaacctaattacccaaagaaccacgtcttcgtttactaacaaattacgaaacgngttccaggaacgacggaccgatacggaccgtaccggccgttagttaactttacgtggtacgcggaagacggtacggtaccggggacccctaaacggtaaccgtttaccgacggtaacgtacgtacggggtaccctcggggaccggggaccgaaacggggaccccg

SEQ ID NO: 381740 - DNA, 554 bp, Homo sapiens
  misc_feature: GZ8MTXP02I5P4H.13.76.G10.1.454.CMB.2.raw
  modified_base (296)..(296): a, c, t, g, unknown or other
  modified_base (435)..(435): a, c, t, g, unknown or other
  modified_base (473)..(473): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccnccaggctccgagggagggctggagtgcgtcttcttttatttatagtagtcggtagtacatactcgcagctccgtggacggggccattcacctatcctccagacgacaattccaaagacagctgttctacaaatgaaacngcctgagacgccgatgacacggcctagtacttacgtgngtacgaggagacgtcgggggaccccaacggtaaaccgttaacgtacgacttaagtcgggtaactcggtacgggggaacccg

SEQ ID NO: 381741 - DNA, 557 bp, Homo sapiens
  misc_feature: GZ8MTXP02GYETD.13.76.G10.1.454.CMB.2.raw
  modified_base (363)..(363): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctctggggttcaccgtcagtcacacctacatgagctgggtccgccaggcctccgaggggaaggggctggagtgcgtcttcttttattatagtgtggtagtacatactcgnagactccgtggacgggcgattcactatctccagagacaattccaaagaacacgctgtttcttacaaatgaaacagcctgagacgccgatcgacacggccgtagtattacgtgtgacgagagacgtcgggggacccaacggaaccgttacacggctagtcggacgtcgtacgggggacctaaacggggaaccccg

SEQ ID NO: 381742 - DNA, 571 bp, Homo sapiens
  misc_feature: GZ8MTXP02H057Y.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggttcaccgtcagtcacacctacatgagctgggtccgccaggctccgagggaaggggctggagtgcgtctcttttatttatagtagtggtagtaccatactcgcagactccgtggacggggccgaaaacttcaccatctcccagagacaattaccaagaacacgtcctgtttactactaaatgaaacagacctagagagccgatcgacacggccgtgttattacgtgtgcgagaggagtcgggggacccacgtacgttaacctacggtaacctagtacggaccgtcgtacgggggaccgaacggggaacccgg

SEQ ID NO: 381743 - DNA, 706 bp, Homo sapiens
  misc_feature: GZ8MTXP02GFPT1.13.76.G10.1.454.CMB.2.raw
  modified_base (498)..(498): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatccagccgtggggggtccctgagactctcctgtgcagcctcgtgggttcaccgtcagtcacacctacatgagcgtgggtcccgaccgaggcctaccggaaggggaacggggcgtggagtggtcgttcttactttttatttatagtagtggtagtacctatacctccgacacgacctccggtgggacggggcctagttccacctactcctacccgaaaggacaacctaaacgtacccaaaagaacctacgtcttagttttactaaaccgaaaatcgaaaaccncgtaccgtaggaacgacgacccgaaataccggaaccgaccggggtccgttagttaacgttaccgttggacgggaacggagggtaaacggtacgggtacccgggggaacccctaaaacggggtaaaaccgttttaccgaaacggttcccgttaaagggtcggtaaccgggtccgggtacgggggaacccgaaacgggggtaacccccgg

SEQ ID NO: 381744 - DNA, 681 bp, Homo sapiens
  misc_feature: GZ8MTXP02GYXW0.13.76.G10.1.454.CMB.2.raw
  modified_base (430)..(430): a, c, t, g, unknown or other
  modified_base (446)..(446): a, c, t, g, unknown or other
  modified_base (469)..(469): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatccagccgtgggggtccctgagactctcctgtgcagcctcgtcgggtcacgtcagtcaccacctacatgagcgtcgggtcccgccgaggcctaccggaggggaacggggcgtgggagtcgtcgtttctttactttttatttagtagtagtggttacgtaccatacctccgcagaccgtcgtgggacgggccgtattccacctatcctaccaganaacctaactccgaaanaccacgtctttgtttacctaaanaatcgaaacgcgacgaggaacgaccgtaccgaagtaccggaccgtaccgggttcgttagttacgttacggtggtacggacggaaacggtacgggtaccggggtaacccgggaaacccccgtaaaaccggttaaaccgttacccgtaacggtaacgttacggtaccgggtaccggtaccgggaaccgggggaaacccgaaacggggtaccccg

SEQ ID NO: 381745 - DNA, 631 bp, Homo sapiens
  misc_feature: GZ8MTXP02ISPVK.13.76.G10.1.454.CMB.2.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataatggcagataaatatacttctggtatcagcagaagtcaggccagtcccctgtgctggtcatctatcaagatcgaccaagccggcctcgagggctcccccgtgacgtcgattctcgtcggcctccaaactcgtacgggaacctcgaacgcccactctacgacctaatccgaacgccgggacccaggtcgtaagtggactggaacggtccgtacggtactttaacgttacgttcggtacgtaacggggtcggttacggggaaaccacggacgacgcccgtaaaccgttccggaccccggtacttaacgttcggtttacccgtttaaccggggaaaccgttccggggtaaacccgtaacgggttaccccgtaacccggttaccgtaaacgttcccgaaccggtaaacccccgg

SEQ ID NO: 381746 - DNA, 671 bp, Homo sapiens
  misc_feature: GZ8MTXP02IL2X9.13.76.G10.1.454.CMB.2.raw
  modified_base (410)..(410): a, c, t, g, unknown or other
  modified_base (452)..(452): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggttcaccgtcagtcacacctacatgagcgtgggtcccgccaggcctccgaggggaaggggcgtggagtgcgtcttctttttattatagtagtggtataccatactcgcacgacctccgtggacggggccagttccaccatcctccaagganaaccaaagttcccaaaggaacccacgcttacgttttacctanaaaatgaaaacctaggtccctaggaacgacgcccgtaaagtcgaaccgaccgggtccgttagttatttaaccgtggtacggacgaaggacggacggttacccggggggacccctaaacggggttaaaacccgttttacccggaaacccgtgtttaacggtaccgggggtaccccggtttaggtaccgggggggaaacccaaaacggggggtaacccccg

SEQ ID NO: 381747 - DNA, 559 bp, Homo sapiens
  misc_feature: GZ8MTXP02JVOKJ.13.76.G10.1.454.CMB.2.raw
  modified_base (440)..(440): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagctcgggtccgccaggcctccgaggggaaggggctggagtgcgtcttcttttattatagtagtggtagtacatactccgcagactcgtgacggggccattcacatctccagacgacaacgttccaaagaaccacgcttgtttctacaaatgaaacngcctgagacgccgatcgacacgggctgtattacgtgtgcgaggagacggtacggggaccctacggaaccgttacaacgcgttaagtcggacggtcgtacgggggacccaagggaccccg

SEQ ID NO: 381748 - DNA, 599 bp, Homo sapiens
  misc_feature: GZ8MTXP02HNX7N.13.76.G10.1.454.CMB.2.raw
  modified_base (401)..(401): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggttcaccgtcagtcacacctacatgagcgtgggtccgccgaggcctccgaggggaaggggctggagtggcgtcttctttttattatagtagtggtagtaccatacgtcgagactccgtggcggggcattcaccatcacaganacaatacaagaacacgtcttagtttctaacgaaaatcgaaacacgcctagacgtagccgtaatagaaccgaccgggtacgtgttaattaccgtggtgacggagaggacggaccgggacccgaaacggtaacgttaccgtacggtctaagtcgggaacgttcgggacgggggaccgaaacgggggtacccaacccgggg

SEQ ID NO: 381749 - DNA, 613 bp, Homo sapiens
  misc_feature: GZ8MTXP02GZ37T.13.76.G10.1.454.CMB.2.raw
  modified_base (358)..(358): a, c, t, g, unknown or other
  modified_base (388)..(388): a, c, t, g, unknown or other
tcagtcacgtactacacgaccggtgctcgatttagtcactcatacagggggggagaggagcccagcactgggattccgaggtgtttccattcggtgatcagcactgaacacagaggactaaccatggagttttggctgagctgggttttccttgttgctattttaaaggtgcccagtgtgaggtgcagctggtggagtctggaggaggcttgatccagccgtgggggtccctgagactctcctgtgcagcctctgggttcaccgtcagtcacacctacatgagctcggtccgccgaggctccgaggggaacgggctggagtgcgtctcttttattatagtagtgtagtacatactcgnagactcgtgacggggcatcacatctcaganacaattcaaagacacgtcttacgtttctacaaatcgtaaacagcctaggacgaggcccgatacgaccgtaccggaccgttagtaacttacgtggtcggacggaaggacggtacgggttaccgggggacccctaacgggtaaaccgtttaccgtaacggtacgttaacggtcgggtaccggttacggggtacgggggacccgaaacgggggtaccctaacccgggg

SEQ ID NO: 381750 - DNA, 593 bp, Homo sapiens
  misc_feature: GZ8MTXP02H97XU.13.76.G10.1.454.CMB.2.raw
  modified_base (297)..(297): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtccctgagactctcctgtgcagcctcgtgggttcaccgtcagtcacacctacatgagctgggtccnccagggctccgaaggggaggggctgggagtgcgttcttcttttattatagtagtgtagtacatactcgcagctccgtggacggggccattcactctcctccagacgacaacgtccaaagaaccacgtcttacgtttactaacaaattagaaccacgtcctaggacgacgaccgaagtcgaccgaccgggtccgtagttaagttaccgtggtacgacggaggacggacgtccgggggaccctaacggtaacgtttaaccgacgacgttagtacggggacgttcggacggggaacccg

SEQ ID NO: 381751 - DNA, 636 bp, Homo sapiens
  misc_feature: GZ8MTXP02HBWER.13.76.G10.1.454.CMB.2.raw
  modified_base (374)..(374): a, c, t, g, unknown or other
  modified_base (454)..(454): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggttcaccgtcagtcacacctacatgagcgtgggtccgccgaggcctccgaggggaggggctggagtgcgtcttcttttattatagtagtggtataccatactccgcagacctcgnggacgggggccagttccaccatcctcccaagacgacctaattacccaaagaaccacgtcttgtttactacaaatgaaacngacctgagacgccgatcgaccgacggtccgtagtacttacgtgtcgacggaagaggtacggtaccgggggacccctaaacggtaaaacccggtttaccgtaaccggtaacgttaaacggttcggggtaccccggttacgggttaccgggggtaacccccgtaaacgggggtaaaccccccgg

SEQ ID NO: 381752 - DNA, 551 bp, Homo sapiens
  misc_feature: GZ8MTXP02F9GO3.13.76.G10.1.454.CMB.2.raw
  modified_base (435)..(435): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggcctccgaggggaaggggctggagtgcgtctcttttattatagtagtggtagtaccatactcgcagactcgtgacggggccattccacctatctaccagagacaaatccaaagaacacgcttgttctacaaatgaaacngcctgagagccgatcgacacggcgtagtattactgtgacgagagagtcgggggaccccaacgtaacggttacagcctaagtcggacgtcggtacggggaccccaaggggaaccccg

SEQ ID NO: 381753 - DNA, 784 bp, Homo sapiens
  misc_feature: GZ8MTXP02GKOQR.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttagctgagctgggttttccttgttgctaattttaaaaggtgcccagtgtgaggtgcagcgtggtggagtctgggaggaggcttgatccgaggtccgtcgggggtccctgacgactctcctgtgcagtcctcgtggtcaccgtcagtcacactacatgagcgtcggccgccgaggctaccggaggggaaggggcgtaggagtggtcgttctttactttttaagtttagtaggttagtcggttagtactacgtacctccgacaacgtccgtccggtaggggaccggggaccctacgtttacccaacctaacgttccctaccgaaagtaaacgaaaccttaaaacgttacccgaaaaacggaaccctacggtttactttacgttttaaccttaaacgtaaaattcggaaaacctacggtcccgtaaaggaacgggtacgaaccccggtaagtaccggaaaccggtacccggggtacctttaagttaacgttttaccgaggggttaccggaaggtaaacgggtaacggaacccggggttacccgggggaaaaccccctaaacggtttaaaaccggtttaaacccgtaacccgggtagttaaccgggtacgggggtacccggtttacgggggtaaccgggggaaaacccccgggg

SEQ ID NO: 381754 - DNA, 667 bp, Homo sapiens
  misc_feature: GZ8MTXP02J3K1W.13.76.G10.1.454.CMB.2.raw
  modified_base (302)..(302): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtggggggtccctgagacctctcctgtgcagcctcgtacggggttcaccgtcagtcaccacctacatgagcgtgggtccnccgaggcctaccggaggggaggggctggagtgtcgtcttacttttattatagtagtggtagtaccactactcccgatacgaccgtccggtgggacgggggtaccctattccaaccatcctacccgaaggtaaacgaactaaacttacccgaaaggtaacccacggtctttacgttttacttaaaccgaaatcggaaaccacgtaccgaggacgacgaccgtagtacgaccgtacggtccgttagttacttacgtaggtacggacggaaggacggtaccgggtaccgggaaccctaacgtaaaccgttaccgacgtcgtaacggtacggtaccggtacggtaccggggaaccgaaccgggtacccg

SEQ ID NO: 381755 - DNA, 542 bp, Homo sapiens
  misc_feature: GZ8MTXP02G6VY7.13.76.G10.1.454.CMB.2.raw
  modified_base (479)..(479): a, c, t, g, unknown or other
  modified_base (520)..(520): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctggtccgccaggctccgaggggaaggggctggagtgcgtctctttattatagtagtggtagtacatactcgacagctccgtggaggggccgattcaccatcctccagagaacaattcccaaagaacacgctagtttctacaaaatgaaacagcctgagagccgatcgacacggccgtagtacttactgtgngagagacggtcgggacccaacgtaacgtaacgacgcgtaancgggtactcggagggaacccgg

SEQ ID NO: 381756 - DNA, 605 bp, Homo sapiens
  misc_feature: GZ8MTXP02IY07O.13.76.G10.1.454.CMB.2.raw
  modified_base (359)..(359): a, c, t, g, unknown or other
  modified_base (381)..(381): a, c, t, g, unknown or other
  modified_base (387)..(387): a, c, t, g, unknown or other
  modified_base (395)..(395): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctctgggttcaccgtcagtcacacctacatgagctgggtccgccaggctccgagggaggggctggagtgcgtcttcttttattatagtgtggtagtacatactcgnagactcgtgacgggcatcacanctcagnacatcaanacacgtctgttctacaaatcgtaaacacgcctaggacgacggacccgaagtacgaccgaccgggaccgttggtaactttacgtagtggaccggaagtaggaacggttaccgggggacccctaacggtaaaaccggtttacccgtaaacggcgttaacggtacgggtacccggttcggttaccgggggaaccgaaaacgggggtcccccgg

SEQ ID NO: 381757 - DNA, 598 bp, Homo sapiens
  misc_feature: GZ8MTXP02J1ND1.13.76.G10.1.454.CMB.2.raw
  modified_base (430)..(430): a, c, t, g, unknown or other
  modified_base (496)..(496): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggtcaccgtcagtcacacctacatgagcgtcgggtcccgccgaggcctccgaggggaacggggctggagtggcgttcttcttttattatagtagtggtagtaccatactcgacagactccgtggacggggcctattccaccactcctccagtacaactaacttccaaagaaccncgtcttgttttactacaaatcgaaacagtccagacgagccgatcgacacggccgttatacttacgngtgcgagagacggtaccggggaccctaacggtaaccgtttaacctaccggcttaaggtcgggtaaccgttccggacgggggtaacccaaacggggtaccccg

SEQ ID NO: 381758 - DNA, 633 bp, Homo sapiens
  misc_feature: GZ8MTXP02IYUAK.13.76.G10.1.454.CMB.2.raw
  modified_base (348)..(348): a, c, t, g, unknown or other
  modified_base (382)..(382): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttccaccgtcagtcacacctacatgagcgtgggtcccgccagggcctccggaaggggaaggggcgtggagtgcgttcttcttttattntagtagtggtataccatactccgcacgacctcgngggacgggccagttccaccgtatcctcccaagacaactaacttaccgaaagaaccacgtcctttagttttacctacgaaaagtcgaaaaccgtacgtcccgtaagacggacgtacccgaatacgaccgaaccggtccgttagttacttacgtgtaccgacggtagaggacggtccgggggaaccccaagggttaaaccttacgacgtcgtaacggcggtacgttcggacggggtaccgaacggtaacccgg

SEQ ID NO: 381759 - DNA, 631 bp, Homo sapiens
  misc_feature: GZ8MTXP02H3H11.13.76.G10.1.454.CMB.2.raw
  modified_base (378)..(378): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtcgtccgtgtccccaggacagacagccagcatcactgctctaggaaataattggcagataaatatactctgtatcagcagaagtcaggccacgtcccctgtgctggtcatctatcaagatgaccaagcggccctcgacgggactcccccgtgacgcgtacttctcgtcggtcctaccaactcgtagggaacctcgacgcccactcncgacccacgtacgacgaccgggacccaggtactacgtggaacgtggacggtcgtaggtacttaacgttacgtacggtacgaacgggtcgggttacgggaacgacggacgacgaccgtaaccgtaccggtccccgtacgttaacgttccggttaccgttaccggggtaaaccgttaccgggggaaacccgttaacggggtacccgtaaaccccggttacccgtttaaacgtacccggtaaccgaaaccccccgg

SEQ ID NO: 381760 - DNA, 735 bp, Homo sapiens
  misc_feature: GZ8MTXP02JS7X6.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctctgggttcaccgtcagtcacacctacatgagcgtgggtccgccgaggctccgaggggacggggctggagtggcgtcttacttttatttatagtagtggtagtacctatactcgcagacctcggtggacggggccgtattccgaccacttcctacccgagacgaaccaacttaccaaagaaacctacggtacctttacggtttttccttaacaaaacgttacgaaaccgtacgtaccccgttggaaacggtaccgggacccggtaagttaccggaacccggtacccggggttacccgttaggtttaacgtttaacgttccgggttaggtacccgggaaagggtaaccggtaacgggttcccggggggaaccccctaaacggggttaaaacccggttttaaccgtaccggtaacgttaacgggtacggggaaccggttccgggtaacggggggaacccccgaaacggggggtaaccccccgg

SEQ ID NO: 381761 - DNA, 560 bp, Homo sapiens
  misc_feature: GZ8MTXP02I32FS.13.76.G10.1.454.CMB.2.raw
  modified_base (393)..(393): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctgggggtccctgagactctcctgtgcagcctctgggttcaccgtcagtcacacctacatgagctgggtccgccaggcctccgaggggaaggggctgggagtgcgtcttcttttatttatagtagtgtagtacatactccgcagcgtccgtggacggggccagttcaccntctccagagaacaattacccaaagaaccacgtcttagtttactcaaaattgaaacacgcctagagagcccgatgaccgaacgggccgttagtaatttacgtgtgacgagagagtcggggacccaacggtaacgttaacgacgctagtggacgtcgtacggggaaccg

SEQ ID NO: 381762 - DNA, 663 bp, Homo sapiens
  misc_feature: GZ8MTXP02FNERQ.13.76.G10.1.454.CMB.2.raw
  modified_base (368)..(368): a, c, t, g, unknown or other
  modified_base (405)..(405): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtgggtccgccgaggcctccgaggggaaggggcgtggagtgcgtctcttttattatagtagtggttagtaccatactccgnacgactccgtggacgggggccattccacatctcaganaacaattaccaaagaacacgcttgtttactacaaaatcgaaacacgacctaggaacgacgacccgtagtaccgaaccgaacccggggtcccgttaggttaacctttaacgtggttaccggacggaaggtaaggaaacgggttccgggggtacccccaaaacggggttaaaacccgttaaccgtaaacgggtaaccttaaggttacgggaaaccgggtttcgggtaaccgggggacccgaaaacgggggaaacccccgg

SEQ ID NO: 381763 - DNA, 742 bp, Homo sapiens
  misc_feature: GZ8MTXP02I0ZV4.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgcccagtgtgaggtgcagcgtggtggagtcgtggaggaggtcttgatccgagtccgtcgggggtccctgacgactctcctgtgcagcctcgtcggtcaccgtcagtcacacctacatgacgtcgtcggtcccgccgaggccgtaccggaaggggaacggggcgtgggaggtcggtccgtttcttttacgttttttaagttttagttaggttaggttacgggttacgtaacctacttaccgtccgacgtacgtacccgttccggtggggtacgggggttctacttacccacccgtactccgtacccgaaagtactaaacctaaatacccgaaaagaaacccgtacgttctttagttttacccttaaagaaaagttacgaaaacgtccgtaccgtaggacgacggcccgtaaagtccgaaccgtaccgggtctaagtttacttaacgtggtacgacggaggaaggtccggggtaccgggaccctaaacgggttaaaacccgtttcgaaccggtaagttacgggtacgggtacccggttacggggacccggggaaaccggaacggggtaaccccg

SEQ ID NO: 381764 - DNA, 611 bp, Homo sapiens
  misc_feature: GZ8MTXP02FWCAW.13.76.G10.1.454.CMB.2.raw
  modified_base (296)..(296): a, c, t, g, unknown or other
  modified_base (462)..(462): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtggggggtccctgagactctcctgtgcagcctctgggttcaccgtcagtcacacctacatgagctgggtcccnccgaggctccgaggggacggggctggagtgcgtcttcttttatttatagtagtggtagtacatactcgacagacctccggtggacggggcctattccacctatcctaccaagacgaaactaagttacccaaagaacacgtcttagttttctacaaaatcgaaaacncgcgtagagacgacgagtcgaacgtaccggtacgttagtattacgtggtcgacgaggacggtacggtccggggacccaaacggttaaaccgttcgaacggtcgttaaggtacggaccggttcggacggggaacccgtaacggggacccg

SEQ ID NO: 381765 - DNA, 691 bp, Homo sapiens
  misc_feature: GZ8MTXP02GPLWL.13.76.G10.1.454.CMB.2.raw
  modified_base (173)..(173): a, c, t, g, unknown or other
  modified_base (239)..(239): a, c, t, g, unknown or other
  modified_base (296)..(296): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagcccaccctnagtgtcccgtgtccccaggacagacagccagcatcacctgctcaggaaataatggacagataaatntactctgatcagcagaagtcacggccacgtcccctgtcgctggtccatctatcaagntcgacaagccggcctgaggtctccccgtgacgtgtacttcgtctggcctccaaactcgtacgggtaacctacgacgaccctaacgttccgtaacgaaccctagtacccggaacgggtacccgggtaaccccgaagggtacccttaaggttacggggaagttacggaacgggtacttacggtaacttaacgtttacgtacggtaccggtaaggggtccggtacggggtaaccgaggaacccgtcggacccgtaaaccggtccgtcccggtactttaaccgggttacggtttaccgttaaccgggggaaacccggttacggggaaacccgtaaacggggttacccctaaacccggtacccgtttaaaacggccccgtaaaaccggtaaaccccccgg

SEQ ID NO: 381766 - DNA, 622 bp, Homo sapiens
  misc_feature: GZ8MTXP02FYCFO.13.76.G10.1.454.CMB.2.raw
  modified_base (452)..(452): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtgggtcccgccgaggcctccggaggggaggggctggagtgcgtcttcttttatttatagtagtggtagtaccatacctcgacacgacctcggtggacggggcctattccacctatcctaccagagacctaattacccaaagaaccacgctttagtttaccttaaanaaatacgaaacacgtccgtaggacgacgaccgagtacgaccgacggtcgttagttacttacgtggacgacgaggacgacgggtccgggaacccgtaacggtaaaccgttacgtacgtaacgttacggtacgggaccggtacgggtacggggaaccgaaccggggtacccg

SEQ ID NO: 381767 - DNA, 683 bp, Homo sapiens
  misc_feature: GZ8MTXP02HMMYI.13.76.G10.1.454.CMB.2.raw
  modified_base (470)..(470): a, c, t, g, unknown or other
  modified_base (535)..(535): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctattttaaaggtgcccagtgtgaggtgcagcgtggtggagtcgtggaggaggcttgatccgagccggtgggggtcctgagactctcctgtgcagcctcgtcggttcaccgtcagtcacacctacatgagcgtcgggtccgcgaggcctaccggaggggaaggggctggagtgcgtttcttctttttattagtaggtaggtggtataccgtataccgtccgacgtacgtaccgtccggtgggacgggggtccctaattcccaaccctatccctaccgaaagaacaaactaaacttacccaaaaggaaacccncgtctttacgttttacaaccaaatacggaaacctagcctaggaggaacgccgtaatcggaaaccncccggggtcgttagttaacgttacgttgggacacgggagaggtaacggtcccgggggacccctaaaacggtaaaccgtttaccggacgtaaccgtaggtccgggtaaccggccgggttaccggggaaccggttaaaaccggggccccg

SEQ ID NO: 381768 - DNA, 686 bp, Homo sapiens
  misc_feature: GZ8MTXP02F52HX.13.76.G10.1.454.CMB.2.raw
  modified_base (368)..(368): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccaggccgtggggggtccctgagactctcctgtgcagcctctgggttcaccgtcagtcacacctacatgagcgtcgggtccgccgaggcctccgaggggaaggggcgtggagtgcgtcttcttttattatagtagtgtagtacatactcgnacgctccgtggacggggccgtattcaccatccctcgagacgaacaaacttccaaaagacctaacggtccttggtttacctacaaaaacgttcgaaaacgtacgacccgttaggaacgggaccgacccggtaattacggaacccgtaaccgggggtacccgtttaaggttaacgtttaaaccgtgggttacggaccggaaaggggtaaacggtacgggtacccggggggtaaccccctaaacgggttaaaacccgtttaaacgacccgtacgttaacggtcggggtaaccggttaccgggtcgggggaaaacccccggg

SEQ ID NO: 381769 - DNA, 698 bp, Homo sapiens
  misc_feature: GZ8MTXP02FWCVX.13.76.G10.1.454.CMB.2.raw
  modified_base (257)..(257): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctaattttaaaaggtgcccagtgtgaggtgcagctggtggagtcgtggaggaggcttgatccagccgtgggggtccctgagactctcctgtgtagcctntggtatttgttttagtgtactagttggatggtaggttgggtcccgccgaggcctccggaaggggaacggggcgtaggggaggtggggtcggacccaaacgtaagtaaaaggtacgagtaggtaaagttaggaagtaattaaatttagtttcggaacttcgttggtaggaacggggtcctaagttaccaaccgtacgtcgtacggaacggggaaccaaaccgccaaaacggtactcgacttgttactcgtagaacgtaaagtgggaagacggtcctggaacggacggcccggaagggaccgacgggtcttagtaattaattagttgtgtagaacgtatttacggcgtaccttaaacgtttaccgtttacgaaccgtttaaccgggcggggacccgtaaacggggtaccccctgggtacccctacccggttccttaacccccg

SEQ ID NO: 381770 - DNA, 665 bp, Homo sapiens
  misc_feature: GZ8MTXP02GSZMM.13.76.G10.1.454.CMB.2.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtcgtccccaggacagacagccagcatccacctgctacgtaggaaaattaagtggacaagtaataaatactacttcgtaggtatcagcaagaacgtcacggccacgtccccgtgtcgcgtggtcagttctaatacaagtactcgaccgaagccggaccctcgacggtctcccccgtagacgcgtacttcgtcgtcggtccctacctaacgtcgtacgggaacctcgacgtcccactcgtacgaccacgtaccgaccggggtaccggaaccccgaggtaccgtaggtacgggtagtaggggtaacggtcgttacggtaactttaacgtttacggtaccgtacggttacggggacggtacggggaacacggtccgacgaccgtaccgttccggaccgtaccgttaagtccggttaccgttaccggtaacggttacgggaaccgtaacggtacccgtacccgttacgaaaccgtccgaaccgaaaccccgg

SEQ ID NO: 381771 - DNA, 587 bp, Homo sapiens
  misc_feature: GZ8MTXP02GHEZS.13.76.G10.1.454.CMB.2.raw
  modified_base (452)..(452): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctggttttccttgttgctattttaaaaggtgcccagtgtgaggtgcagctggtggagtctggaggaggcttgatccagccgtgggggtccctgagactctcctgtgcagcctctgggtcaccgtcagtcacacctacatgagcgtgggtcccgccaggctccgaggggaaggggcgtggagtgcgttcttctttttattatagtagtggtagtacatactcgcagcctcgtggacgggccgtattcaccatcctaccgagagaacaattacccaaagaccacgtcttagtttactacaaaatcgaaacngaccgtgaacgtacgccgatacggaccgaacgggtcctagtacttacgtggtgacggagaaggacgttaccgggggaccctaacggtaaacgttaaccgtacgctacgtgggaccgttcggcggggaaaccccgg

SEQ ID NO: 381772 - DNA, 595 bp, Homo sapiens
  misc_feature: GZ8MTXP02H7UJY.13.76.G10.1.454.CMB.2.raw
  modified_base (241)..(241): a, c, t, g, unknown or other
  modified_base (252)..(252): a, c, t, g, unknown or other
  modified_base (317)..(317): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtcctgtactgacgcagccgccctcagtgtcgtcggggccccagggcaggagggtcaccgatctcctgcacgtgggancagctccaacnttggggcacattatgatgtacactggtaccagcagtttaccaggagcgacggtcccagactcctnactacgaatacgtaacaacaactccggaccgcgacggggtccctggaccgtattctcgtcgccttcgagtctggaccacctcgacgtcccgtccctggtccatccgacgtcgggcctccgaggtccttaggagggtacgtaggtaaggccgttggtaacttttacgttctcgtaccctacggttccctaagttacgacgacgccgtaacgtccgtaggtaagttccggtacgtttacggggttacgtttcccgggggccgggggtaacccctacgggg

SEQ ID NO: 381773 - DNA, 494 bp, Homo sapiens
  misc_feature: GZ8MTXP02GNPJ1.13.76.G10.1.454.CMB.2.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaattggggataaatatgcttgctggtatcagcagaagccaggccagtcccctgtgctggtcatctatcaagataccaagcggcctcagggatccccctgagcgattctctggctcaactctagggacacagccactctgaccatcagccggacccaggctgtgactgaggctgactatactgtcaggcgtggacagcagcactcgcctccgttacggaactcgggaaccaggtccaaccggtctacggtccacgcccgaacggcccaaaccccg

SEQ ID NO: 381774 - DNA, 591 bp, Homo sapiens
  misc_feature: GZ8MTXP02GG31R.13.76.G10.1.454.CMB.2.raw
  modified_base (357)..(357): a, c, t, g, unknown or other
  modified_base (366)..(366): a, c, t, g, unknown or other
  modified_base (378)..(378): a, c, t, g, unknown or other
  modified_base (381)..(381): a, c, t, g, unknown or other
  modified_base (386)..(386): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtctggaggaggcttgatccagccgtgggggtccctgagactcccctgtgcagcctctgggttcaccgtcagtcacacctacatgagcgtgggtccgccaggctccgaggggaagggctggagtgcgtctctttattatagtagtggtatacatactccgnagactccgngcgggcatcacntcncaganacatcaagacacgctgttctacaaatcgaacagcctagacgagcccgagtgaacccgacgggtcccgttaggttaacttaccgtaggtacggaccgtaaggacggtaaggtccggggaacccctaacggtaaaccgtttacaccgttacgtaacgtcggggaccgttcggtacgggggaacccgaaacgggggaccctaaccggg

SEQ ID NO: 381775 - DNA, 605 bp, Homo sapiens
  misc_feature: GZ8MTXP02JFXLD.13.76.G10.1.454.CMB.2.raw
  modified_base (303)..(303): a, c, t, g, unknown or other
  modified_base (443)..(443): a, c, t, g, unknown or other
  modified_base (454)..(454): a, c, t, g, unknown or other
  modified_base (472)..(472): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctcgtgggttcaccgtcagtcacacctacatgagctgggtccgccaggtccnccgaggggaaggggctggagtgcgttcttcttttattatagtagtggtagtaccatactcgacagacctccgtggacggggcctattccacctatctccaagagactaacttcaaaggaaccacgtcttgtttcctaaanaaatacgaacncgacgagacgacgacgancgacgtaccggtcgtatacttacgtgacgacggagacggtacggtaccgggaaccctaacggtaaaccgttaccgtacggtaacgtacggtacgggtaccggtcgggaccggggaacccgaacggggtacccg

SEQ ID NO: 381776 - DNA, 555 bp, Homo sapiens
  misc_feature: GZ8MTXP02GJW16.13.76.G10.1.454.CMB.2.raw
  modified_base (385)..(385): a, c, t, g, unknown or other
  modified_base (393)..(393): a, c, t, g, unknown or other
  modified_base (432)..(432): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtggttccaccgtcagtcacacctacatgagctgggtccgccaggctccgaggggagggctggagtgcgtcttcttttattatagtagtggtaagtacatactcgcagctcgtggaggggccatcacntctcaganacattacaaagacacgtcttgttactataaaatgaaacnggcctaggaagtacgaccgatacgaccgacggccttagtacttacgtgagtccggagtaacggacgtcgggaaccccagtaaacgttaacgtacgctaagtcggacgtcggtccgggaaacgg

SEQ ID NO: 381777 - DNA, 655 bp, Homo sapiens
  misc_feature: GZ8MTXP02IRCML.13.76.G10.1.454.CMB.2.raw
  modified_base (435)..(435): a, c, t, g, unknown or other
  modified_base (483)..(483): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctgggtggagtctgggaggaggcttgatccagccgtgggggtccctgagactctcctgtgcagcctcgtgggtcaccgtcagtcacacctacatgagcgtcgggtcccgccaggcctccggaggggacggggcgtgggagtcggtcgttctttcgtttttatttagtagttaggtggttatacctactaccgtccgcacgtaccttccggtgggacggggcccgtattccacctatcctccaaganaacctaactaccaaagaaccacgtcttgtttactacaaaatcgaaacncggacctgacgtacgaccgatcggaacaccgggtcgttaagtacgtttaactggtcggaacggtaggacgggtacgggttacgggggaccccctaacggtaaaacccgttacgttaccggaacgttaaggtcgggaacgtcggtaacgggggaccgaaacgggggtaccccg

SEQ ID NO: 381778 - DNA, 660 bp, Homo sapiens
  misc_feature: GZ8MTXP02H6IYP.13.76.G10.1.454.CMB.2.raw
  modified_base (257)..(257): a, c, t, g, unknown or other
  modified_base (342)..(342): a, c, t, g, unknown or other
tcagtcacgtactacacgaccggtgctcgatttagtcactcatacagggggggagagggagcccagcactgggattccgaggtgttccattcggtgatcagcactgaacacagaggactcaccatggagttttggctgagctgggttttccttgttgctattttaaaggtgccagtgtgaggtgcagctggtggagtcgtgggaggaggcttgatccagccgtggggggtccctggagtactctcctgtgcagcctntcgggttcaccggtcagtcacacctacatgagcgtgggtccgccgaggcctccggaggggaggggcgtaggagtcggcgttcttnttttattagtagtagtggtagtacatacctccgacacgacttccggtggacgggtaccgtacttccacctatcctaccgaagagaactaacttacccaaagaaccctacgtctttagtttcctaactaatacgaaacaggttacccgagggaacgacggaccgaagtacggaaaccgtccggggtaccgtagttaaaccttggtgtacgggacgtaggacgggtacgtacccgggggaccctaaacgggttaaccgtacgtaccgtaacgtagttacggggaccgtttggaccgggggtaaccgaacggggaccccgg

SEQ ID NO: 381779 - DNA, 598 bp, Homo sapiens
  misc_feature: GZ8MTXP02FSKGK.13.76.G10.1.454.CMB.2.raw
  modified_base (458)..(458): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggtcaccgtcagcaccacctacatgagcgtgggtcccgccgaggcctccgaggggaacggggctggagtgcgtcttcttttatttagtagtgtggtatacatactcgcagacctcggtgacggggccgtattccgacctatcctaccaagacgaaacctaattacccgaaaagaccacgtctttagtttacctacaaaangtaaaccagccctaggagacgacccgaatcgaccgacgggccttagtacttacgtgtgacgagtacgaacggtcgggacccaacgtaaacgttccaggtctacggtagaccggtcgtacggggaaccctacgggaacccg

SEQ ID NO: 381780 - DNA, 658 bp, Homo sapiens
  misc_feature: GZ8MTXP02J0XWW.13.76.G10.1.454.CMB.2.raw
  modified_base (235)..(235): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataatggcagataaatntacttcctgtatcagcagagtcaggccagtcccctgtgctggtcatctatcaagatgaccaagccggccctgagggactcccccgtgacgtcgacttcgtctcggtcctaccaaacgttcgtaggggaacctccgacgtcccaccttcctacggaacccagtaccgaacgggacccggggacccgagggaccttagtagggattagggacggtacgtcggtaaccttagttacgtaggttaccgacggggtacgggtcgggaacagggaccgacggaccctaccgttcccgggccccgtacggtttacgttccgggttacccgttaccgggggtaaccgttaccgggggtaaccccgtaaaacggggtccccgttaacccgggtaaccctttaacggtaccccgaaccgggtaaaccccccgg

SEQ ID NO: 381781 - DNA, 551 bp, Homo sapiens
  misc_feature: GZ8MTXP02GINRK.13.76.G10.1.454.CMB.2.raw
  modified_base (397)..(397): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtggggttcaccgtcagtcacacctacatgagctgggtccgccaggctccgagggaggggctggagtgcgtctcttttatttatagtagtggtagtaccatactcgcagactccgtgacggggccattcaccatctccaganacggataccaagaacacgctgtttctacaatgaacagcctagagagccgatgacgacgcgtgtattacgtgtgacgagagagtcgggacccgacgtaacgttaacgtacgtaacgtagtacggtacgtcgtcggggaccgaacggggtaacccg

SEQ ID NO: 381782 - DNA, 604 bp, Homo sapiens
  misc_feature: GZ8MTXP02JHC67.13.76.G10.1.454.CMB.2.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggacagaataaatatacttctggtatcagcagagtcaggccacgtccctgtgctggtcatctatacaagatcgaccaaggccggaccctcgacgggtactcccccgtaggacgtcgtacttctcgttcggccttacccaacgtcgtacgggaacctcgacgccacctcgtacgaccacgtcgacgggacccggacccgaggtacctaaggtcggagtacgggacggtacgtacgtactttaagttacgttggtaccggagggtacgggtacggacgtacggcgaacgcctacgtccggacccgtcgtacgttcggttcgtaccggtaacgtacggggaacctacggtaccaccggtactaacgtaccgaccgtaaccccg

SEQ ID NO: 381783 - DNA, 629 bp, Homo sapiens
  misc_feature: GZ8MTXP02IB0O0.13.76.G10.1.454.CMB.2.raw
  modified_base (267)..(267): a, c, t, g, unknown or other
  modified_base (293)..(293): a, c, t, g, unknown or other
  modified_base (340)..(340): a, c, t, g, unknown or other
  modified_base (361)..(361): a, c, t, g, unknown or other
  modified_base (366)..(366): a, c, t, g, unknown or other
  modified_base (386)..(386): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggggttcaccgtnagtcacacctacatgagctgggtccnccaggcctccgaggggaaggggctggagtgcgtcttctttttattanagtagtgtagtacatactcgnagacnccgtgaggggcattcaccanctccagagacaattccaagaacacgcttgtttactacaaatagaaacacggcctaggagaacgccggaagtacgaaccgacggtaccggttagttaagtttacggtagtacggacggaagggacggtaaacggtaccgggggaaccccctaaaccgggtaaacccgtttaaccgtaccggtaacgttaacgtacgggtaccggttaccgggtaccgggggaacccggtaaaaccggggacccg

SEQ ID NO: 381784 - DNA, 609 bp, Homo sapiens
  misc_feature: GZ8MTXP02JYW93.13.76.G10.1.454.CMB.2.raw
  modified_base (453)..(453): a, c, t, g, unknown or other
  modified_base (488)..(488): a, c, t, g, unknown or other
tcagtcacgtactacacgaccggtgctcgatttagtcactcatacagggggggaggaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggtcaccgtcagtcacacctacatgagcgtcggggtccaccgaggcctccgaggggaaggggctgggagtgcgtcttcttttattatagtagtgtagtaccatactccgacagaccgtccgtggacggggccgattcaccactcctacccagtagaactacgttacccaaggaaccacgtcttgttttacctaanaaactcgaaacacgtccgtaggaagtcgacgtaancgaccggacggtccgttagttagttacgtgtacgacggaggaggtacggtcccggggaccctaacgtaacccgttacgacgtcgttaggcggtacggtcggcggggaaccgaacggacccg

SEQ ID NO: 381785 - DNA, 710 bp, Homo sapiens
  misc_feature: GZ8MTXP02IJOG6.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggagggaggcttgactccgaggccggtcggggggtccctgacgactctcctgtgcagcctcgtcgggttcaccgtcagtcacactacatgagcgtcgggccgccgaggcctccggaggggaggggcgtaggagtcgtccgtttctttacgtttttatttaagtaggtaggttaggtagtaccctactaccgtccgacgtacgtaccgttccggtggggacggggtacccgtacttacccgacctactcctacccgaagtacgaaacctaacgtaccaaagaaccacgttctttacgttttacctaaacgtaaaactcgaaaaccgtacgtaccgtaaggaacgacgtaccggaagtccggaacgtaccgggtacgttagttaactttacggtgtacggacgaaggtaggtacggtaccgggggaaaccctaacggtaaaccgtttacaacggtaaccgtaaggttccgggaacggttccggaccgggggaaccgaaacggggtacccgg

SEQ ID NO: 381786 - DNA, 771 bp, Homo sapiens
  misc_feature: GZ8MTXP02HN96N.13.76.G10.1.454.CMB.2.raw
  modified_base (293)..(293): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggtcaccgtcagtcacacctacatgagctgggtccnccaggctccgagggaaggggctggagtgcgtcttcttttatttatagtagtggtagtaccatactccgacagtaccgtccgtggacggggtccagtttccaaccgtactcctacccgaaggtaacgaacctaaaacgtttacccaaaacgtaaaccctaacggtcctttacggttttaccctttaaccaaaaagtttacggaaaacccgtacggttaccccgttaagggaaaccgggtaaccggacccccgggttaaagttaccgggaaaccccgtaaacccgggggtccccggtttaaggttaaaccgttttaaccgttggggttacggaccgggtaaagggaacgggtaaccggttacggggggaaacccccctaaacgggttaaaacccggtttaacccgtacggtaacccgttaaagtcggggtaacccggttcggttaccggggggaaccccgaaaacgggggtaacccccgg

SEQ ID NO: 381787 - DNA, 688 bp, Homo sapiens
  misc_feature: GZ8MTXP02GR50C.13.76.G10.1.454.CMB.2.raw
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtctggaggaggcttgatccagccgtgggggtccctgagactctcctgtgcagcctcgtgggttcaccgtcacgtcaccacctacatgagcgtgggtccgccgaggcctccgaggggaaggggctggagtgcgttcttctttttattatagtagtgtagtacatactccgcagactccggtgacgggccattccactatcctaccagaacgaactaaacttaccaaaagtaaaccaccgtacttacggttttaccttaacaaaattaacggaaaccaagtacccctaggaacgacggacccgaaagtcggaaacccgtaccggggtacccggttagttaaacgtttaccgtggttacggacggaaagggaggtaacggttaccggggggaccccctaaaaccgggtaaaaccgttttaaccgaaaccgtaccgttaaaaggtccggggtaaaccggtttccggtaccggggggaacccaaaacccgggggg

SEQ ID NO: 381788 - DNA, 636 bp, Homo sapiens
  misc_feature: GZ8MTXP02HHAEB.13.76.G10.1.454.CMB.2.raw
  modified_base (480)..(480): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtccctgagactctcctgtgcacgcctcgtgggttcaccgtcagtcacacctacatgagcgtcgggtcccgccgaggcctccggaggggaacggggcgtggagtgcgtcttcttttattatagtagtggtagtacatacctcgcagacctcggtggacggggcctattccacctatcctacccgaagacgaaacctaaacttacccgaaaagaaaccacgtcttacgttttacctaacaaaatcgaaaaccncgtacctaggacgacgccgaatcgaaccgtacgggtaccgttagttaacttacgtgtacggacgaaggaggacgtacgggggaaccctaaaggtaaccgttacgtacgaacgttagacgggtacgttacggcggggaacccgaacggggtaccccg

SEQ ID NO: 381789 - DNA, 629 bp, Homo sapiens
  misc_feature: GZ8MTXP02JD32A.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggttgattctggaggaggcttgatccagccgtgggggtccctgagactctcctgtgcagcctcgtgggttcaccgtcagtcacacctacatgacgcgtcgggtccgccgaggcctccggaaggggaacggggctggggaggtggggttcggaccgttaagttaaacggtagaaagacgagtggtacccggacaacgagtttacacaggttcgttcccgtagaaaggcagtacttacaactactctacgaaagagatagaaactaacaaaagaatagaatactattacagaacaaaagtacgaaaacctaaaccgtaaaggaaaacgcggaaacggaacgaacggaacggtacgttaagtaacttaacgtacgtaacccaagacgagtacgggacctagactaagactaaacgcgggaccgacggacgacgttaaccgg

SEQ ID NO: 381790 - DNA, 702 bp, Homo sapiens
  misc_feature: GZ8MTXP02G7BSN.13.76.G10.1.454.CMB.2.raw
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccacctcagtgtccgtgtcccaggacagacagccagcatcacctgctctaggaaataattggacagaataaatatactctggtatcagcagaagtcaggccagtcccctgtgctggtcatctatcaagatcgccaagccggacccctgaggggtactcccccgtgacggtcgacttcctcgtcgggtccttacccgaaagttccgtaggggaaaccttcgaacggtcccctaaccgttacctaacggaacccccagttacccgaacgggggtacccgggggaacccccaagggggtcccctttaaaacggggtacgggtaacggttaagggaaccgggtacgtaacggttaacgtttaactttaccggttacggtaccggtacggggtacggtacggggaacctaggaccgtacgaaccgtaccgtccggtacccttacgttacgttccggttacccgttaaccgggtaacggtaccggggaaacccgtaacggttacccgtaaccgtaaccgtaaccggtaccgaacccggaccccg

SEQ ID NO: 381791 - DNA, 584 bp, Homo sapiens
  misc_feature: GZ8MTXP02GU992.13.76.G10.1.454.CMB.2.raw
  modified_base (367)..(367): a, c, t, g, unknown or other
  modified_base (393)..(393): a, c, t, g, unknown or other
  modified_base (448)..(448): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagcgtggttttccttgttgctatttaaaggtgcccagtgtgaggtgcagctggtggagtcgtggaggaggcttgatccagccgtgggggtccctgagactctcctgtgcagcctctgggttcacgtcagtcacacctacatgagctgggtcccgcgaggcctccgaggggaaggggctggagtcgcgtcttcttttagttatagtagtggttagactatactccgnagctcggtggacgggccgattcaccnttccaccagagactaactccaaagaccacgtcttagttcttacgaaatcgaaacncgtacgaggacgacgacgtaagtacgaacgtaccggtacgttagttacgtacgtaggagacggagacggacggtccgggaaccctaacggtaacgtcgtacgtacgtacggcggtacggtccggtacgggaacccg

SEQ ID NO: 381792 - DNA, 664 bp, Homo sapiens
  misc_feature: GZ8MTXP02G5RSZ.13.76.G10.1.454.CMB.2.raw
  modified_base (270)..(270): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccacctcagtgtccgtgtccccaggacagacagccagcatcacctgctctaggaaataatggcaagataaatatactctggtatcagcagaagtcaggccagtccccngtcgctggtcaatctaatcaagatgaccaaagcggccctgaggggactccccccgtagacgtccgaatttccgtcgttcgggccttacccgaaaacttccgtacgggggaaaaccttcgaaacccgtaccctacctccgtaacgaaccaacgtaccgaaccgggacccgggaaacccgtaaggtaccgtaaggtacggtaacgtacgggtaacggtacgttaacgttaacctttaagtttacgtacggtaccggacggggtacgggtacgggaacgaacgacgacgacgaccgtaccgtacccgtacgtacgttacgttaccgttacggtaaccggtaacggtaaccgtaacggtaaccgtaccgtaaccgtaaccgtaccgtaaccgaacccg

SEQ ID NO: 381793 - DNA, 682 bp, Homo sapiens
  misc_feature: GZ8MTXP02HW0AE.13.76.G10.1.454.CMB.2.raw
  modified_base (381)..(381): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtctgggaggaggcttgatccagccgtgggggtccctgagactctcctgtgcagcctctcgggttcaccgtcagtcacacctacatgagcgtcgggtccgccgaggcctaccggaaggggaacggggcgtgggacgtggtcgttcttctttttattagtagttagtggtatacactactcganagtacctcggtggacggggcctacttaccgacctactcctacccgaaagagaaaccttaaacttccgaaaagaaaccctacgtcctttacgttttaccttaacaaaagttcggaaaactaccgaccgttaaggaacggaacgcccgaataccgaccggtaaccggtccgttagttaacttcgtaggtacgacggtaggaacggtacggtccgggggaaacccccaaacgttaaacccgttacaacggaaccttaggttaccgggacggttacggtccgggggaaacctaacggggaccccg

SEQ ID NO: 381794 - DNA, 650 bp, Homo sapiens
  misc_feature: GZ8MTXP02G8PH9.13.76.G10.1.454.CMB.2.raw
  modified_base (282)..(282): a, c, t, g, unknown or other
  modified_base (466)..(466): a, c, t, g, unknown or other
  modified_base (548)..(548): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtctgggaggaggcttgatccagccgtggggggtccctgacgactctcctgtgcagcctcgtggtcaccgtcacgtcacacctanatgagcgtcgggtccgccgaggcctccggaggggaggggctgggagtcggcgttcttctttttattagtagtagtggtataccatacctcgctagcctcggtggacggggtcgtacttccaccgactcctccgaaagcgaacctaaattacccaaggaacctacggtcttacgtttaccttaanaaaacgttgaaacctggtacccttgggaacgaccgtacccgaatccggaacccgtacggggtccttagttaacgttaccggngtacgacggaacgtaggacggttccggggaccctaacgtaacgtttaccgacgtaagtacgtaggggcccgtacgggtaccgggaccggaacgggtaccccg

SEQ ID NO: 381795 - DNA, 554 bp, Homo sapiens
  misc_feature: GZ8MTXP02FQ2CK.13.76.G10.1.454.CMB.2.raw
  modified_base (234)..(234): a, c, t, g, unknown or other
  modified_base (493)..(493): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctctgcactgggancagctccaacattggggcacattatgatgtacactggtaccagctagtttccgaggagcgacggtcccagactcctcatcaaatacgtaacaacaaatccggacccgcgacggggtcccctagacccgtattcctcgtcggcctcccgagtcctcggccaccgtcacgccctccgtcgtcactacacgtcgggcctccgaggccgtggaggactggaggctagttacttattcgtcgccgtacgtcctagtcgaaaccncgacgacgtcgtgtaacgttcgtacggttacgggtccggtccgggggaccgggtaccgtcg

SEQ ID NO: 381796 - DNA, 570 bp, Homo sapiens
  misc_feature: GZ8MTXP02HX6WE.13.76.G10.1.454.CMB.2.raw
  modified_base (334)..(334): a, c, t, g, unknown or other
  modified_base (439)..(439): a, c, t, g, unknown or other
  modified_base (449)..(449): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcacccgtcagtcacacctacatgagcgtgggtccgccgaggcctccgaggggaaggggctggagtgcgtcttnttttatttatagtagtggtagtaccattacctccgacagtacctccgtggagggggcctattccaccatctccagagacaattccaaagaacacgcttgttctanaaatgaaacngcctgagagccgatcgacgacggtccgtagttaactcgtgtgcgagagcgtcggggcccaacgtaacgttactacggctacgtacggaccggtcgtacgggggaccaaaacgggggtcccg

SEQ ID NO: 381797 - DNA, 658 bp, Homo sapiens
  misc_feature: GZ8MTXP02IGTFH.13.76.G10.1.454.CMB.2.raw
  modified_base (272)..(272): a, c, t, g, unknown or other
  modified_base (387)..(387): a, c, t, g, unknown or other
  modified_base (633)..(633): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtcgggttccaccgtcngtcacacctacatgacgcgtgggtcccgccgaggcctccggaaggggaaggggcgtgggagtcgtcgttctttctttttaatttagttagtagtggtagtacctatacctccganagtaccgtcggtggggacggggacccgtattaccgacctatccgtacccaaaggacaaccgtaaacttaccgaaaagtaaaccctaccggtcttttacgttttaccttaacaaaattcgaaaactccgtaccgtaggaacgtacggacccgtaagtacggaccgtaacgggtccttaaggttacttacgtggtacgacgagaagcggtcgggaaccctacgaaacgttcacgctagtcggtaccgngtaccgggggacaacggggtacccg

SEQ ID NO: 381798 - DNA, 636 bp, Homo sapiens
  misc_feature: GZ8MTXP02FX10P.13.76.G10.1.454.CMB.2.raw
  modified_base (292)..(292): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcactgctctaggaaataatggcagaataaatatacttctgtatcagcagaagtcaggccagtcccctgtgctggtcattctatcaaagntcgaccaaggccggcccctcgaacggggactccccccgtggacgcgtactttcgtccgtcgggcctaccgaaaccttcgtacggggaacccttcgacgccctaacgtctcgaacccatccgagacccgggacccaggctaagtggatggtagacgtagtacttaagtttaccgtagtccgaagggtcgggtagggacacggacgaacggacctaaccgtccgggtaccccgtcgttaacgttcggttacccgtttaacggggaaccggttaccggggaaaccgtaaacgggtacccgtaaacccggttacccgtaaacggtacccgaaccggtaaaacccccgg

SEQ ID NO: 381799 - DNA, 608 bp, Homo sapiens
  misc_feature: GZ8MTXP02GX43P.13.76.G10.1.454.CMB.2.raw
  modified_base (365)..(365): a, c, t, g, unknown or other
  modified_base (405)..(405): a, c, t, g, unknown or other
  modified_base (461)..(461): a, c, t, g, unknown or other
  modified_base (509)..(509): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagcgtggtggagtctggaggaggcttgatccagccgtgggggtccctgagactctcctgtgcagcctcgtgggttcaccgtcagtcacacctacatgagcgtcgggtccgccgaggctccggaggggaaggggctggagtgcgtcttcttttattatagtagtgtagtacatactcganagacctcgtggacggggctacttccaccatcctacaaganaacctaataccaaagaaacctacgtctttagtttacctaacaaaagtcgaaaaccncgacctaggagacgaccgatacgacgaccgggtcttagtaacttacgngtagcggaagtacgacggtcgggggacccctaaggtaaaccttccgacgaacgttacgtacgggtaccgtcggtacgggggaccgaaacggggaccccg

SEQ ID NO: 381800 - DNA, 761 bp, Homo sapiens
  misc_feature: GZ8MTXP02IAZOE.13.76.G10.1.454.CMB.2.raw
  modified_base (543)..(543): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtctgggaggaggcttgatcagccgtgggggtccctgagactctcctgtgcagcctcgtgggttcaccgtcagtcacacctacactgacgcgtcggtacccgccgaggcctaccggagggggaaggggccgtaggggaggtcggtccggtttcgtttacttttttaagtttagtaaaggtttaggttagggtaacgtacctacttaccgtccgacgtaacgtaccgttccgggtggggaccgggggtacctacgttaccaacctacgttacctacccaagggtaacaaaccgttaaacttaaccgaaaacggaaacctaccggttcgtttacgtttttaccctaaanaaaacgttaccgaaaaccgtacggtaccgttaagggaacggaccggtacccgaagttacggaaacccgtcgggggtacccttaggtttaaacttccgtaggcgtacggaagggaggtacggtacccgggggaccctaaacggtaaccgtttacgaccggtaacgttaggtaccgggtaacggttccgggacgggggaacccaacgggggtaaccccgg

SEQ ID NO: 381801 - DNA, 771 bp, Homo sapiens
  misc_feature: GZ8MTXP02J1C9P.13.76.G10.1.454.CMB.2.raw
  modified_base (296)..(296): a, c, t, g, unknown or other
  modified_base (328)..(328): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagtctgggtccnccaggcctccgagggaggggctggagtgcgtntcttttattatagtagtggtatacgatactccgcagactccgtggaggggcctattcaccatctccaagacgaacaaacttcccaaagtaaccacggtcttaggtttttacctaacctaaaatacgaaacccgaggtaccccgttagggaacggtaacgacccccggttaaagtacccggaaaccccggaaccgggggtcccccggttttagggttaaacccctttttaacggggtacgggttaacgggtaaccggggtaaaacgggtaaacgggggttaaccggggtaacccccgggggtaaacccccgtaaaaccggggttaaaaccccgttttaacccgggtaaaccggttaaccgttaaacggggttaccgggggtaaaccccgggtttaccgggggtaacccggggggaaaccccggtaaaccgggggtaacccccgg

SEQ ID NO: 381802 - DNA, 555 bp, Homo sapiens
  misc_feature: GZ8MTXP02JHJGP.13.76.G10.1.454.CMB.2.raw
  modified_base (449)..(449): a, c, t, g, unknown or other
tcagtcacgtactacacgaccggtgctcgatttagtcactcatacaggggtctaggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctcgtgggttcaccgtcagtcacacctacatgagcgtcgggtcccgccaggcctccggaggggaaggggctgggagtgcgttcttcttttatttatagtagtggtagtacatactccgcacgctccgtggacggggccattcaccatctcagagacaactccaaagacacgtcttgtttctacaaatgaaacncgcctagagacgaccgatcgacgacggtccgtagtattacgtgtcgacgagagagtcggggacccacggtaacgttcacgtctacgtggaccgtcggagggaaccg

SEQ ID NO: 381803 - DNA, 559 bp, Homo sapiens
  misc_feature: GZ8MTXP02GI6EB.13.76.G10.1.454.CMB.2.raw
  modified_base (293)..(293): a, c, t, g, unknown or other
  modified_base (489)..(489): a, c, t, g, unknown or other
tcagtcacgtactacacgaccggtgctcgatttagtcactcatacagggggggagaggagcccagcactgggattccgaggtatttccattcggtgatcagcactgaacacagaggactcaccatggagttttggctgagctgggttttccttattactattttaaaaggtgtccagtgtgaggtgcagttggtggagtctggaggaggcttgatccagccgtgggggtccctgagactctcctgtgcagcctctgggttcaccgtcagtcacacctacatgagctgggtccnccaggctccgagggaggggctggagtgcgtctcttttattatagtagtgtagtacatacctccgcagactccggtgacggggccgtattccactactcctccagacgacaattcccaaagacacgcttgtttcttacaaatgaacagtacctgagacgtccgatgaccacggccgtatacttactgtgcgagacgngtcggggacccaggaacgttacacgctagcgggacgttcgtacgggggaccaaagggcccgtacggtccc

SEQ ID NO: 381804 - DNA, 600 bp, Homo sapiens
  misc_feature: GZ8MTXP02I2CWU.13.76.G10.1.454.CMB.2.raw
  modified_base (251)..(251): a, c, t, g, unknown or other
  modified_base (324)..(324): a, c, t, g, unknown or other
  modified_base (365)..(365): a, c, t, g, unknown or other
  modified_base (553)..(553): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcngcctcgtgggttcaccgtcagtcacacctacatgagctgggtccgccaggctccgaggggaaggggctggagngcgtcttcttttattatagtagtggtagtaccatactccgnagactcgtggacggggccattccacatcctcagacactaataccaaagtaacacgtcttagtttctaacgaaatgaaaccagacctaggagacgccgtaatcgaacgaccggtcgtagttacttaacgtggtacgacggtaggaggtacgtacccgggggaccctaacggtaaaccgttacgtaccgngtacgtacggggtacctcggtacgggggaccgaaacggggtaccccg

SEQ ID NO: 381805 - DNA, 667 bp, Homo sapiens
  misc_feature: GZ8MTXP02IGXGA.13.76.G10.1.454.CMB.2.raw
  modified_base (170)..(170): a, c, t, g, unknown or other
  modified_base (237)..(237): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctctaggaaataattggacagataaatntacttctgtatcagcagagtcaggccacgtcccctgtgctggtcatctatacaagactttaccgaaggtccggcccctacgacggggacctccccgtaggacgtccgtactttccgtcgtacggtcctccctaacgttcgtacgggaaacccttcgaacgtccctaccgtctacgaaccctacgttccgacggcccggggaacccgagggtaccctaaggtacgggtacgttacgggaacggtccgttacggtaaccttttagttacgtcgggtaccgtacggggtcggtacggggacacggaccacggtacccgtaacgtccggacccggtactaacgttcggtaccgtttacgggaaccgttacgggaacccgtaaggtacccgtaacccgtaccgtaaaacgtccgaaaccgtaacccgaaacccgg

SEQ ID NO: 381806 - DNA, 605 bp, Homo sapiens
  misc_feature: GZ8MTXP02JRVFJ.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctggggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtgggtccgccaggctccgaggggaaggggctggagtgcgtcttctttattatagtagtggtagtacatactcgcagcctccggtaggacgggggtccattccaacctatcctacccgaagacgaactaacttacccaaaagaccaacggtcttagtttccttaacaaaattcggaaactcgcctagacggacgccgtaatcggacgacgggccgttagtaacttacgtggtcgacgaaggaggacggtcgggggacccctaaggtaaaccgttaacgtacgacgtagtacggaccggtcggcgggggaaacccgg

SEQ ID NO: 381807 - DNA, 597 bp, Homo sapiens
  misc_feature: GZ8MTXP02HIOXX.13.76.G10.1.454.CMB.2.raw
  modified_base (371)..(371): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtctgggaggaggcttgatccagccgtgggggtccctgagactctcctgtgcagcctcgtgggttcaccgtcacgtcacacctacatgagcgtcgggtcccgccaggcctccggaggggaacggggcgtagggagtgcgttctttcttttatttatagtagtggtataccatacnccgcagtactcgtggacgggcctagttccaccgtatcctaccaagacgaaactaacttaccgaaagaaccacgtacttacgtttactaacaaatacgaaacacgtacctaggagacgaccgtatcgacgacggtaccgtgttacttacgtgtgacgtagagacgtcggggaccacggtaactacgtacgcgtagtcggacgtcgtacggggaccgaacgggacccg

SEQ ID NO: 381808 - DNA, 663 bp, Homo sapiens
  misc_feature: GZ8MTXP02FOJWW.13.76.G10.1.454.CMB.2.raw
  modified_base (252)..(252): a, c, t, g, unknown or other
  modified_base (372)..(372): a, c, t, g, unknown or other
  modified_base (383)..(383): a, c, t, g, unknown or other
  modified_base (414)..(414): a, c, t, g, unknown or other
  modified_base (465)..(465): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttaattttaaaaggtgcccagtgtgaggtgcagctggtggagtcgtggaggaggcttgatccagccgtcggggggtcctgagactctctgtgcncgcctcgtggtcaccgtcagtcacacctacatgagcgtcgggccgccgaggcctaccggaggggaggggctgggagtggcgttcttctttttattatagtagtggtataccatctccganacgccgtcggngggacggggcctactccacctatcctcaganaactaactaccaaagacctacgctttgtttacctacaaaaatcgaaaaccncgaccgtaggaagaccggccgtaagtccggaacccgtaccggggttccgtttaagtttaacgttcgtagggtacggacggaagggtaacggtacgggtacccgggggaaccccctaaaacggttaaacccgttacgaacggtcgttaaggaccgggtacggtccggggacgggggaaaccccgaaacgggggtacccc

SEQ ID NO: 381809 - DNA, 571 bp, Homo sapiens
  misc_feature: GZ8MTXP02FIXHH.13.76.G10.1.454.CMB.2.raw
  modified_base (236)..(236): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcaggaggtcaccatctcctgcacgtgggancagctccaacagttggggcacattatgatcgtacactggtaccagctagtttccaggagcgacggtcccagctcctcatcaatacgtaacaacaatccggacccgcgacggggtccctacgaccgtattcctcgtcggctccgaggtctcggcacctcgacgtccctccctcggtcactcgaccgtcggggcctccgacggctaggacggagtcggaggtcttagttacttacgtttcgtcgtacctacgttacctaagtcgacgacgaccgacgtcccgtaggcgttcgtcgtttacgggtacggtttccgggggaccgggggtaccctacggg

SEQ ID NO: 381810 - DNA, 617 bp, Homo sapiens
  misc_feature: GZ8MTXP02I0OG2.13.76.G10.1.454.CMB.2.raw
  modified_base (536)..(536): a, c, t, g, unknown or other
  modified_base (580)..(580): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtcgggtccgccgaggcctcccggaaggggaacggggcgtggagtgtcgttcttcttttattagtagtagtaggtagtacatactccgcacgacctcggtggacggggccgtattccaccactcctacccaagacgaaactaaacttaccaaaagaaccacgtcctttatttacctaacaaaaatcgaaaactcgacctaggaagacgtacccgaatacggaacccgtacgggtccgttagtacttacgngtcgacgagaggacgtccggggaacccacgtaaacgttcaacgngtaacgtcggacgtcggacgggaccgaacgggacccg

SEQ ID NO: 381811 - DNA, 767 bp, Homo sapiens
  misc_feature: GZ8MTXP02HEXBU.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgcttattttaaaaggtgcccagtgtgaggtgcagcgtggtggagtcgtgggaggaggtcttgactccagccgtgggggtccctgagacctctcctgtgcacgcctcgtggttcaccgtcacgtcacacctacatgagcgtcgggtcccgccgaggccgtaccggaaggggaacggggcgtggggacggttcggtccggtttcctttacgtttttaattttaagttaagggtttaaggttaggggttaacgtaaccctaacgtacccttcccggactaacggtacccgttccgggtgggggtaacgggggtcccgtaacttacccgaaccctacgtcctacccgaaagaacgtaaacctaaacgttacccgaaaagtaaacccaccggtcctttacgtttaccttaacgaaaagttacgaaacacgtccgtaggaacgacgacccgagtacggaccgacgggtcccgtagttaacgttacgtgtacgacggtaaggaaggtacgggtaccgggggaacccccttaacgggtaaaacccgtttaccgtaaccgtcgttaacggtacggggttaacccggtcggtacgggggaaccccgtaaacggggacccccg

SEQ ID NO: 381812 - DNA, 617 bp, Homo sapiens
  misc_feature: GZ8MTXP02H184K.13.76.G10.1.454.CMB.2.raw
  modified_base (322)..(322): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcacgtcacacctacatgagcgtcgggtccgccgaggcgtccgagggaggggcgnggagtgcgtcttcttttattatagtagtggtatacgggggatactcgcagacgtcgtggacgggcgacgtcacctactctaccagacgaacaacttaccaaacgaacacgtcttacgtttacttaactaaatacgaacaacgccgtagagacgaccgagtacgaccgaccggtaccgtacgttactttacgtcgtagacggaggaggacggtacggggacccgaaccggtaaaccgttaacgtaccgtaacgtacgtacggtacggtacggtcgggaccggaacgggaaccccgg

SEQ ID NO: 381813 - DNA, 583 bp, Homo sapiens
  misc_feature: GZ8MTXP02GEIZS.13.76.G10.1.454.CMB.2.raw
  modified_base (368)..(368): a, c, t, g, unknown or other
  modified_base (393)..(393): a, c, t, g, unknown or other
  modified_base (405)..(405): a, c, t, g, unknown or other
  modified_base (423)..(423): a, c, t, g, unknown or other
  modified_base (436)..(436): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagctggtccgccaggctccgagggagggctggagtgcgtcttcttttattatagtagtcgtagtacatactccgcagcctcgnggacggggcattcacatctccaganacaattccaaanacacgtcttgtttactanaaattggaaaccnggtacctggaagacgaccgagtacggaaccgacgggtaccgttagtaactttaccgtgtacggcgaccggtaggacgggttcgggaccgttcggacgggggaacccgtaaaggggaccctacggggtcccaccgttccgtcctaccg

SEQ ID NO: 381814 - DNA, 649 bp, Homo sapiens
  misc_feature: GZ8MTXP02GZE55.13.76.G10.1.454.CMB.2.raw
tcagtcacgtactacacgaccggtgctcgatttagtcactcatacaggggctcggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttccaccgtcagtcacacctacatgagcgtcgggtcccgccaggcctccggaggggaacggggctgggagtgcgttcttctttaattagtagttagtgtacgtactatacctcgcacgccgtccggtaggacggggtcctattccgaaccacttcctcgaacgtaacgaactaacttacccgaaagtaacctacgtactttagtttacccttaagaaaacgtcgaaacacgtacccgtgaacggacgacccgagtacggacgaccggtacccgttaggtaacttacggtggtcgacggaggaggacgggtccgggaaccctaaccggtaaacgttaaccgaccggtacgtaacggtacgggtacggttcgggacggggtaaacccggg

SEQ ID NO: 381815 - DNA, 589 bp, Homo sapiens
  misc_feature: GZ8MTXP02HDOUO.13.76.G10.1.454.CMB.2.raw
  modified_base (522)..(522): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtcgggttcaccgtcacgtcacacctacatgagcgtgggtccgccgaggcctaccggaggggaaggggctgggagtggccgttcttctttttagtttatagttaggtagtagtactataccgtcgcagcctccggtggacgggggccacgttccaccatctaccgagaagactaaattccaaaagaccacgtacttgttactactaaaatcgaaacagtccagagacgccgagtacgacgtacggccgttagttactactggtcgnggagagacggtcggggaacccacggtaacgttcgacgtctagtacggaccttcgggacggaacccgg

SEQ ID NO: 381816 - DNA, 635 bp, Homo sapiens
  misc_feature: GZ8MTXP02I8M2R.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtcctgagactctcctgtgcagcctcgtgggtcaccgtcagtcacacctacatgagctcgggtccgccaggcctccggaggggaacggggctgggagtgcgtctttcttttattataggtagtggtagtactatactccgacagccgtccggtggacgggggccctattaccacctactcctacccaagacgaactaattacccgaaagaacccagtcttgtttacctacaaattggaacacgcctagagacgcccgagtacgaccgtacgggccgttagtagttaccgtaggtcgtacggaggaacggtacggttacccgggggacccctaacggtaaaccggtttaaccgaaccgggttactacgggtacggtaccggttccgggtacgggggtaaaccccgg

SEQ ID NO: 381817 - DNA, 550 bp, Homo sapiens
  misc_feature: GZ8MTXP02GLD2H.13.76.G10.1.454.CMB.2.raw
  modified_base (393)..(393): a, c, t, g, unknown or other
  modified_base (430)..(430): a, c, t, g, unknown or other
  modified_base (440)..(440): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtggttcaccgtcagtcaccacctacatgagcgtgggtcccgccgagggcctccggaggggaaggggcgtggagtgcgtcttcttttattagtagtagtggtatacatactcgacagctcgtggacgggccatcacntctcagacgacaatccaaagacacgtcttgttactanaaatgaaacncgctagagacgaccgatacgacgtacggcgttagtattacgtgtacgacgagagcggtcgggacccaacgtaacgttaacgacgctagtcggacgtcggagggaacccgg

SEQ ID NO: 381818 - DNA, 567 bp, Homo sapiens
  misc_feature: GZ8MTXP02HF0IQ.13.76.G10.1.454.CMB.2.raw
  modified_base (296)..(296): a, c, t, g, unknown or other
  modified_base (340)..(340): a, c, t, g, unknown or other
  modified_base (360)..(360): a, c, t, g, unknown or other
  modified_base (452)..(452): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctctggggttcaccgtcagtcacacctacatgagcgtggtccnccaggctccgagggaggggctggagtgcgtcttcttttatttanagtagtggtagtacataccncgcagacctcgtggacgggggtcctagttcacctatcctaccacgagacaaacttaccgaaagaacacgtcctagtttctacaaatgaaacngacctgagacgaccgatcgacacgggcgtagtaattctgtgcgaggagtacgtcggggacccacgtaacgttactacgcgtagtcggacgtcgtacgggaccgaacgggaacccg

SEQ ID NO: 381819 - DNA, 658 bp, Homo sapiens
  misc_feature: GZ8MTXP02GWT68.13.76.G10.1.454.CMB.2.raw
  modified_base (558)..(558): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtcgggtccgccgaggcctaccggaggggaaggggctagggagtcggtcgttctttacgtttttatttatagttagtggttagtacctatacctcgacagtaccgttccggtggggacggggccgtattaccgacctactaccctaccgaaagtacgaaacctaaacttaccgaaaacggaaacccacgtctttacgtttaccttaacaaagtacgaaacacgcctaggaacgacgtaccggatacgacgaccggtcgttagtaattacgngtcgacgagaggacggtaccggggaccctaacggtaaacgttactacggtaaccgttagaccgggtacgtacggtacgggggacccgaacggggaacccg

SEQ ID NO: 381820 - DNA, 637 bp, Homo sapiens
  misc_feature: GZ8MTXP02HXWC6.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggaggaggcttgatccagccgtgggggtccctgagctctcctgtgcagcctcgtggtcaccgtcagtcacacctacatgagctcgggtccgccaggctccgaggggaaggggcgtgggagtgcgttcttcttttattatagtagtggtagtacatactcgcagctcgtgacggggccatcactatcctcagacacaattacccaaagaccacgtcttacgtttacttacaaaattcgaaacacgtcctaggaacgacgacccgaagttcggaaccgaccgggtaccggttagtttaactttaaccggttggtacggcggtaaaggaacggtacggttaccgggggaacccctaacgggttaaaacccgtttaacgtaacccggtacgttacggttacgggtacccggttacggttaccgggggaaaccccgg

SEQ ID NO: 381821 - DNA, 653 bp, Homo sapiens
  misc_feature: GZ8MTXP02HSX1J.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggggtctggaggaggcttgatccagcctgggggtcccgtcgagactctctgtgcgcgcctcgtcggttcgtaccgtcacgtcaccacctacatgagcgtcggtccggccgacggcgtccggacggggaacggggcggtggtaggtggtcgttcgtttcttttattttagttagttaggttaggtagtactactactccgccgacgcgtccgtcggtacggggaccggtacgtactaccactacctccacgacgaactaactaacctaaacgaaacgaacgtacgttcgtttactttactaaactaacgtaacgacgtaccgtacgaggacgaccgacgtacgacgacggaccggtacgttacgttacgttcgtggcggacggaggacggtacgggtaccggaaccgtaaccgttaacgtacgtacgtacgtacggtacggtacggtacgggtaccgg

SEQ ID NO: 381822 - DNA, 878 bp, Homo sapiens
  misc_feature: GZ8MTXP02GDY82.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtgggttcaccgtcagtcacacctacagtgacgcgtcgggtcccgccgacggcctaccggaagggggaacggggccgttaggggacggttcggtccggtttccttttacgttttttaagtttttaagttaagggttaagggtttaggggtttaacggttaacccctaacgtttaaccccgtccccggtaccgtaacggtaaccccgttcccggggttacgggggaaccggggggtaccccgttaacgttttaccccgaacccccgtaactttacccgttaccccggaaagaaaccggtaaaacccttaaacgtttaaccccgaaaaacgggtaaaccctacccgggttacctttttacggtttttacccctttaaacgaaaaacgtttccggaaaaaaccgtcggtaccccgttaagggaaacgggaaccggtacccccggtaaagttacccgggaaacccggtacccggggttacccgtttaagttaacgtttaccgtgggtacgacggtaagacggtacggtaccgggggaaccccctaaaggtaaacccgttacctaacggtcgttaacggtcgggtaccggtaccggtacgggggaacccgtaaacgggggtaacccccg

SEQ ID NO: 381823 - DNA, 639 bp, Homo sapiens
  misc_feature: GZ8MTXP02GSQ99.13.76.G10.1.454.CMB.2.raw
  modified_base (296)..(296): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtcgggtccnccgaggctccgagggaggggctggagtgcgtcttcttttattatagtagtggtagtacatactcgcagacctcgtggacggggccgattccgaccagtcctccagacaacaacgaccaaacgaacctccctagtactctagacaaatgaaacagcccgtagacgagcctaggaaggaccgacgggtcctttaggtaatttacgttggtacgtaaaccgaaaaggtaccttaacccccgtaaaccccgtttaaggttaccgttttttagggaaggtttaacggtttaacgtaaacccgggtaggggtcgggggtaaccccaacgggggtaaccccgtttcgggg

SEQ ID NO: 381824 - DNA, 662 bp, Homo sapiens
  misc_feature: GZ8MTXP02ISLIW.13.76.G10.1.454.CMB.2.raw
  modified_base (169)..(169): a, c, t, g, unknown or other
  modified_base (209)..(209): a, c, t, g, unknown or other
  modified_base (220)..(220): a, c, t, g, unknown or other
  modified_base (228)..(228): a, c, t, g, unknown or other
  modified_base (234)..(234): a, c, t, g, unknown or other
  modified_base (238)..(238): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctctatgagctgactcagccaccctnagtgtccgtgtcccaggacagacagccagcatcactgctntagaaatatgnagataatntactcngtancagcagaagtcaggccacgtcccctgtgctggtcatctatcaaagatcgaccaaaggccggaccctacgaagggtctcccccgtagacgtacgtatttcgtcgtcggtcctacccaaacgttccgtaacggggaacccttcgaacgtcccctaacttcctacggaacccaacgtaccgaacgggacccggggaaccccaaggggtccttaaggagggacttaggggaacggtccttaaggtaaccttaatttaacggttcggtaccggaacggggtcggttagggggaaacacggacgaaacggttccaacgtcgggacccctagttacgtacggttaccgttaacgggaaccgttacggggaaacccgtaacgggtaccctaaacccgggttaccttaaacggtccgaaccggaaacccccgg

SEQ ID NO: 381825 - DNA, 613 bp, Homo sapiens
  misc_feature: GZ8MTXP02HJD3I.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtctggaggaggcttgatccagccgtgggggtcctgagactctcctgtgcagcctcgtggttcaccgtcagtcacacctacatgagctcggtccgccaggctccgaggggaagggcgtggagtgcgtcttctttatttatagtagtgtagtactatactccgcacgcgtcgtggacggggccgtattcacctatcctccaagacgaactaacgttacccaaagaaccacgtacttcgtttacttaacaaaattcgaaactacggtcctaggaacgacgaccgtagtacgaccgacgggtcccgttagttaacgttacgtgtacgacggaacgaggtacggtacgggggacccctaaggtaaaccgttaacgtacccggtattacggacggtacggttccggtacgggggaacccg

SEQ ID NO: 381826 - DNA, 774 bp, Homo sapiens
  misc_feature: GZ8MTXP02ISDUI.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgccagtgtgaggtgcagctgggtggagtcgtggaggaggcttgatccgagccgtgggggtcctgagactctcctgtgcagcctcgtggtcaccgtcagtccacacctacatgacgtcgtcgggtccccgccgacgggccgtaccggaagggggtaacggggccgtggggtacggttcggtcggtttctttacgtttttaagtttagttaaagggttaggttagggttaacgtaactaacgttaccgtacccggaccgtaacggtccgttccgggtacggggaccggggggtaccccgttaacgtttacccgaaacccttaaccgttcccgttacccgaaacggtaaacgtaaacccttaaacgtttaacccgaaaaacgtaacccgaaccggttaccgtttacgttttacctaacgtaaaacgttaacgaaaccgtaaacgtcccgtaggaacggaccgaccgtagtacggaaccgacggggtccgtagttacttacgtggtacggacggaaggtacggacgggtaccggggacccgtaacggtaaaccgttaacgtaccgtacgtaacggtcggaaccgtcgggtacggggaaacccgg

SEQ ID NO: 381827 - DNA, 709 bp, Homo sapiens
  misc_feature: GZ8MTXP02JNDRG.13.76.G10.1.454.CMB.2.raw
  modified_base (448)..(448): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtggtccgccaggcctccgaggggaggggctggagtgcgttcttcgttttatttagtagtacgtggtagtacctatacctcgacacgacctccggtggacgggggcctattccaccgtatcctacccgaagagtaaacctaacttaccgaaaggaaacccnccgtacgtttacgtttttaccctaacgtaaaaattcggaaaaccacggtaccgttagggaacgaccgggccccgaaattcgggaaacctaccggggtacccggttaggtttactttaaaccggttcggggtacgggaacgggtaacggtaacgggtaccgggttacccgggggaacccctaaaacgggttaaacccgttacgacggtaacgtacggtaccggtaccggtaccggtaccggggacccgtaaccggggtcccg

SEQ ID NO: 381828 - DNA, 771 bp, Homo sapiens
  misc_feature: GZ8MTXP02HNWGV.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtcgggtcccgccgaggcctaccggaggggaacggggcgtgggagtcggcgttctttactttttatttagtagttaggtggtaagtacctactaccgtccgacaacgtaccgttccgggtggggacgggggtacccgtactttcccgaacccgtactcctacccgaaagtaacgaaacctaaacgttacccgaaaacgtaaacccgtaccgttccgtttacgttttacccttaactaaaagttaccgaaaaccgtacggtacccgttagggaaacggaccggtaccggtaaagtaccgggaacccgtacccggggtcccggtttaagttaaacgtttaccggtgggttcggtaacggaagggtaacgggtacgggttacccgggggaaccccttaaaccgggtaaaccgtttaaccgaccggtaacgtaaacgggtcgggttaaccggtcggtaccgggggaaccgtaaaccgggggtaaccccg

SEQ ID NO: 381829 - DNA, 596 bp, Homo sapiens
  misc_feature: GZ8MTXP02IBHZG.13.76.G10.1.454.CMB.2.raw
  modified_base (477)..(477): a, c, t, g, unknown or other
  modified_base (518)..(518): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtccctgagactctcctgtgcagcctcgtcggggttcaccgtcagtcacacctacatgacgctcggggtccgccgaggcctaccggaggggaacggggctgggagtggcgttcttctttttattatagttagtggtagtacataccgtccgacagacctccgtggacgggggctattccaccctatcctccaagacgaactaacttaccaaaagaactacgtctttagtttactaacaaatagaaaccncgtactagagacgcgagtacgacgacgtcgtattagtacgngcgacgagagacgtcgggaccctaacgtaacgttacgacgtaacgtagtcggtacgtacggacgggaccgaacggccg

SEQ ID NO: 381830 - DNA, 596 bp, Homo sapiens
  misc_feature: GZ8MTXP02I8WRE.13.76.G10.1.454.CMB.2.raw
  modified_base (170)..(170): a, c, t, g, unknown or other
  modified_base (291)..(291): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctctaggaaataatggcagataaatatacttctggtatcagcagaagtcaggccagtcccctgtgctggtcatctatcaagntgcaagccgcctcgaggactccccgtgagcgtattctctgcctccaactcgtaggaacctcgacgccactctacgacccagtcgaacggccgggaccccagggtcctaagcggtagtacggaggtctagtacgtatttacgtacgtccgagggccggtagggacacggacgaacggctaaccgtcggacccgtacgttaacggttccgttaccgtttaccgggaaaccggttacggggaaaccccgtaacggggttacccgaacccggtttaccgtaaacggtaccccgaacggtaaacccccgg

SEQ ID NO: 381831 - DNA, 674 bp, Homo sapiens
  misc_feature: GZ8MTXP02GI9NK.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtggttccaccgtcacgtcacacctacatgagcgtcgggtccgcgacggcctccggaagggggaacggggcgtagggaggtcggccgttctttactttttaatttagtaggttaggtggttaagtactatacctccgcacgccgtccgtggacggggtccgatccacactcctaccagagaactaattacccgaaagaacctacgtcgtttactttaccttaacaaaacgttcgaaaaccgtacgtaacccgtagggaaacggtaacggaccccgtaagttacggaaccggtaaccgggtcccgtttaggttaaaactttacgtggtacgacgggtagacggacggtccgggggacccctaacggtaaaccgttaacgacgtactaggtacggacgttcggtacgggggaaaccccg

SEQ ID NO: 381832 - DNA, 619 bp, Homo sapiens
  misc_feature: GZ8MTXP02HRPQ9.13.76.G10.1.454.CMB.2.raw
  modified_base (247)..(247): a, c, t, g, unknown or other
  modified_base (249)..(249): a, c, t, g, unknown or other
  modified_base (260)..(260): a, c, t, g, unknown or other
  modified_base (266)..(266): a, c, t, g, unknown or other
  modified_base (280)..(280): a, c, t, g, unknown or other
  modified_base (313)..(313): a, c, t, g, unknown or other
  modified_base (318)..(318): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagtttttggctgagcgtggtttcgtgtaggctattttaaaagtgccagtgtgaggtgcagctggtggagtctggaggaggcttgatccagcctggggggtccctgagactctcctgtgcncnctcgtcggtcnccgtcncgcacactacatgngcgtcggtccgccgcggcgtcggagggaggggngtggngtcgtcgtctttattttatttatagtagtgtagtacctatactacacacgtacgtcgtcggacgggtcgtactacctacctactacctaccgagacgaactaactaacgaaacgaacgtacgtactttacgtttacttacgtaaactaacgaacgtacgtacgtacgtagacgacgacgtacgtaccgacggtacgtacgttagttacgtgtcgtacgaggagacggtacgggtaccgtacgtaacgttaacgtacgtaacgtacgtacggtacggtacggtacgggtaccggacggaccg

SEQ ID NO: 381833 - DNA, 781 bp, Homo sapiens
  misc_feature: GZ8MTXP02IL9J4.13.76.G10.1.454.CMB.2.raw
  modified_base (249)..(249): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcngcctcgtgggtcaccgtcagtcacacctacatgagtcgtcgggtcccgccgacggccgtccggaaggggaacggggcgtgggagtcggtcgtttcctttctttttaatttagttaggttacggttagggtagtaacctactaccgtcccgtacgacgtaccgttccggtggggaccgggggcctaaacttcccaacctacgttcctacccgaaaggtaactaaacctaaacgttacccaaacggaaacctaccgcttttacgttttacccttaacgaaaacgttcgaaaaccgtcgacccgtaggaaacgccggaccgtaaagtacccggaccgtaacccggggttcccgttaaggtttaccctttaacggttggacggtaaccgggaaaggaacggtaccggggttaacccggggggaaccccctaaaacgggggtttaaaaccctttaaccgacccggtaagttaccggttacgggaaccggtttccggggacgggggaaacccccggttaaaacgggggtaacccccgg

SEQ ID NO: 381834 - DNA, 581 bp, Homo sapiens
  misc_feature: GZ8MTXP02HT8XR.13.76.G10.1.454.CMB.2.raw
  modified_base (365)..(365): a, c, t, g, unknown or other
  modified_base (442)..(442): a, c, t, g, unknown or other
  modified_base (499)..(499): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgccaggctccgaggggaaggggctggagtgcgtcttcttttatttatagttagtggtagtaccatactccgnagacctccggtgacgggggccattccacatctccagagacaattccaaagaacacgcttgttactacaaatcgaaanacgacctggaacgacgacccgaagtcgaaccacggggtcccgtgttaactcgttggngacgaggagacgtcggtaccgacgtaaccgtaacgtacgtaacgtacgtacggtacggtacggtacgggacggtaccggacg

SEQ ID NO: 381835 - DNA, 637 bp, Homo sapiens
  misc_feature: GZ8MTXP02IWCSP.13.76.G10.1.454.CMB.2.raw
  modified_base (496)..(496): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctctgggttcaccgtcagtcacacctacatgagctgggtcccgccaggctccgagggaggggctggagtgcgtcttcttttatttatagtagtgtagtaccatactccgcacgactccgtgggacggggcctattccaccatcctaccagacgaactaattaccgaaagaacacgtcttgtttacttacaaatgaaacagcctagacgacgccgaatcgacacgggtccgttagtacttacgngtcgaccgaggacggacggttaccgggggaccccctaaacgggttaaaacccgttacccgttaaaccggtaaccgttaaacggttcggggtaacccggttccgggtaccgggggaaccccgaaaacgggggtaacccccgg

SEQ ID NO: 381836 - DNA, 652 bp, Homo sapiens
  misc_feature: GZ8MTXP02GUOV8.13.76.G10.1.454.CMB.2.raw
  modified_base (248)..(248): a, c, t, g, unknown or other
  modified_base (274)..(274): a, c, t, g, unknown or other
tcagtcacgtactacacgaccggtgctcgatttagtcactcatacgagggggaggctctgcttcagctgtgggcacaagaggcagcactcaggacaatctccagcatggcctggtctcctctcctcctcactctcctcgctcactgcacgagggtcctgggcccagtctgtactgacgcacgcccgccctcagtgtccgtcggggcccccagggcaggacgggtccaccatcctcctgcacgtgggancagctccaacagttggggcacattangatgtacacgtggtaccagctagtttccgaggagcgacggtccccagtacctcctacactacaaatacgtaaacaacacgtccggcccgcgacggggtccctgaccgtattcctcgtgcctccgacgtctcggcacccgtcaccgtccctcccgtggtactactccgaccgtcgggcccttaccggaggtaccgttggagggtacgtcggtaacggtccgttaggtaactttacgtttccgtacgggtaccctaacgttcccgtaagttacggtacctaacggcccgtaacggtcccgttaaggtaacgttccggttaccggtttaccggggttaaccggtttccccgggggtacccgggggaaccccttacccgggg

SEQ ID NO: 381837 - DNA, 642 bp, Homo sapiens
  misc_feature: GZ8MTXP02I938D.13.76.G10.1.454.CMB.2.raw
  modified_base (513)..(513): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtgggtccgccgaggctccgaggggaaggggctggagtgcgtcttctttttagttatagtgtggtagtaccatacgtccgcagtacctccgtgagacggccgattccacatccaccagacgacaacttccaaagaacacgtcttagtttctacaaaagtgaaacctagcccgttagacggacgacccgtaatcggaacgaccgggtccgttaggttaactttacgnggttacggaccggtaaagaggaacggttccgggggaccccctaaaacgggttaaccgtttaccgtaaccggtaccttacgggtacggggtacccgtaccgggttacgggggacccgtaaaacccggggg

SEQ ID NO: 381838 - DNA, 571 bp, Homo sapiens
  misc_feature: GZ8MTXP02FFS1B.13.76.G10.1.454.CMB.2.raw
  modified_base (295)..(295): a, c, t, g, unknown or other
  modified_base (360)..(360): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagctgggtccnccaggctccgaggggaaggggctggagtgcgtctcttttatttatagtagtggtagtaccatacnccgcagacctcggtgacggggccattccacctatcctaccagagacaattccaaagaaccacgcttgtttactcaaaatcgaaacagcctgagagaccgatcgacgacggtccgtgtaattacgtgtgacggagaggtacgtccgggggacccaaacggtaacgtactaacgctagtcggacgtcggtacggggaccgaaggggaaccccg

SEQ ID NO: 381839 - DNA, 546 bp, Homo sapiens
  misc_feature: GZ8MTXP02IK3YR.13.76.G10.1.454.CMB.2.raw
  modified_base (361)..(361): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctctgggttcaccgtcagtcacacctacatgagctgggtccgccaggctccgagggaggggctggagtgcgtctctttttattatagtagtggtagtaccatactcgnagactcgtggagggccgattccaccatctcagagacaatccaagaacacgcttgtttctacaaaatgaaacagcctgaagagcccgaatgacgacggccgtgtattactgtgcgagagacggacggaccgaccgtaacgtacgtacgtaacgtacgtacgtacgtacgtcggaccggaacggacg

SEQ ID NO: 381840 - DNA, 589 bp, Homo sapiens
  misc_feature: GZ8MTXP02G51I9.13.76.G10.1.454.CMB.2.raw
  modified_base (298)..(298): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtcgggtcccnccgaggcctccgaggggaaggggctggagtgcgttcttcttttattagtagtagtggtagtacatactcgcagacctcgtgggcggggcctagttccacctatcctacccaagacgaaacctaattacccgaaagaaaccacgtcttggtttactacaaattgaaacagcctagagagccgatcgaacgacggccgttagtacttacgtgtagacgagacgagtccggggaccctacgtaaacgttcaacgcgttaagtcgggacgtcgtcgggggaaccaagggaccccg

SEQ ID NO: 381841 - DNA, 560 bp, Homo sapiens
  misc_feature: GZ8MTXP02IQVOG.13.76.G10.1.454.CMB.2.raw
  modified_base (369)..(369): a, c, t, g, unknown or other
  modified_base (432)..(432): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctggggttttccttgttgctattttaaaaggtgcccagtgtgaggtgcagctggtggagtctggaggaggcttgatccagcctggggggtccctgagactctcctgtgcagcctctggggttcaccgtcagtcacacctacatgagctgggtcccgccaggcctccgagggaggggctggagtgcgtcttcttttattatagtagtggtagtacatacctcgcagctcgngagggccattccaccatctccagagacaattccaagaacacgcttgtttctacaaatgaaacngcctgagcgccgatgacgacggtccgtgtattactgtgtacgagaggacgtcgggggacccaacggtaaaccgttactaccgtcgtagtacgggtacgtccgtacgggggtcccaaagggggaccccg

SEQ ID NO: 381842 - DNA, 558 bp, Homo sapiens
  misc_feature: GZ8MTXP02F7GFC.13.76.G10.1.454.CMB.2.raw
  modified_base (447)..(447): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctatttaaaggtgcccagtgtgaggtgcagctggtggagtcgtggaggaggcttgatccagccgtggggggtccctgagactctcctgtgcagcctctgggtcaccgtcagtcacacctacatgagcgtgggtccgccgaggcctccgaggggaaggggctggagtgcgtcttctttatttatagtagtgtagtacatacctcgacagactccgtggcgggccgtattccaccatctccagagactaaagttccaaagaacacgtcttacgtttactacaaaatgaaacngacctagagacgaccgatcgacacgggctagtatacgtgtcgacgtagagaggtccggggacccacgtaacgttcacgctagtcggacgtcgcggggaccacgggtacccg

SEQ ID NO: 381843 - DNA, 659 bp, Homo sapiens
  misc_feature: GZ8MTXP02JBOF7.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagccgtgggtccgccaggctccgaggggaggggctggagtgcgtcttctttattagtagtagtggtagtacatactccgacacgtacgtccggtaggacgggggcccgtattccgaaccctattaccctacccgaagacgaaactaaacgttacccgaaaagaacccacggtcctttagtttacctactaaagtcgaaacgacgcccttaggacggacgcccgtagtacggaaccgacggtaccgttagtacttacgtggtaggacggtaaggtaaggtacggtaccgggggaccccctaaaaggggttaaccgttaaccgtacggtaccgttaagggtcgggtaaccggtccgggtaccgggggaaacccgg

SEQ ID NO: 381844 - DNA, 529 bp, Homo sapiens
  misc_feature: GZ8MTXP02GBMOR.13.76.G10.1.454.CMB.2.raw
  modified_base (391)..(391): a, c, t, g, unknown or other
  modified_base (464)..(464): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggggtcaccgtcagtcacacctacatgagctgggtccgccaggctccgaggggaggggctggagtgcgtctcttttatttatagtagtggtagtaccatactcgcagctccgtggagggcattcaccatctcaganacattccaaagacacgcttgtttctacaaatgaacagcctgagacgccgatcgacacggccgtagtattacgngtgcgagagcgtcggggacccacgtaacgtcacgctagtacggactcgcgggaccaagggtaccc

SEQ ID NO: 381845 - DNA, 578 bp, Homo sapiens
  misc_feature: GZ8MTXP02IDPTA.13.76.G10.1.454.CMB.2.raw
  modified_base (461)..(461): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctcgtgggttcaccgtcagtcacacctacatgagcgtcgggtcccgccgaggcctccggaggggaaggggcgtggagtgcgttcttctttttattatagtagtggtagtacatacctccgcagacctccggtgggacggggcctattccacctatctaccagagaacctaataccaaagaacacgtcttagtttactacaaatgaaacncgcctagacgacgccgatcgaccgacggccgttagttactacgtgtgacgagagacgtcggggacccacgtaacgttcacgtgtacgcggtacgtcggtcgggaccgacgggacccg

SEQ ID NO: 381846 - DNA, 641 bp, Homo sapiens
  misc_feature: GZ8MTXP02H3XGD.13.76.G10.1.454.CMB.2.raw
  modified_base (382)..(382): a, c, t, g, unknown or other
  modified_base (461)..(461): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagctggtagagtctgggaggaggcttgatccagccgtggggggtccctgagactctcctgtgcagcctcgtgggttcaccgtcagtcacacctacatgagcgtgggtccgccgaggcctaccggaggggaaggggctaggagtgcgttcttctttttattatagttagtggtagtaccatacctcgcagactccgngacggggcacttcacatctccagacgaacaacttacccaaagaaccacggtcttacgtttactaacaaatacgaaaacncgtacctaggaacgacgacccgatacggaaccgacgggtaccgtgttaaacgttcgtaggtcgacggaaggacggaacgtccgggggaccctaaacggtaaccgtttaaccgaccgtaaccgttaaggtacgggtaccggttaccggtacgggggaacccgaaaacggggtacccccggg

SEQ ID NO: 381847 - DNA, 736 bp, Homo sapiens
  misc_feature: GZ8MTXP02GY7TV.13.76.G10.1.454.CMB.2.raw
  modified_base (564)..(564): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtctgggaggaggcttgatccagccgtgggggtccctgagactctcctgtgcagcctcgtcgggttcaccgtcagtcacacctacatgagcgtcgggtcccgccgaggccgtaccggaaggggaacggggccgttagggaggttcggtcggtttaccttttacgtttttaagttttaagttaaggtttaggttagggttaacgttaaccctacgttaccgttcccgacgtacggtaccgttccgggtggggacgggggtccgtaacttacccgaacctactcctacccgaaaggacaaacctaaacttaccgaaaacggtaacctaccggtctttacgttttacctaaacgaaaattcggaaaacncggtccgtaggaagacgtaccgaatacggaaccgtcgggtacgttgttaacttacggtgtacgacggaagtaggacgggttccggggaacccctaaaggtaaaccgtttccgaaacgtcgtaaggtccggggtacgttccgggaacgggggaacccgaaacggggtaccccg

SEQ ID NO: 381848 - DNA, 688 bp, Homo sapiens
  misc_feature: GZ8MTXP02JTMGC.13.76.G10.1.454.CMB.2.raw
  modified_base (244)..(244): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagcccgccctcagtgtccgtcggggcccccagggcaggagggtccaccatcctcctgcacgtgggancagctccaacagttgggcacattatgatgtacactggtaccagctagtttccgaggagcgacggtcccagtacctcctcatacctaataacgtaacaacaacgtccggacccgcgacggggtccctacgaccgtacttcctcgtcgccttccgaggtcctcggcctaccgtccgacgtcccctcccgtcggtacctacgtaccgtaccggttcgggcccgttaccggacgggttaccgtacgggaggggttacgtacggggtaacggtaccggtttagttaacgttttacgtttacgtccggtacccgtaaccgtttaccgttacgttaacggaccgtaaacggttcccgaacgtcccggttagaacggtttaccggtttaccggtttaccgggggtttaaccggggtttccccgggggaaccgggggtaaccccgtaccgggg

SEQ ID NO: 381849 - DNA, 564 bp, Homo sapiens
  misc_feature: GZ8MTXP02JWX1H.13.76.G10.1.454.CMB.2.raw
  modified_base (364)..(364): a, c, t, g, unknown or other
  modified_base (375)..(375): a, c, t, g, unknown or other
  modified_base (441)..(441): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtctggaggaggcttgatccagccgtgggggtccctgagactctcctgtgcagcctcgtcggttcaccgtcagtcaccacctacatgagcgtcgggtccgccgaggcctccggaggggaaggggcgtggagtgcgttcttcttttattatagtagtggtatacatacncgcagactcgnggacggggcctatccacatcaccagagacatcaaagaccacgtcttgtttactacaaatcgaaacngtcctgaagacgcgagtcgaaccgacgggtcgtattacttacgtggtcgacgaggagacggtcggggaccaacgtaacgttacacgcgacggttcggacgtcggacgggaccgaagggccccg

SEQ ID NO: 381850 - DNA, 747 bp, Homo sapiens
  misc_feature: GZ8MTXP02FQM71.13.76.G10.1.454.CMB.2.raw
  modified_base (194)..(194): a, c, t, g, unknown or other
  modified_base (286)..(286): a, c, t, g, unknown or other
  modified_base (290)..(290): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagcgtggtttcgtgtagctatttaaagtgccagtgtgagtgcagctggtgagtntggaggaggcttgatccagccgtgggggtccctgagctctcctgtgcagcctgtggttcacgtcagtcaccactacatgagtctcgggtccnccgnggtcgaccggaaggggaggtcgtgggagtcgtcgtttacttttacttttaagttagtaggttaggttacggttaagtacctacgtacctcgactacgtccgtcgggtagggacgggtacctacttaccacctactccaccgaagaactaacctaaacttaacccgaaaacgtaacctacgttccgtttacgttttaaccttaaacaaaggttacgaaaccgtacgtaccgtacggtaacggaaccgtaccgtacgtacggtaaccggtaaccggttaccggtttaacgtttaacgtttacgttacggtacggtacgggtaacgggtaacgggttaacggggttacccggggtaaccccggtaaacccggttaaaacccggttaaaccggttaaaccggtaaccggttaccggttaccggggtaaccgggttaccggggtaccgggggtaacccgggg

SEQ ID NO: 381851 - DNA, 617 bp, Homo sapiens
  misc_feature: GZ8MTXP02GM0YG.13.76.G10.1.454.CMB.2.raw
  modified_base (281)..(281): a, c, t, g, unknown or other
  modified_base (366)..(366): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctggattttccttttggctattttaaaaggtgtccagtgtgaagtgcagctggtggagtcgtggggggagcttgggtacagcctggcaggtccctgagactctcctgtgcagcctctggattcacctttgatgattangccatgcacgtgggtccgcaagcctccgaggggaacggcctagggaggtggggtctcgagggttattaggttaggaatggtggancatagggctagtggcggactctggtaggaacgggccgtattcccacccgattccctacccgaaggtacgaaccgaacccggaccaaacgaacccttcccgtagtaactctagactaaagtcgaaacgagcctaggagacgcgtaggacggactaccgggtcctttaggtaatttacgtagtacgaactaaaaacgcttaaccccgtaaccccgtttacggtatttttacgggaacgtttacggtttaacgg

SEQ ID NO: 381852 - DNA, 613 bp, Homo sapiens
  misc_feature: GZ8MTXP02GBQ2A.13.76.G10.1.454.CMB.2.raw
  modified_base (249)..(249): a, c, t, g, unknown or other
  modified_base (266)..(266): a, c, t, g, unknown or other
  modified_base (279)..(279): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctctgtgcngcctcgtggtcaccgtnagtcacacctacntgagcgtcgggtcccgccaggcctccggaggggaacggggctaggagtggcgtcttcttttatttatagtagtggtataccatacctcgacagactcgtggacggggcctagttccaccgtaatcctaccgaagagaactaaacttaccaaagaacacgtcttagtttccttaacaaaatcgaaaactacgaccgtaggacgacgacccgaataccgaccgtaccggtccgtagttactacgtgtcgacggtagagacggtcggggaccctacgtaaaccgttactaacgctaacggtcggaaccgtcggtacggggaccaacgggtaaccccg

SEQ ID NO: 381853 - DNA, 621 bp, Homo sapiens
  misc_feature: GZ8MTXP02HOPVX.13.76.G10.1.454.CMB.2.raw
  modified_base (366)..(366): a, c, t, g, unknown or other
  modified_base (375)..(375): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtcgggtccgccaggctccgaggggaaggggctggagtgcgtcttcttttatttatagtagtggtataccatactccgnagacctcgnggacgggccattccaccactctcccaagacgaactaattacccaaagaacccacgtctttcgtttaccttacaaaattcggaaacacggtcctaggacgacgacccggtatccggaaccgacgggtccgttagttaacttacgtagtcggacgaggtagacggtcgggggacccctaacggtaaccgtttaccacggtaaccgtagcgggtaccgtacggtacgggggaaccaaacggggaccccg

SEQ ID NO: 381854 - DNA, 564 bp, Homo sapiens
  misc_feature: GZ8MTXP02GXY5L.13.76.G10.1.454.CMB.2.raw
  modified_base (294)..(294): a, c, t, g, unknown or other
  modified_base (406)..(406): a, c, t, g, unknown or other
  modified_base (410)..(410): a, c, t, g, unknown or other
  modified_base (431)..(431): a, c, t, g, unknown or other
  modified_base (440)..(440): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagctgggccnccaggctccgaggggagggctggagtgcgtctcttttattatagtgtagtagaccatactccgcagactccgtggacggggcctagttccaccatctccagagacaatcaanaacncgctgttctacaaatgaaacncgctagagngaccgatacgacgaccggtctagttatacgtgcgtacgagacgacgtcgggggacccaacggtaaccgttaccgtaacgcgttacgcggtaccgtcggtacggggacccgaaacggggaccccg

SEQ ID NO: 381855 - DNA, 524 bp, Homo sapiens
  misc_feature: GZ8MTXP02HEABJ.13.76.G10.1.454.CMB.2.raw
  modified_base (267)..(267): a, c, t, g, unknown or other
  modified_base (293)..(293): a, c, t, g, unknown or other
  modified_base (302)..(302): a, c, t, g, unknown or other
  modified_base (330)..(330): a, c, t, g, unknown or other
  modified_base (390)..(390): a, c, t, g, unknown or other
  modified_base (396)..(396): a, c, t, g, unknown or other
  modified_base (398)..(398): a, c, t, g, unknown or other
  modified_base (404)..(404): a, c, t, g, unknown or other
  modified_base (409)..(409): a, c, t, g, unknown or other
  modified_base (411)..(411): a, c, t, g, unknown or other
  modified_base (413)..(413): a, c, t, g, unknown or other
  modified_base (416)..(416): a, c, t, g, unknown or other
  modified_base (419)..(419): a, c, t, g, unknown or other
  modified_base (421)..(421): a, c, t, g, unknown or other
  modified_base (423)..(423): a, c, t, g, unknown or other
  modified_base (426)..(426): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtctggaggaggcttgatccagccgtgggggtcctgagactctcctgtgcagcctctgggtcaccgtnagtcacacctacatgagctgggtccnccaggtccnccgaggggaaggggctgggagtgcgttntcttttattatagtagtcggtatacatactcgcagctccgtgacggggccatcaccatcncagaananatacanacacntntntanaanananacncgagagagacgacgacgacgacgacgtagtactacgtcgtgagagagacgacggaccgacgaacgtaacgtacgacgtacgtagacgtcgtacggacg

SEQ ID NO: 381856 - DNA, 579 bp, Homo sapiens
  misc_feature: GZ8MTXP02HMXGF.13.76.G10.1.454.CMB.2.raw
  modified_base (445)..(445): a, c, t, g, unknown or other
  modified_base (454)..(454): a, c, t, g, unknown or other
  modified_base (469)..(469): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctcgtgggttcaccgtcagtcacacctacatgagctgggtccgccgaggctccggaggggaaggggctggagtgcgttctttacttttatttagtagtagtggtatacactactccgcagaccttccgtgggacggggccaattccacctatctccagacgacaattccaaagaacacgtcttgttactaanaatagaacngctagagacgacgancgacgtacggtcgttagtactagtgagacgagagtacggtaccgggaccctacgtaaccgttacgacgtaacgtagtacggtacgtcggtacgggaccgtaaacggaccg

SEQ ID NO: 381857 - DNA, 600 bp, Homo sapiens
  misc_feature: GZ8MTXP02ILKKY.13.76.G10.1.454.CMB.2.raw
  modified_base (407)..(407): a, c, t, g, unknown or other
  modified_base (446)..(446): a, c, t, g, unknown or other
  modified_base (452)..(453): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctcgtgggttccaccgtcagtccacacctacatgagcgtcgggtcccgccgaggcctaccggaggggaaggggctggagtgcgttcttcttttatttatagtagtggtagtacatactcgcagactcgtgacggggcattcaccatctccaaganactaatccaaagaactacgtcttgtttactacaaaagtnaaaacnncctagacgagaccgatcgaaccgcggtccgttggttattacgtggcgacgaggagaacgtcgggggacccctaaacgggtaacctttaaccgacgtccgttagacgggtacccggttcggacgggggacccgaaaacggggaccccg

SEQ ID NO: 381858 - DNA, 792 bp, Homo sapiens
  misc_feature: GZ8MTXP02IRLNJ.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggaggaggcttgactccgaggccgtggggggtccctgagactcctcctgtgcagcctcgtcgggttcaccgtcagtcacacctacagtgagcgtcgggtccgccgaggtcctccggaagggggaacggggcgtagggagtcggtcggttcctttacttttttagtttagtacggttaggtaggttaacgttaccacttaccgtcccgacacggtaccgttccggtggggaaccgggggcctaagtttcccgaacctactccttaccgaaacgggaacaaacctaaaacgttcccgaaaaaagtaacccgtaacgttccgttttacgttttaccttaaaacaaaaacggttcggaaaaccctcgggtaccccttaaggggaaccgtaccgggacccggggtaattaccggaaaccggtacccggggttaccggtttagttaagtttaacccggtgggtacgggaaccggaagggtaaggtacggttcccgggggaaaccctaaacggttaaaaccggttcctaaacggtaacgtaacggttcggggaacccgttcggggtaccggggaaacccggaacgggtaaccccgg

SEQ ID NO: 381859 - DNA, 531 bp, Homo sapiens
  misc_feature: GZ8MTXP02I1NW0.13.76.G10.1.454.CMB.2.raw
  modified_base (296)..(296): a, c, t, g, unknown or other
  modified_base (320)..(320): a, c, t, g, unknown or other
  modified_base (401)..(401): a, c, t, g, unknown or other
  modified_base (473)..(473): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtgggccnccaggctccgaggggaacggggcngggagtgcgttctcttttatttatagtagtggtagtacatactcgcagctccggtggagggcagtactcaccatctcaganacaatccaagaacacgctgttctacaaatgaactgcctagagacgcgaatgacgtacggcgtagtattacgngtgcgagagacgtcggggacccaagtaacgtactacgactagcggacgttcgacgggg

SEQ ID NO: 381860 - DNA, 618 bp, Homo sapiens
  misc_feature: GZ8MTXP02IKQSK.13.76.G10.1.454.CMB.2.raw
  modified_base (170)..(170): a, c, t, g, unknown or other
  modified_base (213)..(213): a, c, t, g, unknown or other
  modified_base (235)..(235): a, c, t, g, unknown or other
  modified_base (270)..(270): a, c, t, g, unknown or other
  modified_base (412)..(412): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatccacctgctntggaaataatggcagataaatntacttctggtatcagcagagtcaggccagtccccngtcgctggtcatctatcaagatgaccaagccggccctcgagggtactccccgtagacgcgtattcctcgtcggccttccaactcgtacggggacctcgacgtacccactcacgaccagtcgacggccggacccaggctaagnggagttacggaggtccttacggtacttacgttacgtacggtacgagggtaccgggtggggaaccagggtacaacgggtcctaacgtccgggacccccgtagttacgttacggttaccgtttaaccggggaacgttacgggggaaacccgtaaacgggttaccctaacccgggttaccgtaaacggttcccaaaccggtaacccccg

SEQ ID NO: 381861 - DNA, 588 bp, Homo sapiens
  misc_feature: GZ8MTXP02IY4G1.13.76.G10.1.454.CMB.2.raw
  modified_base (235)..(235): a, c, t, g, unknown or other
  modified_base (247)..(247): a, c, t, g, unknown or other
  modified_base (265)..(265): a, c, t, g, unknown or other
tcagtcacgtactacacgaccggtgctcgatttagtcactcatacaggggtgggagaggagcccagcactgggattccgaggtgtttccattcggtgatcagcactgaacacagaggactcaccatggagttttggctgagcggtggtttcgtgtaggcgtatttaaaagtagccagtgtgagtgcagctggtggagtctggaggaggcttgatccagcctgggggtccctgganctctcctgtgcncgctcgtgtcgacgcacncacacacatgagcgtcggtccgcgacgcgtacgacggagggcgtggtgtcgtcgttcttactttatttattagtagtagtacgtactactactcgacgacgtacgtccggtacggtacgggacgtactacctacctactactacgaagagaactaactaacgaaacgaacgtacgtacgttacttacttactaaacgtacgtaacgacgtacgtacgagacgacgacgacgacgacgacgtagtatagtgtacgagagacgacgacggacgacgtaacgtacgtaacgtacgtacgtacggtacgtacggtacggacggaacg

SEQ ID NO: 381862 - DNA, 582 bp, Homo sapiens
  misc_feature: GZ8MTXP02INVOO.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctctgggttcaccgtcagtcacacctacatgagcgtgggtccgccaggcctccgaggggaggggctggagtgcgttcttcttttattatagtagtggtagtacatactcgcagactcgtggagggccgattccacctatcctccaagagacaaacttaccaaagaaccacgtcttgtttactacaaaatcgaaacagtcctagagacgccgaatcgaccgacggccgttagttattacgtgtagcgagagacgtcgggggacccaacggtaaacgtttacgacgtaacgtagtacgggacgtcgtacgggggacccgaaacggggacccg

SEQ ID NO: 381863 - DNA, 605 bp, Homo sapiens
  misc_feature: GZ8MTXP02I0FJY.13.76.G10.1.454.CMB.2.raw
  modified_base (239)..(239): a, c, t, g, unknown or other
  modified_base (539)..(539): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagcccaccctcagtgtccgtgtccccaggacagacagccagcatcacctgctctaggaaataatggacagataaatntacttcctggtatcagcagagtcaggccagtcccctgtcgctggtcatctatcaagatcgaccaagccggaccctgacggtctcccccgtgaacgcgtacttcctacgtcggccttaccgaaaccttccggtaccggggaaccttcccgacggtacccctaaccgtcgtaccgaacctactaccgacgggaccccgggaccccgaggtccgtaagtacggagtacggtacggtactaggtaaccttagttacgtacgtaccgagggttcgacgggacaggacagcctaacgcgacccgtntacgtcgttaccgtacggtaacgtaggaacccgaaggtctaccggactacggaccacgaaaccccg

SEQ ID NO: 381864 - DNA, 542 bp, Homo sapiens
  misc_feature: GZ8MTXP02JI84T.13.76.G10.1.454.CMB.2.raw
  modified_base (411)..(411): a, c, t, g, unknown or other
  modified_base (523)..(523): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacactacatgagctggtccgccaggctccgagggaaggggctggagtgcgtcttcttttattatagtagtggtatacatactccgcagcgtccgtggacgggggcctattcaccatctccagagacaacttaccaanacacgtctgtttactactaaatgaacacgtcctagacgtagccgatcggacacggccgtagtactctagtgcgagagacgtcggggaccacggacgtaacgacgtactacgnggacgtcgtacgggaccgg

SEQ ID NO: 381865 - DNA, 733 bp, Homo sapiens
  misc_feature: GZ8MTXP02GVU86.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtggttcaccgtcagtcacacctacatgagcgtgggtccgccagggcctccggaaggggaaggggctgggagtgcgttcttcttttattatagtagtggtagtacatactccgcacgcgtccgtggacgggggcctagttccaacctacttccctacccgaaggaacgtaaacctaaactttacccgaaaagtaaacccaccggtctttacggttttacctaaaccgtaaaaattcggaaaacctacgggtaccctagggaacggtaaccgacccggtaagtaccgggaaccgtaaaccgggggtcccgtttaaggtttaaactttaaccggtggttacgggaaccggaaaggtaacgggaaccgggttacccggggggaaccccctaaaacggggttaaaacccggtttaacccgtaacggtaccgtttaaaggtcggggtaaaccggttccgggtacggggggaaaacccccgg

SEQ ID NO: 381866 - DNA, 647 bp, Homo sapiens
  misc_feature: GZ8MTXP02I8YXN.13.76.G10.1.454.CMB.2.raw
  modified_base (468)..(468): a, c, t, g, unknown or other
  modified_base (479)..(479): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtcgggttcaccgtcagtcacacctacatgagccgtcgggtcccgccgagggcctccggaaggggaaggggcgtagggagtgccgtttctttctttttatttagtagttaggtggttagtaccataccgtccgcagtacctccggtgggacggggcctattccacactcctaccaagacgacaacttaccgaaagaaccacgtcttgtttactanaaatcgaaacngacctaggagacgccgatacgaccgacggtacgtagttacttacgtggtacggacgtaagaggtacgtaccgggggacccctaaacgggtaaaccgtttaacgtacgaacgtttaacgtacggggtacccgtacgggtacgggggaacccgtaaacgggggaaccccg

SEQ ID NO: 381867 - DNA, 689 bp, Homo sapiens
  misc_feature: GZ8MTXP02GN0E3.13.76.G10.1.454.CMB.2.raw
  modified_base (298)..(298): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtccacacctacatgagcgtcgggtccnccgaggcctcgaggggaaggggctggagtggcgttcttctttttatttatagttagtggttagtaccatacctccgcacgtaccgtccgggtgggacgggggacctacgttaccacccgtatcctacccgaaggagaacctaaacttacccaaaaggaaccctacggtacctttgtttacccttaacaaaagttcaaaaccgcgtacccgttagggaagacggacccggaagtcggaaccgaccggggtccgtttaagtatttaaccgtggtcggacgaaggtacggacggttaccgggggacccctaaacgggtaaaccgtttacctaccggctttaacggtacggggtaccgtacggtaccgggggaccgaaaccgggggtaaccccgg

SEQ ID NO: 381868 - DNA, 734 bp, Homo sapiens
  misc_feature: GZ8MTXP02H8VEP.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggaggaggcttgatccagccgtggggggtccctgagactctcctgtgcagtcctcgtcgggttcaccgtcagtcacacctacagtgacgcgtcgggtccgacccgagggcctccggaaggggaacggggtcctaggggagtcggaccgtttctttcttttttaagttaagttaggttaaggttaggttaacgtaaccctacgttaaccgtcccgacgtacggtacccgttccgggttagggaccgggggtccctaagtttccaacccgtatcctaccagaacgaactaaacttaccgaaaagaaccctacgtacgttacgttttaccttacaaagttacgaaactacggtacctagggaacgacggacccgtagtacggaaaccgtaaccggggtcccgttaggttaacgtttaacgtcggtacggacgaaacggtaggacggtaccgggggaccctaaacggtaaccgttacgtaaacgtccgttaagtcgggtaacgttccggacgggggtaacccgaacgggaaccccg

SEQ ID NO: 381869 - DNA, 609 bp, Homo sapiens
  misc_feature: GZ8MTXP02GMXYT.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtcgggtcccgccgaggcctccgaggggaaggggcgtggagtgcgtcttcttttatttagtagtagtggtatacatactcgcagactccgtggacggggccgtattccacctatcctaccaagacgaactaaattacccaaagaaccacgtcttgtttactacaaatcgaaacacgacctgagacgaccgagtacgacgacggtcgttagttattacgtgtcgacgaggaggacggtccgggggacccaacggtaaaccgttacgtacgtaacgtacgtacggggtaccgtcggtacgggggaacccgaacggggtaaccccg

SEQ ID NO: 381870 - DNA, 624 bp, Homo sapiens
  misc_feature: GZ8MTXP02IZB1W.13.76.G10.1.454.CMB.2.raw
  modified_base (302)..(302): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagcttgggttttccttgttgctaattttaaaaggtgcccagtgtgaggtgcagctggtggagtcgtggaggaggcttgatccagccgtgggggtccctgagactctcctgtgcagcctcgtggttcaccgtcagtcacacctacatgagcgtcgggtcccnccgaggcctccggaaggggaaggggcgtgggagtgtccgttctttctttttaatttagtaggtagtggtagtacatacctccgcagccgtccgtggacgggggcctagttacacctactcctaccaagaacgaactaacttacccaaaagaaccacgtcttagtttactacaaaagttcgaaacacgccctaggaagacgaccgatcggacgacggtccgttagtaacttcgtgtcgacgtaggacgacggtcgggggaaccccaacggtaaacgttccgaacggtccttaaggtcggtaccgtcgggtacgggggaacccg

SEQ ID NO: 381871 - DNA, 661 bp, Homo sapiens
  misc_feature: GZ8MTXP02JD88O.13.76.G10.1.454.CMB.2.raw
  modified_base (456)..(456): a, c, t, g, unknown or other
  modified_base (516)..(516): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctggggttttccttgttgctattttaaaaggtgcccagtgtgaggtgcagctggtggagtctgggaggaggcttgatccagccgtggggggtccctgagactctcctgtgcagcctctgggttcaccgtcagtcacacctacatgagcgtgggtccgccaggctccgagggaggggctggagtgcgtcttcttttattatagtagtggtagtacatactcgcagactccggtggacggggccgtattccaccatcctaccagacgaacaacttaccaaaggaaccacgaccttgttttacctacaaaatcgaaaacngacctaggaacgacgccggtaatcggaaccgaccggggtccgttacgttacgtttaacgngggttaggaccggaggaaacgggtacggtaccggggggaccccctaaacggggtaaaacccgtttaccgtaaaccggtccgttaacggttacggggtaacccggtccggtttaacggggggacccgtaaaacgggggacccccgg

SEQ ID NO: 381872 - DNA, 534 bp, Homo sapiens
  misc_feature: GZ8MTXP02IGOTN.13.76.G10.1.454.CMB.2.raw
  modified_base (235)..(235): a, c, t, g, unknown or other
  modified_base (376)..(376): a, c, t, g, unknown or other
  modified_base (387)..(387): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgcctcagtgtctggggccccagggcagagggtcaccatctcctgcacgtgggancagctccaacattggggcacattatgatgtacactggtaccaggcagtttccaggagcaggtcccagactcctcatcaatacgtaaacaacatccgccgacgacggggtccctgacgacttcctcgtcggcttccgagtcncggcactcacncctccctggtcactcactcgggccttccgacgctcgaggatggagctagtatttcttcgtcgtacctacggttccctaagttcgaacacgacacggtcctggaacgtcgtcgtttcggtacgtttccggggacgggggtacccaggg

SEQ ID NO: 381873 - DNA, 746 bp, Homo sapiens
  misc_feature: GZ8MTXP02G0EL2.13.76.G10.1.454.CMB.2.raw
  modified_base (292)..(292): a, c, t, g, unknown or other
tcagtcacgtactacacgaccggtgctcgatttagtcactcatacagggggggattccgaggtgtttccattcggtgatcagcactgaacacagaggactcaccatggagttttggctgagcgtggtttcctgtgctatttaaaggtgccagtgtgaggtgcagctggtggagtctgggaggaggcttgatccagccgtgggggtccctgagactctctgtgcagcctgtggttcaccgtcagtcacacctacatgagctgggtccgccagggcctccgaggggaacggggngtgggagtgtcgttctttacttttatttagttaggttaggtaggtaagttactagttaccgtccgacgtacggtaccgtccggtagggacggggtacctacttaccacctacttacctccgaagaaacgtaacctaaacgttaacccgaaaagtaaacctaccgtcgtttacgttttacccttaaacgaaaacgtacggaaacacgtccgtaggaacgacgaccgtacgttacggaaccggtaccgggtcggttagttacgtttacggtaggtcggtacggaaggacgggtacgggtacccggggaaaccccgtaaacggttaaacccggtttaacgtaccggtacttaacggttacggggtaccgttacggggtaccgggggaacccgtaaaacggggtaacccgtacccgggttaccgtaccccgttccgtcccgtaaccgtaccgtacccg

SEQ ID NO: 381874 - DNA, 648 bp, Homo sapiens
  misc_feature: GZ8MTXP02GHVAI.13.76.G10.1.454.CMB.2.raw
  modified_base (373)..(373): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctcgtgggtcaccgtcagtcacacctacatgagcgtgggtccgccgaggcctccgaggggaaggggctggagtgcgtcttcttttatttatagtagtggtagtaccatactcgcagactcgngacgggcattcaccatcctcagacgacaattaccaaagaaccacgtcttgtttacttacgaaaattcgaaacacgtcccgtaggaaggacgacccggaagtaccggaaaccgaaccggggtcccgttaagttaactttaaccgtgggtacggacggaaggaaggtacggttacgggggaccccctaaacggtaaaccgtttaacctaaccggtaacgttaacggtacgggaccggttccggtacgggggaaccccgtaaacgggggaacccccgg

SEQ ID NO: 381875 - DNA, 550 bp, Homo sapiens
  misc_feature: GZ8MTXP02IOPDL.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagcgtcgggtccgccgagggctccgaggggaacggggctgggagtgcgttcttcttttattatagtgtggtagtacatactcgcagctcgtggaggggccatcaccatctcagagacaattaccaaagaccacgtcttgtttactacgtaaaatgaaacacgtcctagagacgccgatacgacgacggcgtagtattactggtgacgagagagtcggggacccacgtaacgttaacgacgctacgcggtacggtcgacggggaccg

SEQ ID NO: 381876 - DNA, 653 bp, Homo sapiens
  misc_feature: GZ8MTXP02GGALA.13.76.G10.1.454.CMB.2.raw
  modified_base (305)..(305): a, c, t, g, unknown or other
  modified_base (438)..(438): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagcttgggttttccttgttgcttaattttaaaaggtgcccagtgtgaggtgcagctggtggagtcgtggaggaggtcttgactccaggccgtgggggtccctgacgactctctgtgcagcctcgtggttcaccgtcagtcacacctacatgagtcgtcgggtccnccgacggtccgtaccggaggggaaggggctaggggagtcggcgtttctttactttttaagtttagtaggttaggttaggtacgtactactacctccgacacgtccgtccggtaggacgggtccgattccaacncgtacctaccgaagtacgaactaaagttacccaaaaggaaccctcggtactttacgtttacttaaacaaaagttcgaaaaccgagtccgaggacgacgccgagtacgaacgaccggtcgtatacgttactggacgacggacgagacggttcccggggaaaccctaagtaaccgttaactacgacgttagcggtaacgtccggacggggtaaaccg

SEQ ID NO: 381877 - DNA, 697 bp, Homo sapiens
  misc_feature: GZ8MTXP02INHJ6.13.76.G10.1.454.CMB.2.raw
  modified_base (254)..(254): a, c, t, g, unknown or other
  modified_base (335)..(335): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgtctattttaaaaggtgcccagtgtgaggtgcagctggtggagtcgtgggaggaggcttgatccaggccgtcgggggtccctgagactctcctgtgcngcctcgtgggttccaccgtcacgtcaccacctacatgacgcgtcgggtcccgccgacggcgtccgaggggaggggcgtggngtgtcgttctttcttttatttatagtagtggtagtacctatactccgcacgtaccgtcggtgggacggggccgtacttccaccctactcctaccaagaacgaaacctaaacttacccgaaaagaacccgtaccgtcttttacgtttaccttaacaaaactcggaaaacacggtaccctagggaccgacgtacccgaagtcgaaccgacgggtcgtacgttaatttacgtggtacgtacggaaggacggtacgggttccgggggaacccctaaacgggtaaaaccgtttaccgtaaccgtaacggttaacggtcggggtaacccggttcgggtaccgggggaaaccctaaacggggaaccccg

SEQ ID NO: 381878 - DNA, 580 bp, Homo sapiens
  misc_feature: GZ8MTXP02IL3HX.13.76.G10.1.454.CMB.2.raw
  modified_base (282)..(282): a, c, t, g, unknown or other
  modified_base (341)..(341): a, c, t, g, unknown or other
  modified_base (377)..(377): a, c, t, g, unknown or other
  modified_base (388)..(388): a, c, t, g, unknown or other
  modified_base (405)..(405): a, c, t, g, unknown or other
  modified_base (443)..(443): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtagcagcgtggtggagtcgtggaggaggcttgtataccacggccgtcggggggtcccgtcgtagaccgtctcctgtgcagccgtctgggttcaccgtcngtcacacctacatcgagcgtcggtccgccaggctccgacgggaaggggcgtggagtcgngtcttgttttattatagtacgtgtagtacagtaccncgcagcgtcgngagggctactcacatcncagacaacaactaccaagaacacgtcttacgttctaanaaagagaacgacgcgtagagacgcgagtcgacgtacggtcgtattactagtgtagacgacgagacgtacggaccgaccgtaaccgtaacgtacgtaacgtacgtacggtacggtacggtacggacggaacggaaccg

SEQ ID NO: 381879 - DNA, 664 bp, Homo sapiens
  misc_feature: GZ8MTXP02FQPI2.13.76.G10.1.454.CMB.2.raw
  modified_base (237)..(237): a, c, t, g, unknown or other
  modified_base (309)..(309): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgccctcagtgtcgtcggggccccagggcaggaggtcaccatctcctgcactgggancagctcaacattggggcacattatgatgtacactggtaccagctagttccaggagcaggtcccagactcctnatcaatagtaacaacaatcggacccgacgacggggtccctagaccgtattacctcgtcgacctcccgaggtcctcgggaccaccgttccgacgcccctccccgttgggccctacttaccgaccgttgggacccttcccgaacgggtcttacggacgggtaatcggaacgggtccttaaggttactttaagtttccgtccgggtacccttaacgggttccccttaaagttacgggtaaacctaaacgggccgtaaacgggtcccccttaggggtaaccggttcgggttacccggttttacgggggttacggtttaaccccgggggggcccggggggttaaaccccctacccggggg

SEQ ID NO: 381880 - DNA, 588 bp, Homo sapiens
  misc_feature: GZ8MTXP02IY759.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagcgtgggtccgccaggctccgaggggaggggctggagtgcgtcttcttttatttatagtagtggtagtaccatacctcgcagacctccgtggacggggccgattccgaccatcctccagagacaattccaagaccacgcttgtttactacaaatgaaacagcctagagacgaccgagtcgaccgacggccgtagtacttactgtcgacgagaggacgtcgggggaccctaacggtaaacgtttaaccgtacgtccgtacgtacgggtaccggtcggtacgggggacccgaacggggtaaccccgg

SEQ ID NO: 381881 - DNA, 617 bp, Homo sapiens
  misc_feature: GZ8MTXP02I464E.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagccgtcgggtccgccgaggccgtccggaaggggaacggggcgtgggaggtcgcgtttctttctttttatttagtagttaggtggtacgtactatactccgcagaccgttcgtgggcgggccgtattccaccatcctcgaagacgtaactaactaccaaagtaccacgtcttgtttactacaaaatcgaaactgcctggaagacgccgaagtcgaacctacgggcccgttatacttacgtggagtcggagtacggcgtacgggggaccctaacggtaaccgttactacgcgttaggtacggtacgtacggtcggggaccgtaaacgggaccccg

SEQ ID NO: 381882 - DNA, 736 bp, Homo sapiens
  misc_feature: GZ8MTXP02HIRH9.13.76.G10.1.454.CMB.2.raw
  modified_base (301)..(301): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagcgtggtggagtcgtggaggaggcttgatccgagccgtggggtccctgagactctcctgtgcagcctcgtcgggttccaccgtcacgtcaccacctacatgacgcgtcggtccnccgaggccgtaccggaggggagggcgtaggaggtcgtccgttctttacgtttttaattagtaaggttaggtacggggttaatacctaacgttacccgtaccgctaacggtaccgttccggggtgggaccgggggtacctaacgtttaccaaccctactcctacccgtaaagaacgtaaacctaaaacgttacccgaaaacggtaaccgtaaccggttctttacgtttttaccaaacctaaaagtacgaaaaccgcgtaccgtaggaacgaccgaccgaacgacgaacccggtacggtaccgttaggttaaacttcgaggtcgacggaggaggtacggtacccggggaacccgtaaaccgtaacgtttaaccgaacgtaacgttaacgtccggggtacgtaccggggacggggaaccgaaaccggggtaaccccgg

SEQ ID NO: 381883 - DNA, 596 bp, Homo sapiens
  misc_feature: GZ8MTXP02IRZHM.13.76.G10.1.454.CMB.2.raw
  modified_base (237)..(237): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagcccgccctcagtgtcgtcggggccccagggcagaggtcacatctcctgcacgtgggancagctccacattgggcacattatgatgtacactgtaccagctagttccaggagcgagtcccagactcctcatacaatacgtaaacaacaactccggcccacgacgtccggggtccctacgacccgtattcctcgtcgtcctaccgtaggtcctggccacccgtcacgtcccctcctcggtcactcacgtgggcctcgtagcgtaggagacgtggacgtcgtaggtatttacgttcgtacggtacctacggttacccttaaagttccgaacgtacgtaccgtaacggtcccgttaaggtaacgttcccggttacggtttccggggttaaccggtttcccgggggacccggggtaaccccg

SEQ ID NO: 381884 - DNA, 590 bp, Homo sapiens
  misc_feature: GZ8MTXP02F1A3K.13.76.G10.1.454.CMB.2.raw
  modified_base (268)..(268): a, c, t, g, unknown or other
  modified_base (364)..(364): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggtcaccgtnagtcacacctacatgagcgtgggtcccgccgaggcctccgaggggaaggggctggagtgcgtcttctttatttatagtagtggtataccatactcnacgactcgtggacgggcattccgacatctcagagacaactacaagaacacgcttcgtttacttacaaatacgaaacgacgaccgtagagacgacgatacgacgacggccgtagtacttagtgtgacggagaggacggtacggggacccgaacggtaaaccgttaacgtaaccgtaacgttacgtacggtacggtcggtacggggacccccccgaagggaaccccgg

SEQ ID NO: 381885 - DNA, 662 bp, Homo sapiens
  misc_feature: GZ8MTXP02HF92T.13.76.G10.1.454.CMB.2.raw
  modified_base (388)..(388): a, c, t, g, unknown or other
  modified_base (450)..(450): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagcgtggtttctgtgctatttaaaggtgccagtgtgaggtgcagctggtggagtcgtggaggaggcttgatccagccgtgggggtccctgagactctcctgtgcagcctcgtgggttcaccgtcacgtcaccactacatgagctgggtccgcaggctccgaggggaagggctgggagtcgcgtacttcttttattatagtagtaggtatacatactcgctagctccgtggacggggcattcaacctntccacgagacactaactacgaacgaaccacgtcgtttacttactaactaaagtacgaaaccncgtaccgtaggacggaaccgaccggtaacgtaccggaaccggtaccgggtaccggtttagtttaaccgttacggtacgggtacggtacgggacggtaaacggggtaccgggtacccgggggtaacccctaaaccgggttaaaaccgttaaccggtaccggtaaccggttacggtacgggtacccgggttacggggaccgggggtaaacccgg

SEQ ID NO: 381886 - DNA, 554 bp, Homo sapiens
  misc_feature: GZ8MTXP02I4QA2.13.76.G10.1.454.CMB.2.raw
  modified_base (382)..(382): a, c, t, g, unknown or other
  modified_base (385)..(385): a, c, t, g, unknown or other
  modified_base (390)..(390): a, c, t, g, unknown or other
  modified_base (401)..(401): a, c, t, g, unknown or other
  modified_base (412)..(412): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctggggttttccttgttgctattttaaaaggtgcccagtttgaggtgcagctggtggagtctggaggaggcttgatccagccgtgggggtccctgagactctcctgtgcagcctctgggttcaccgtcagtcacacctacatgagctgggtccgccaggctccgaggggaagggctggagtgcgtcttcttttattatagttagtgtagtacatactccgcagctcgtgcggggccatcacntcncaganacatcaagacncgctgttctanaaatgaacagcctagacgagacccgatacgaaccgacgggtccgttagtaacttacgtgtgacgagaggagtcgggggacccaacggtaacgttacacggactaagtcggacgttcggaggggacccaacgggacctaccgg

SEQ ID NO: 381887 - DNA, 590 bp, Homo sapiens
  misc_feature: GZ8MTXP02FS8XK.13.76.G10.1.454.CMB.2.raw
  modified_base (510)..(510): a, c, t, g, unknown or other
tcagtcacgtactacacgaccggtgctcgatttagtcactcatacagggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggaccagacagccagcatcacctgctctaggaaataattggacagaataaatatacttctggtatcagcagaagtcaggccagtcccctgtgcctggtcatctatacaagactgaccaaggccggaccctgaacgggtctcccccgtagacgacgtattcgtcgtacggtcctaccaaacgttcgtacgggaaccttcgacgtcccaactctacgaccataccgacgggtacccggacccgagtaccttagaggacttagggacgtctacggtacttagttacctagacgtaggcggtaggacagcacgcctacgtcgacccgtnttacgttcgtaccggttacggacgttacgggaacctaacgggtacctaacccggtacgtaaacgccgtaaccgaaccccg

SEQ ID NO: 381888 - DNA, 603 bp, Homo sapiens
  misc_feature: GZ8MTXP02GY97W.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttctttgttgctattttaaaaggtgcccagtgtgaggtgcagctggtggagtctggaggaggcttgatccagccgtggggggtccctgagtattctcctgtgcagcctctgggttcaccgtcagtcacacctacatgagctgggtccgccgaggctccgaggggaaggggctggagtgcgtcttctttatttatagtagtgtagtacatactccgcacgactccgtgacgggggccagttcacctatctacccgagacgacaacttaccaaagaaccacggtcttgtttaccttacaaaatcgaaacacgaccttaggagagacccgagacgaccgaaccggtccgtggttactaaccgtgtcgaggacgaggacgaccggggaccctaacgaaaccggttacctacgaacgttacgcgggtaccgtcggtacggggacccgaacgggaaccccgg

SEQ ID NO: 381889 - DNA, 568 bp, Homo sapiens
  misc_feature: GZ8MTXP02GW032.13.76.G10.1.454.CMB.2.raw
  modified_base (172)..(172): a, c, t, g, unknown or other
  modified_base (215)..(215): a, c, t, g, unknown or other
  modified_base (236)..(236): a, c, t, g, unknown or other
  modified_base (413)..(413): a, c, t, g, unknown or other
  modified_base (438)..(438): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctcnggaaataattggcagataatntactctggtatcagcagagtcaggccagtcccctgtgctggtcatctatcaagatcgaccaagccggccctgaggctacccccgtgacgcgtattcctcgtggcctaccaaacttccgtacggggaacctcaacgccctactctacgaccagtccgaggccgggacccaggcctagnggtatggagctagtactatttacgngtacgaggcggtaggacgagacgacgaccgtacgtcggacccgtacgttacgttacggttaccgtaccggtaacggtacggtaaccgtacggtaccctaccggtaccgtaacggtaccgaccgtaacccg

SEQ ID NO: 381890 - DNA, 541 bp, Homo sapiens
  misc_feature: GZ8MTXP02I1SIH.13.76.G10.1.454.CMB.2.raw
  modified_base (170)..(170): a, c, t, g, unknown or other
  modified_base (213)..(213): a, c, t, g, unknown or other
  modified_base (290)..(290): a, c, t, g, unknown or other
  modified_base (330)..(330): a, c, t, g, unknown or other
  modified_base (393)..(393): a, c, t, g, unknown or other
  modified_base (441)..(441): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctcnggaaataattggcagataaatatacttctggtatcagcagagtcaggccagtcccctgtgctggtcatctatcaagntgccaagccggcctgagggactcccccgtgagcgatttcnctggctccaactcgtagggaacctcgacgcccactctacgacatcagcgggacccaggctagnggatggacggctaggacttattacgtcgtaccgagggtcgtgggaacngcgagcacgtcgccccgtatacgtcggttaccgttacgggaacttacggggaaccgaacgggttccaacccggttctaaaacggtccaaccggaaccccg

SEQ ID NO: 381891 - DNA, 586 bp, Homo sapiens
  misc_feature: GZ8MTXP02FIFOD.13.76.G10.1.454.CMB.2.raw
  modified_base (482)..(482): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtggggggtccctgagactctcctgtgcagcctcgtgggttcaccgtcagtcacacctacatgagcgtgggtcccgcaggcctccgaggggaggggctggagtgcgtctctttatttatagtagtggtagtacatactcgcagacctcgtgacggggctagttccacctatcctccagagaacaacttaccaaagaaccacgcttgtttacttacaaaatgaaacagcctagagacgaccgatcgaaccgacggtccgtntattacgtgtaggacgagaggtacggtcgggggacccaacggtaaccgttacgtaaccgtgtacgtcggtacgtccggtacggggacccgaacggggaaccccg

SEQ ID NO: 381892 - DNA, 700 bp, Homo sapiens
  misc_feature: GZ8MTXP02IKAK3.13.76.G10.1.454.CMB.2.raw
  modified_base (483)..(483): a, c, t, g, unknown or other
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctatttaaaaggtgcccagtgtgaggtgcagctggtggagtcgtgggaggaggcttgatccagccgtgggggtccctgagactctcctgtgcacgcctcgtggttccaccgtcagtcacacctacatgacgcgtcgggtcccgccgacggccgtaccggaggggaacggggcgtgggagtcgtccgttctttactttttagtttagtagttaggttggtacgtactatacctccgactagtacctcgggtacgacggggcccgtattacccgactactcctaccaaggacgtaactaaacttaccgaaaacgaactacccggttntttacggttttaacctaacaaacgttacggaaaacctggacccgtaggaaccggtacgacccgtagtcggaaccggaccggtccggttaagttaacttaccgtggtacgacggaaaggacggtacggtaccgggggacccctaaaacgggtaaccgtttaacgaacggtcctaaggttcgggaacccgttcgggtacccggggaacgaaacccgggg

SEQ ID NO: 381893 - DNA, 739 bp, Homo sapiens
  misc_feature: GZ8MTXP02H2HRF.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtccctgagactctcctgtgcagcctcgtgggttcaccgtcagtcacacctacatgagcgtcgggtcccgccgaggcctccggaggggaacggggcgtggagtggtcgttctttctttttattagtagttagtggttagtaccattacctccgacagtaccgttccggtgggacgggggtcccgtacttccgaacctactcctacccgaagaacgaaacctaaactttacccgaaaacggaaaccctaaccggttcctttacgtttttacctttaaccaaaagttaccggaaaacctacgggtacccttagggaacggtaacggacccggaagttaccggaaccgaccggggttaccgttagttaacgtttacgtggtacggacggaaaggtacgggtacggtaccgggggaaacccctaacgggttaaacccgtttaacgtaaccggtaacgttaacggtacgggtaccggtacggtaccgggggaacccgtaaaacgggggtaaccccg

SEQ ID NO: 381894 - DNA, 642 bp, Homo sapiens
  misc_feature: GZ8MTXP02FM6FL.13.76.G10.1.454.CMB.2.raw
  modified_base (295)..(295): a, c, t, g, unknown or other
  modified_base (341)..(341): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctattttaaaaggtgtccagtgtgaggtgcagctggtggagtcgtgggggaggcttggtccaggccgtgggggtccctgagactctcctgtgcagcctctggattcacctttagagctattggatgagctgggtccnccgaggcctaccgaggggaaggggctggaggtggggcggaccaaanagtaaagctaaaggttggaagtgaagaaatactagtgtaggactcgtaggttacggggcctattccaacctatctaccgagacgacaaaccgacaaagactcactgtatctagaacaaagtacgaaacacgtccgtagaacggacggaccccgaaggaccgacgggtcttacggttaccttaagtttaccgtggtacggacggtaggaacggtacgggttaggggggaccggtaaaaggttagtaacggaacgtagggtacggaccgttaacggtttaaccttacggtttacgaaaccggg

SEQ ID NO: 381895 - DNA, 748 bp, Homo sapiens
  misc_feature: GZ8MTXP02H9TGD.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtgggaggaggcttgatccagccgtgggggtcctgagactctcctgtgcagcctcgtggttccaccgtcagtcaccacctacatgagcgtcgggtccgccgaggcctaccggaggggaacggggcgtgggagtcggccgtttctttacttttttattaagttaggttaggtggttaagttaaccctacgttaaccgtcccgactaacggtacccgttcccgggtagggaccgggggtaccctacgtttacccgaacctacttccctacccgaaagaacgaaacctaaacttacccgaaaagaccctacggtcctttgttttaccaaccgtaaagttacgaaacgtacgtacccgtaggaacggacgtaccccggattaccggaacccgtaccggggtaccgtttagttaacgttaaccgtggtacggacggaaaggcggaacgtacccgggggaccccaaacgggtaccgtttaaacccacggtaaccttaaggtacgggtaccgggttaccggaccgggggtaacccgaaacggggtaacccccgg

SEQ ID NO: 381896 - DNA, 567 bp, Homo sapiens
  misc_feature: GZ8MTXP02FI3EX.13.76.G10.1.454.CMB.2.raw
  modified_base (364)..(364): a, c, t, g, unknown or other
  modified_base (459)..(459): a, c, t, g, unknown or other
  modified_base (485)..(485): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggtttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctcgggtccgccaggcctccgaggcgaaggggctggagtgcgtcttctttttattatagtagtggtagtacatactccgnagactccggtgacggggccgattcacatctcagacgactaaattcccaaagaaccacgcttgttcttacaaatagaaacagcctgagacgcgtangaacgacgggtccgtagtacttacgngtagacggagacggagtcgggggacccaacggtaacgttaacgcgtactacggtacggacgtcggtacgggacaaaccgggg

SEQ ID NO: 381897 - DNA, 545 bp, Homo sapiens
  misc_feature: GZ8MTXP02FJMDC.13.76.G10.1.454.CMB.2.raw
  modified_base (435)..(435): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggggtcaccgtcagtcacacctacatgagctgggtcccgccaggctccgagggaaggggctggagtgcgtctcttttatttatagtagtggtagtaccatactccgcagactccgtgacggggccattcaccatcctccagagacaattccaaagaacacgctgtttctcaaatgaaacngcctgagagccgaatgacgacggccgtgtattacgtgtgcgagagagtcgggggcccaacgtaacgtactaacgctagtcggacgtcgtacgggggaccaagggaacccg

SEQ ID NO: 381898 - DNA, 613 bp, Homo sapiens
  misc_feature: GZ8MTXP02IZI9J.13.76.G10.1.454.CMB.2.raw
  modified_base (256)..(256): a, c, t, g, unknown or other
  modified_base (306)..(306): a, c, t, g, unknown or other
  modified_base (423)..(423): a, c, t, g, unknown or other
  modified_base (458)..(458): a, c, t, g, unknown or other
  modified_base (469)..(469): a, c, t, g, unknown or other
  modified_base (487)..(487): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagcgtggtggagtcgtgggaggaggcttgatccagccgtcggggggtccctgacgactctcctgtgcngcctcgtcggttccaccgtcagtcaccacctacatgagcgtcgggtcccnccgaggcctccggaaggggaaggggctgggagtggcgttcttctttttatttagtagtagtggtagtaccatacctcgacacgactccggtggacgggcctattccacatcacaganaactaactcaaagacacgtcttagtttacctaaanaaatcgaaacncgactagagaccgacgancgacgccggtcgtattacgttagtgagacgaggacggtacggtaccgggaaccctaacggttaaaccttaccgtaacgcgttacggtacggtaccggtcggacggggaacccgaacgggtaccccg

SEQ ID NO: 381899 - DNA, 607 bp, Homo sapiens
  misc_feature: GZ8MTXP02FV64V.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggtcaccgtcagtcacacctacatgagctggggtcccgccaggcctccgaggggaggggctggagtgcgtctcttttattatagtagtggtagtaccatactccgcagacctccgtgaggggccgattcaccatctccagagacaataccaaagaacacgcttagtttcttacaaatcgaaactagcctagagacgcccggtaatcgaccgacgggccgttaggtaattaccgtggtacgacggaaggacggaacggttcgggggacccccaacggtaaaacccgtttacaccggtaaccgttagtacggggaccggttccggtacgggggaacccaacgggggaaccccg

SEQ ID NO: 381900 - DNA, 574 bp, Homo sapiens
  misc_feature: GZ8MTXP02GJAH9.13.76.G10.1.454.CMB.2.raw
  modified_base (281)..(281): a, c, t, g, unknown or other
  modified_base (400)..(400): a, c, t, g, unknown or other
  modified_base (469)..(469): a, c, t, g, unknown or other
tcagtcacgtactacacgaccggtgctcgatttagtcactcatacaggggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacactacntgagctgggtccgcaggctccgaggggagggctggagtgcgtctcttttattatagtagtggtagtaccatactccgcagacctcggtggacggggccattccacctatcctaccaganaccaattacccaaagaacacgcttagtttcctacaaaatgaaactaggcctagagacgccgatcgaccncgggcttgtattacgtgtgcggagagtacggtccggggaccccaaggtaaaccgttacgaacgcctaagtcggaccgtccggtagggggacccaaggggaccccg

SEQ ID NO: 381901 - DNA, 549 bp, Homo sapiens
  misc_feature: GZ8MTXP02GIRQJ.13.76.G10.1.454.CMB.2.raw
  modified_base (268)..(268): a, c, t, g, unknown or other
  modified_base (280)..(280): a, c, t, g, unknown or other
  modified_base (294)..(294): a, c, t, g, unknown or other
  modified_base (398)..(398): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagcgtggtggagtcgtggaggaggcttgatccagccgtgggggtccctgagactctctgtgcagcctcgtgggttcaccgtnagtcacacctanatgagctgggtccnccaggcctccgaggggaggctggagtgcgtcttctttattatagtagtggtagtaccatacctcgcagactcgtggacgggcgattccacctatcctacaaganacaaagtccaaagacacgcttcgtttactacaaaatcgaaactagcctagagacgccgaagcgaacgacggtccgtagtacttacgtgagacgagacgagtcggggaccacgtaacgtcacgctagcgacgtcgacggaccgaaggacccg

SEQ ID NO: 381902 - DNA, 556 bp, Homo sapiens
  misc_feature: GZ8MTXP02FVIVH.13.76.G10.1.454.CMB.2.raw
  modified_base (366)..(366): a, c, t, g, unknown or other
  modified_base (393)..(393): a, c, t, g, unknown or other
  modified_base (396)..(396): a, c, t, g, unknown or other
  modified_base (401)..(401): a, c, t, g, unknown or other
  modified_base (425)..(425): a, c, t, g, unknown or other
  modified_base (430)..(430): a, c, t, g, unknown or other
  modified_base (435)..(436): a, c, t, g, unknown or other
  modified_base (442)..(442): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcaccacctacatgagcgtgggtcccgccgaggctccggaggggaggggcgtggagtgcgtcttcttttatttatagtagtggtagtacataccncgcagactcgtggacgggcattccacntcncaganacaatccaagacagcttgttctanaaatnaaacnncctganacgacgatcgacgacggccgtagtactacgtgtgacgagagacggtcggggaccaaccggtaaacgttacgacgcgtacgcggtacgtcggtcggggaccgaacggggtacccg

SEQ ID NO: 381903 - DNA, 742 bp, Homo sapiens
  misc_feature: GZ8MTXP02FN2HF.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactaaccatggagttttggctgagctgggttttccttgttgctattttaaaaggtgcccagtgtgaggtgcagctggtggagtctgggaggaggcttgatccagccgtgggggtccctgacgactctcctgtgcagcctcgtgggttcaccgtcagtcaccacctacatgagcgtcgggtcccgccgaggcctacccgagggggaacggggcgtagggagtcgtcggttcctttcttttttagtttagttaggttaggttgggttaagtacctacgttaccgtcccgacacgtaccgttcccggtagggcgggggccctattaccaccctattccctaccaaggacgaaacctaaacgtttacccgaaaagaaaccctaccgtcttacgtttttaccttaacaaaatacgaaaccgacgtcccgtaggaacggacgtacccggaattacggaacccgtaccgggtcccgttaagttactttaaccggtggtaggaccggaaggtacggtacggaccgggggtaccccctaaacgggtaacccgtttaacgaccggtacgtaacggttacgggacccggttacggtaccgggggacccgaaaacgggggtaccccttaacccggggg

SEQ ID NO: 381904 - DNA, 703 bp, Homo sapiens
  misc_feature: GZ8MTXP02INSH1.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagcttgggttttccttgttgctaattttaaaaggtgcccagtgtgaggtgcagcgtgggtggagtcgtgggaggaggcttgatccagccggtgggggtccctgagctctcctgtgcacgtcctcgtggtcaccgtcagtcacacctacatgacgcgtcggccgccgagggcctccggaggggaggggcgtgggagtgtcgttctttactttttatttagtagttaggttaggtactactactacctccgcgacgtcgtccggtgggacgggtccgtacgttccaccgtactcctaccgaaggaccaactaaacgttacccaaaagtaccctcgttactttcgtttacctataaaaacgttcgaaacgacgtaccgtagaacggtaaccgaccgtagtaccggaaccgtacccgggtacgttacgttaagttaaccgtggcggaagaacggtaagggtacggtaccggggaacccccgttaacggttaaaacccgtttcggaaacccgttgggttaaccggtcggggtaccgtttacccgggggtaacgggaaaccccggggg

SEQ ID NO: 381905 - DNA, 646 bp, Homo sapiens
  misc_feature: GZ8MTXP02FQMAL.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtcctgagactctcctgtgcacgcctcgtgggttcaccgtcagtcacacctacatgagcgtcggggtcccgccagggtcctaccggaagggggaacggggctggggagtcggtcgttctttactttttattataggtagtggtagtacatactccgcagccgtccgtggaggggcagtattcacctatctaccgaagaacgtaaactaaacttacccgaaaagaaaccaacgtctttacgttacttaacaaaattcggaaaaccagtacccttaggacggaacgacccgtaagtcggaaaccgaccgggtaccgttagtaactttaccggtgtaggacggaaagacggtacgggtacggggaccccgaaaggtaaccgttactaaccgtctaagtcgggaacggtcgtaacggggg

SEQ ID NO: 381906 - DNA, 765 bp, Homo sapiens
  misc_feature: GZ8MTXP02HHX2O.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctattttaaaaggtgcccagtgtgaggtgcagctgggtggagtctgggaggaggcttgatccagccgtgggggtccctgagactctcctgtgcacgcctcgtgggttccaccgtcagtcaccacctacatgagcgtcgggtccgccgaggcctaccggaaggggaacggggcgtgggaggtcggtccgttctttactttttagtttaagttaggttaggttaggtaagtaaccctacttacccgtcccggactaacggtacccgttccgggtcggggacgggggtacccgtacgtttccaacccctaacgtccctacccgaaagaaccgtaaaacccttaacgttaaccccgaaaacggaaaccctaccggtcctttaggtttttacccttaacaaaagttcgaaaacacgggtaccctaggacgacggtacccgagttacggacccgtaccggggtaccgtttagtaacgtttaccggtggtacggacggtaaggacggaccgggttaccgggggaccccctaaacgggtaaccgttaacccgtacggaaccttaggtacgggtaccgttaccgggtacgggggaacccgtaaacggggaaccccg

SEQ ID NO: 381907 - DNA, 668 bp, Homo sapiens
  misc_feature: GZ8MTXP02JXY4A.13.76.G10.1.454.CMB.2.raw
  modified_base (485)..(485): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctattttaaaaggtgcccagtgtgaggtgcagctggtggagtcgtgggaggaggcttgatccagccgtgggggtccctgagactctcctgtgcagcctcgtggttcaccgtcagtcacacctacatgagcgtcgggtcccgccgaggcctccggaggggaaggggcgtaggagtgcgttcttctttttattatagtagtggtataccatactcgcagacctcgtggacgggccgtatccacctacgtcctaccgagaacgaacctaaagttacccaaaagaacccacgtcctttagtttttaccctaacaaaagttacgaaaacccnggtacccttagggaaagtacggttaccggaaattccggaaaacccgtccgggggtacccgtttagttaacgtttaaccgttgggacggacggtaagggagtacggtaccgggggacccctaaacggtaaacgttaccagtccgtaagtcgggaccgttcggacggggaccgaaacggggcccc

SEQ ID NO: 381908 - DNA, 602 bp, Homo sapiens
  misc_feature: GZ8MTXP02HBCSW.13.76.G10.1.454.CMB.2.raw
  modified_base (296)..(296): a, c, t, g, unknown or other
  modified_base (550)..(550): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggttcaccgtcagtcaccacctacatgagcgtcgggtccnccgaggcctccgaggggaaggggctggagtgcgtcttcgtttttattatagtagtggtagtaccatacctcgcagactccgtggacgggacgattccactatcctcccagagaacacttaccaaagaaccacgtcttgtttactacaaatgaaacacgtcctagagacgaccgatacgacgaccggtccgtaggtattacgtgcgcggagtagacggtacggggaccccaacggtaaacggttacctaaccggngttaaacggtcggtaacggttcggaccggggaaccgaaacggggacccccgg

SEQ ID NO: 381909 - DNA, 727 bp, Homo sapiens
  misc_feature: GZ8MTXP02ILVY6.13.76.G10.1.454.CMB.2.raw
  modified_base (227)..(227): a, c, t, g, unknown or other
  modified_base (232)..(232): a, c, t, g, unknown or other
  modified_base (495)..(495): a, c, t, g, unknown or other
  modified_base (715)..(715): a, c, t, g, unknown or other
tcagtcacgtactacacgaccggtgctcgatttagtcactcatacagggggggattccgaggtgtttccattcggtgatcagcactgaacacagaggactcaccatggagttttggctgagcttgggttttccttgttgcttattttaaaaggtgcccagtgtgaggtgcagctggtggagtctggaggaggcttgatccagccgtgggggtccctgagacctctcngtgcncgtccttgttcggttccaccgtctacgtaccacctacctactagtgacgtcggtcggtcccgacgacggtccgtaccgggaagggggaacggggtcgtagggaggtcggtcgttcttttacgtttttatttaagtaggttaggttaggtacgtactacttaccgtccgacgacgtaccgtccggacggggaccgggacctacttaccactactcctcgagacgaactaacctaccaaagacctacgtctttgttaccctaaanaagtacgaaactcgtccgtaagacggtacgaccgtagtaccggaaccggtaccggtccgtttagttaactttcggagtccggaggaaggtacggtaacggggtccccgggaaccctaaacggttaaccgtttacacggttacgtacggtaccggacggttcggggtaacccggaacgaaaccggggaaccgtacccggtccgtaccgtcctccgtaaccncggtaacccccg

SEQ ID NO: 381910 - DNA, 601 bp, Homo sapiens
  misc_feature: GZ8MTXP02FMEZD.13.76.G10.1.454.CMB.2.raw
  modified_base (396)..(396): a, c, t, g, unknown or other
  modified_base (413)..(413): a, c, t, g, unknown or other
  modified_base (438)..(438): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggtcaccgtcagtcacacctacatgagctgggtcccgccaggcctccgaggggaggggctggagtgcgtcttcttttattatagtagtggtagtaccatactccgcagactcgtggacggggcattccacatctcaganaccaatccaaagaaccncgcttgtttacttacaaatgaaacngcctaggagacggacccgaagtcgaaccgaccgggtcccgttagttaatttacgtaggtcggacgaggaggtacggtaccgggggacccctaaacggtaaaccgttactaaccgcgttacggtcggaccggtcggtacgggggacccgtaaaggggacccccg

SEQ ID NO: 381911 - DNA, 671 bp, Homo sapiens
  misc_feature: GZ8MTXP02H9ZXL.13.76.G10.1.454.CMB.2.raw
  modified_base (300)..(300): a, c, t, g, unknown or other
  modified_base (379)..(379): a, c, t, g, unknown or other
  modified_base (413)..(413): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggtttttccttgttgctattttaaaaggtgcccagtgtgaggtgcagctggtggagtcgtgggaggaggcttgatccagccgtggggggtccctgagactctcctgtgcagcctcgtcgggttccaccgtcagtcacaccacatgagcgtcgggtccnccgaggcctaccggaggggaaggggctggagtgcgttcttctttttaattagtagttagtggtataccgatacgtccgnagtaccgtcgtggacgggggctagttccaacctntacctaccaacgaagaaacctaacttaccgaaaagaccgtacgtacctttgtttaccttaacaaattacgaaacctacgtacccgtaggaagacgacccggaagttacggaccgaccgggtaccgtagtttaaacgtttcgtaggtcgaccggaagggtcggaacggttaccgggggaccctaaacggtaaccgtttaacgacggtaaccgttagtcgggtaacggttcggtacggggaccgaacggggtaaccccgg

SEQ ID NO: 381912 - DNA, 624 bp, Homo sapiens
  misc_feature: GZ8MTXP02FZ6N0.13.76.G10.1.454.CMB.2.raw
  modified_base (526)..(526): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggtcaccgtcagtcacacctacatgagcgtcgggtcccgccgaggcctaccggaggggaaggggctgggagtggtcgttcttctttttatttatagtagtggtagtaccatacctcgcagacctcggtgggacggggccgattccaccatcctccaagacgaactaaacttacccgaaagaaccacgtctttagtttaccttaacaaaatcgaaacctacgacctaggaagacgacccgatacgaccgacggtccgttagtacttacgngtgacggaggagacggtacgggggacccctaacggtaaaccgttcaacgcgttaaggtcggtacgtcggtacgggggacccgaaacggggtaaccccg

SEQ ID NO: 381913 - DNA, 721 bp, Homo sapiens
  misc_feature: GZ8MTXP02GGG3U.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactaaccatggagttttggctgagctgggttttccttgttgctattttaaaaggtgcccagtgtgaggtgcagctggtggagtcgtggaggaggcttgatccagccgtgggggtccctgagactctcctgtgcagcctcgtgggttccaccgtcagtcacacctacatgagcgtcgggtcccgccgaggccgtaccggaggggaacggggtcgtaggggagtcggtcgttctttactttttaagttttagtaaggttagttaggttaagttactaaccgttaccgtcccgacacggtaccgttacccggttggggaccgggggtcccgtaactttccgaaccctattcccgtaccaaaggaacgtaaacctaaacttacccgaaaaggtaaaccctacggtcctttcggtttttaccttaaactaaaagttcgaaaactaacgtccccgttaaaggacgtaccgaccgtagtacgaaccgacgggtccgttagttaacttaccgtggtagacggaagacggtacggtcgggaccccgtaagtaacgttaccgacacgtggtaccggacgttacgggcggggaccgtaacggggacccgtaaccgg

SEQ ID NO: 381914 - DNA, 693 bp, Homo sapiens
  misc_feature: GZ8MTXP02HG8DM.13.76.G10.1.454.CMB.2.raw
  modified_base (513)..(513): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtcctagagtactctcctgtcgcacgcctcgtggttcaccgtcagtcacacctacatgagcgtcgggtccgccgacggcctaccggaggggaaggggcgtagggaggtcgtccgtttctttacgtttttaatttagtaggttagttacgggttaagtacctacgttaccgtccgacgtacgtaccgtccgggtagggacgggggtccgtacttacccgacccttaacgtcccgtaccgaaacggtaacgtaaacctaaactttaaccccgaaaagtaacccncgttacgtttcgtttaactaaccgtaaaagtcgtaaactacggtccgtaagaggtaccgactagaccgacgacggtcttagtacgtacgtggaggacgtagacggacggtaccggggaccctaacggtaaacgttccgaacgtccgttacgtcggtacggtacggtacgggggaaaccgg

SEQ ID NO: 381915 - DNA, 559 bp, Homo sapiens
  misc_feature: GZ8MTXP02GIXT9.13.76.G10.1.454.CMB.2.raw
  modified_base (477)..(477): a, c, t, g, unknown or other
  modified_base (489)..(489): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctcgggtccgccaggcctccgaggggaaggggctggagtgcgtctcttttatttatagtagtggtagtacatactcgcagactcgtgacggggcattccaccatctccaagagacaatccaaagaacacgcttgtttactacaaatgaaacagcctagagacgaccgatcgacacgggccgttagtacttacnggtgacgagagngtccgggggaccacgtaaaccgttcaacgcgtaacgtcggaccgtcgtacgggggacccaagggtacccg

SEQ ID NO: 381916 - DNA, 577 bp, Homo sapiens
  misc_feature: GZ8MTXP02JC99C.13.76.G10.1.454.CMB.2.raw
  modified_base (365)..(365): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtctggaggaggcttgatccagccgtggggggtccctgagactctcctgtgcagcctcgtgggttcaccgtcagtcacacctacatgagcgtcgggtccacacggctccgaggggaaggggctggagtgtcgtcttctttatttatagtagtggtagtaccatactcgnagacctcgtggagggccgattccactatcctccagagaacaatccaaagaacacgcttagtttactacaaatcgaaacgagcctagacgacgaccgatacgacgacggccgtagtacttacgtggtacgacgaggagtacgacggggtacccacgtaaacgttacacgtaacgttacgacggtacgtcggacggggacccaagggaaccccg

SEQ ID NO: 381917 - DNA, 523 bp, Homo sapiens
  misc_feature: GZ8MTXP02GK1R0.13.76.G10.1.454.CMB.2.raw
  modified_base (270)..(270): a, c, t, g, unknown or other
  modified_base (296)..(296): a, c, t, g, unknown or other
  modified_base (335)..(335): a, c, t, g, unknown or other
  modified_base (397)..(397): a, c, t, g, unknown or other
  modified_base (401)..(401): a, c, t, g, unknown or other
  modified_base (419)..(419): a, c, t, g, unknown or other
  modified_base (428)..(428): a, c, t, g, unknown or other
  modified_base (433)..(434): a, c, t, g, unknown or other
  modified_base (466)..(466): a, c, t, g, unknown or other
  modified_base (497)..(497): a, c, t, g, unknown or other
  modified_base (502)..(502): a, c, t, g, unknown or other
tcagtcacgtactacacgaccggtgctcgattagtcactcatacaggggggtagaggagcccagcactgggattccgaggtgtttccattcggtgatcagcactgaacacagaggactcaccatggagttttggctgagctgggttttccttgttgcttaattttaaaaaggtgcccagtgtgaggtgcagctggtggagtctggaggaggcttgatccagccgtggggggtccctgagactctcctgtgcagcctgtgggttcaccgtnagtcacactacatgagctggggtccncgaggcaccgaggggaaggggctggagtcggcttacttntttttaagtttataagtagtggtactacatacgcgcagactcgtgacggggcattcacatcncagntacaatcaaagacagctnttctaaaangaacnnctagagacgacatcgacgacgtcgtatatcgngagcgagagcgtcggaccacgtaactacacngtagnggacgtggacggacgaacggc

SEQ ID NO: 381918 - DNA, 631 bp, Homo sapiens
  misc_feature: GZ8MTXP02JPP09.13.76.G10.1.454.CMB.2.raw
  modified_base (289)..(289): a, c, t, g, unknown or other
  modified_base (391)..(391): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtcgtccgtgtccccaggacagacagccagcatcacctgctctaggaaataatggcagataaatatacttctgtatcagcagagtcaggccacgtccctgtgctgtcatctatcaagntcgaccaaggcccggcctacgagggtactcccccgtagacgtcgtattcctcgtcggcctaccgaactcgtacggaacctcgacgtcccactctacgacccngtaccgacgggacccggaccaggtactaggtcggacgtacgggaggtacctacggtactttaacgttacgtggtacggtacggggtacggtacgggaacacgggacacggaccgtaccggtaccggccccgtagttacgttacgggttacccgtaacggggaaccgttacgggggaaacccgttaacggggtacccctaacccggttaccttaaaccggtaccgacccggaaacccccgg

SEQ ID NO: 381919 - DNA, 710 bp, Homo sapiens
  misc_feature: GZ8MTXP02JRNC5.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctatttaaaaggtgcccagtgtgaggtgcagctggtggagtctgggaggaggcttgatccagccgtggggggtccctgagactctcctgtgcagcctcgtgggttcaccgtcagtcacacctacatgagcgtcgggtccgccgaggcctccggaaggggaacggggcgtgggagtcggcggttctttactttttaagtttattaaggttaggttagggttaacgtaaccgtacttaccgtacccgacacgtaccgttcccggtggggacgggggccgtactttccgacctactcctacccgagtaacgaaacctaaactttaccccaaaagggaaacccctaaccggtctttacggttttaaccttaaccaaaaattcgaaaacctcggtacctaggacgacggtacccgaatcggaccgaccgggtccttaggttacttacgtgtcgacggtagacgacggtaccgggggaccccaacgggtaacctttaccgacgaacgttaacggtccgggtaccggtcggtacgggggaacccgaacggggaacccccg

SEQ ID NO: 381920 - DNA, 604 bp, Homo sapiens
  misc_feature: GZ8MTXP02HP1UX.13.76.G10.1.454.CMB.2.raw
  modified_base (293)..(293): a, c, t, g, unknown or other
  modified_base (329)..(329): a, c, t, g, unknown or other
  modified_base (363)..(363): a, c, t, g, unknown or other
  modified_base (371)..(371): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggccnccgaggcctccgaggggaaggggctggatgcgtctntttttattatagtagtggtataccatactccganacgctcgngacggcatcactatcacagacaactaactaccgaaagaacacgtcttagtttactaacaaatacgaaacacgctagagacgacgatacgaaccgacggtcgtagttaacttacgtagtggacgaaggtacggacggtaccggggaaacccctaaacggtaaaccgttaacgtaaccgtaacgtaacggtacgggtaccggtcggtaccggggaacccgaaaaccggggacccg

SEQ ID NO: 381921 - DNA, 695 bp, Homo sapiens
  misc_feature: GZ8MTXP02ID4E6.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggaggaggcttgatccagccgtgggggtccctgagactctcctgtgcagcctcgtgggttccaccgtcagtcacacctacatgagcgtcgggtccgccgaggcctaccggaggggaacggggcgtgggagtggccgtttctttacttttttattagtagttaggtggtagtaccataccgtccgacacgtaccgtcggtgggacggggcctacttccacctatcctacccgaagtaacgaaacctaaattacccaaaaggtaaaccctacgtactttacgttttaccttaaacaaaagttacgaaaaccgtcgtacccgtagggaaacgaaccggtacccgaagttccggaaaccgtaccggggttaccgttaggttaaactttcggtaggtcggacggaaggtacggacggtaccgggggaacccaacggttaaacgtttacacgtaacgtaggtcggtacgtcggtacggggaccgtaacgggtaccccg

SEQ ID NO: 381922 - DNA, 622 bp, Homo sapiens
  misc_feature: GZ8MTXP02HSTRO.13.76.G10.1.454.CMB.2.raw
  modified_base (442)..(442): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctgggtggagtcgtgggaggaggcttgatccagccgtggggggtccctgagactctcctgtgcagcctctgggttcaccgtcagtcacacctacatgacgcgtcgggtccaccgaggcctaccggaggggaaggggctgggagtcggcgttctttcttttatttatagtaggtggtagtaccatactccgacagtacctcgtgggacggggcctattccaccacgtctacccagagacaattaccaaagaacncgtactttgtttacttacaaattacgaaactacgtccgttaggagacggacccgatcggaccgacggccgttgttaacttacgtgtacgcgaggtaggacgccgggggtacccaaacggtaaccgttactacgtccgttagacgggtacgtcggtacgggggaccgtaacgggaaccccg

SEQ ID NO: 381923 - DNA, 548 bp, Homo sapiens
  misc_feature: GZ8MTXP02F64LB.13.76.G10.1.454.CMB.2.raw
  modified_base (369)..(369): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagctgggtccgccaggcctccgaggggaaggggctggagtgcgtcttcttttatatagtgtggtatacatactcgcagctccgnggacgggccattcaccatcctccaagacgacaattccaaagacacgcttgtttactacaaattgaaacacgcctagaacgagacccgatcggaccacggtccgtagtattacgtgtgcggagagacggtcggggacccagaacgttcaacgctagtcggacgtcggacggggtaacccg

SEQ ID NO: 381924 - DNA, 650 bp, Homo sapiens
  misc_feature: GZ8MTXP02GMK2V.13.76.G10.1.454.CMB.2.raw
  modified_base (273)..(273): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtcccaggacagacagccagcatcacctgctctggaaataattggacagataaatatacttcctggtatcagcagagtcaggccagtcccctgngctggtcatctatcaagatgccaagccggccctacgagggactccccgtagagcgtacttctctggcctccaactctagggaactcagcccactctacgaccactacgacgacccggggaacccacgggtcctaagtgggtaaccgtacggacggtcgttacgtaacgtttaacgttaccgttacggtaccggtacgggtacgggtacggggaacgacggtaccgaacggtacccgtaccggtccggtacccggtacgttacggttccggttacccggttaaccggggtaaccggttaccggggaaacccgttaaaccgggttaccccgtaacccggttaacccgtaaaccggtacccggaaacccggtaaccccgg

SEQ ID NO: 381925 - DNA, 635 bp, Homo sapiens
  misc_feature: GZ8MTXP02G68Q7.13.76.G10.1.454.CMB.2.raw
  modified_base (552)..(552): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtgggtccgccgaggcctccggaggggaaggggctggagtgcgtctttctttttatttagtagttaggtcggttagtacctataccgtccgacacgtaccgttcggtggggacggggccgtacttccacctatcctaccgaagacgtaactaacttaccgaaagaccacgtcttacgttttacctaacgaaaattcgaaaacctcgtaccctagggacgacgtacccggaattcggaacctaccgggtcgttagttaacttacgngtcgacgaggtagacggtcggggaccctaacgtaacgtactacgcgtagtcggaacgttcggacggggaccaacggggacccg

SEQ ID NO: 381926 - DNA, 789 bp, Homo sapiens
  misc_feature: GZ8MTXP02HETZ4.13.76.G10.1.454.CMB.2.raw
  modified_base (261)..(261): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagcttgggttttccttgttgcttattttaaaaggtgcccagtgtgaggtgcgagcgtggtggagtcgtgggaggagcttgatccgaggccgtgggggtccctgacgtactctcctgtgcngcctcgtggtcaccgtcagtcacacctacatgagtcgtcggtccgcgacggctaccggaaggggaacggggctgggagtgtccgttctttacgtttttaagtttagtaggttagtcgggttaacgttactacgttaccgtccgacgaacgtccgttaccgggtggggaacccgggggaccttacttacccaacctaaacgttcccgttacccgaaagaacgtaaccgtaaaactttaacccgaaaaggtaaaaccccgtacggttacccttttacggtttttacctaaacctaaaacgttacggaaaacctacggttacccgtaggaacggaacggtacccgtagtacgggaaacccgtaccggggtcccttaagttaacgtttaaccggtgttaccgggacgaaaggtacggtaaccgggttacccgggggacccccttaaaacggttaaaccggttaaccgtaaacggtcccgtttaagggtacccgggtaaccggttccggggttaacgggggaaaacccccggg

SEQ ID NO: 381927 - DNA, 646 bp, Homo sapiens
  misc_feature: GZ8MTXP02GO07F.13.76.G10.1.454.CMB.2.raw
  modified_base (466)..(466): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtcgggccgccgaggcctccgaggggaaggggcgtggagtgcgtcttctttattatagtagtggtagtacatactcgacacgactcggtgggacggggccgtattccacctatcctccaagacgaaacctaacttaccgaaagaaaccgacgtcttagtttacctactaaaatgaaacngacctgagagacccgatacgaaccgtaccgggtccgtaggttaacttacgtggtacggacggaaaggaggtacggtccgggggaaccccaacgggtaaaccgtttaaccgtaccgtaacgttaacggtaccggggtaccggttaccggtacgggggaacccgaaaacgggggaacccccg

SEQ ID NO: 381928 - DNA, 552 bp, Homo sapiens
  misc_feature: GZ8MTXP02IT6CB.13.76.G10.1.454.CMB.2.raw
  modified_base (252)..(252): a, c, t, g, unknown or other
  modified_base (356)..(356): a, c, t, g, unknown or other
  modified_base (367)..(367): a, c, t, g, unknown or other
  modified_base (381)..(381): a, c, t, g, unknown or other
  modified_base (389)..(389): a, c, t, g, unknown or other
tcagtcacgtactacacgaccggtgctcgatttagtcactcatacagggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtatggaggaggcttgatccagcctggggggtccctgagactctcctgtgcagcctntgggttcaccgtcagtcacacctacatgagtggtccgccaggctccgaggggaagggctggagtgcgttctcttttattatagtagtggtagtacatactccgnagactccgtgnggggccattcaccntctcaganacaattccaagaacacgtctgtttctacaaatgaacagcctgagagccgatcgacgacgccgtgtaattactgtcgagagagacggtcgggacccaacggtaaccgttactacgactaagtacgggacgttacgcggggaccaacgggggaccctaacccggg

SEQ ID NO: 381929 - DNA, 680 bp, Homo sapiens
  misc_feature: GZ8MTXP02I1L1B.13.76.G10.1.454.CMB.2.raw
  modified_base (379)..(379): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgacgactctcctgtgcacgcctcgtcggttcaccgtcagtcacacctacatgagcgtcgggtccgccgaggcctcggaggggaacggggcgtgggagtgtcgttctttacttttatttagtagtagtggtacgtacactacnccgacacgcgtcgtggacggggcctattccgaccactcctaccgaagaacgaaactaaacttaccgaaaacgaacccgtaacgttccgtttacgtttaccttaactaaaagttcgaaaaccgtcggtaccgtagggaacgacgacccgagtacgaacggaccggtcgttagtaacgttacgtggtacggaacgaggtaacggtacgggtacccgggggaacccctaacgggtaaaaccgttaacgtaaccggtacgttaaacgtcggggtaccggttaccgggtaccgggggaaaacccgg

SEQ ID NO: 381930 - DNA, 571 bp, Homo sapiens
  misc_feature: GZ8MTXP02JHGNS.13.76.G10.1.454.CMB.2.raw
  modified_base (328)..(328): a, c, t, g, unknown or other
  modified_base (363)..(363): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtctggaggaggcttgatccagccgtgggggtccctgagactctcctgtgcagcctctgggttcaccgtcagtcacacctacatgagctgggtccgccaggctccgagggaaggggctgggagtgcgtnttcttttattatagtagtggtagtacatactccgnagctcgtgacggggccattcaccatctcagagacaacttccaaagaccacgcttgtttctacaaatgaaacagtccctagacgaagcccgtatcgaccgacgggccgttagtaacgttactggtagcgaacggagacggtcgggggaccccaacggtaaccgttaacgtacggtactagtacgggacctttcgggacgggggaacccg

SEQ ID NO: 381931 - DNA, 590 bp, Homo sapiens
  misc_feature: GZ8MTXP02FWA0G.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttattttaaaaggtgcccagtgtgaggtgcagctggtggagtcgtggaggaggcttgatccagccgtgggggtccctgagactctcctgtgcagcctctgggtcaccgtcagtcacacctacatgagcgtgggtcccgccgaggcctccgaaggggaaggggctgggagtgcgttcttcttttatttatagtagtggtagtacatactcgcacactcgtggacgggccattccaccatctccagacaacaataccaaagaacacgcttgtttactacaaaatcgaaacacgacctaggacgacgaccgtatacgaaccgacggtccgttatacttactggtcgacgagaggacgtcggggaaccccaacggtaaaccgttacacgaacgttacgtacggaccgtcggtacggggaccgaaacggggacccc

SEQ ID NO: 381932 - DNA, 605 bp, Homo sapiens
  misc_feature: GZ8MTXP02J1XQA.13.76.G10.1.454.CMB.2.raw
  modified_base (455)..(455): a, c, t, g, unknown or other
  modified_base (464)..(464): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtgggtcccgcaggcctccgaggggaaggggctgggagtgcgtcttacgttttatttagtagtagtaggtagtacatactcgcagcgtcgtggacggggccgtattcacctatccctaccgagagaacctaaattcccaaagaaccacggtcttgtttacctaanaaatgaacncgcagacgacgtcgagtacgaacgtcggtacgttagtaactacgtggtaggacggaggtaacggacggtaccggggaaccctaaacggttaaaccgttaacgtaacgtcgtaacggtcggtaccgtcgggacgggaacccg

SEQ ID NO: 381933 - DNA, 765 bp, Homo sapiens
  misc_feature: GZ8MTXP02HHICN.13.76.G10.1.454.CMB.2.raw
  modified_base (521)..(521): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtccctgagactctcctgtgcagcctcgtgggttcaccgtcagtcacacctacatgagcgtcggggtccgccgaggcctaccggaggggaacggggcgtagggagtcggcgttcttcttttatttatagttagtggtagtacctactacctccgactacgtacgttccggtgggacggggtcctacttccgaacctactacctacccgaaagtacgaaaccctaaagttaccccaaaaggtaaccctacggttctttacgttttacccttaaacgaaaagttcggtaaaaccncggttaaccccttagggaaacgggacccgacccggttaacgtccgggaacccgtacgggggtaccccgtttaggtaaacctttacccgttggggtacggtaaccggaagggtacggtaaacgggtacccggggggtaaccccctaaacgggttaaaaccggtttaccctaaaccggcgttaaacggtaccggggtaaccccggttcggggtacccggggggaaaccaaaacgggggtacccccg

SEQ ID NO: 381934 - DNA, 675 bp, Homo sapiens
  misc_feature: GZ8MTXP02HVCOT.13.76.G10.1.454.CMB.2.raw
  modified_base (285)..(285): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggaggaggcttgatccaggccgtgggggtccctgagctctcctgtgcagcctcgtggtccaccgtcagtcaccacctanatgagccgtcgggtcccgccgacgggccgtaccggaaggggaacggggcgtagggagttcggtcgttctttactttttaagtttagtaggttaggttggtaagtacctattaccgtcgacaacgtccgtccggtaggacgggggccctacttccaacctactcctaccgagtaacgactaaactaccgaaaagaccacgtcttagtttactaacaaagtcgaaacgagtaccgtaggagaccgaccgaatcggaaccgtacggtaccgttaagttacgttacgtggtacgacggaagacggtacggtccgggggaaccccctaaaggttaaacccgttaacgtaccgtacgttaacgacggggtaccggtttaccggacggggaacccgg

SEQ ID NO: 381935 - DNA, 611 bp, Homo sapiens
  misc_feature: GZ8MTXP02F3JVS.13.76.G10.1.454.CMB.2.raw
  modified_base (298)..(298): a, c, t, g, unknown or other
  modified_base (362)..(362): a, c, t, g, unknown or other
  modified_base (509)..(509): a, c, t, g, unknown or other
tcagtcacgtactacacgaccggtgctcgatttagtcactcatacagggggggagaggagcccagcactgggattccgaggtatttccattcggtgatcagcactgaacacagaggactcaccatggagttttggctgagctgggttttccttattactattttaaaggtgtccagtgtgaggtgcagttggtggagtctgggaggaggctttggtccagggccgggggggtccctggagactctcatgtgcggcctgtgggctcaccgtcaacaccaactacatgagctggggtccnccgaggctccgagggagaggccgggagtggtctcgtagtttatttatggtcgacggtgacccanatttcaccgcagacctccggtggacggggtcccttcaccatcctaccagacgaacaattaccaaacgaacacggtagtattcgttacaaatacgaacgacctagagagtcgaggacgacggccgtacgtacttactgtgacgaaagntagcgagacggacgggaccccgtaaggtcgggtaccgtggggtacggtcggtttcgttcgtttacgacgttcggtcgtcggggtaccgaacgggtaccccgg

SEQ ID NO: 381936 - DNA, 687 bp, Homo sapiens
  misc_feature: GZ8MTXP02IJ03Y.13.76.G10.1.454.CMB.2.raw
  modified_base (296)..(296): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctctgtgcagcctcgtgggttcaccgtcagtcacacctacatgagccgtgggtcccnccgaggcctccgaggggaggggctggagtgcgtctttcttttattatagttagtggtagtacctataccgtccgacacgtaccttccggtgggacgggggacctacgttcccacctatcctacccaagacgaacctaattaccaaagtaaccacgtctttagtttccttaacaaaagtcgaaaacgcgtaccctggaaacgtaccggaccgtaagttacggaacccgtaaccggggttcccgttaacggttaatttaaccgtcgggtagtaccgggaaggtaaacggtacgggttaccgggggaaccccctaacggggtaaaaaccgtttctaacggaaccgtttaggtacgggacggttacggtcgggggacccaaaagggggacccccg

SEQ ID NO: 381937 - DNA, 666 bp, Homo sapiens
  misc_feature: GZ8MTXP02FNDQ1.13.76.G10.1.454.CMB.2.raw
  modified_base (364)..(364): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtctggaggaggcttgatccagccgtgggggtccctgagactctcctgtgcagcctcgtgggtcaccgtcagtccacacctacatgagcgtcgggtccgccgaggcctccggaggggaaggggctggagtgcgtcttcttttatttatagtagtggtatacatacncgcagacctccgtggacggggccattccaccatcctccaagacgaaactaacttaccgaaacgaacaccggactttcgttttaccttaacaaaattcggaaaacctcggacctaggaacggacgacccggtaatacggaacccgaaccggggtcccgttagttaacgtttaccgtggtacgacggaggtaacggtacgggtaccgggggacccccaaacgggttaaacccgttacgtaaccgtcgttaacggtacgggtaaccggttcggtaccgggggaacccgaaacgggggtaaccccg

SEQ ID NO: 381938 - DNA, 557 bp, Homo sapiens
  misc_feature: GZ8MTXP02IBUC2.13.76.G10.1.454.CMB.2.raw
  modified_base (369)..(369): a, c, t, g, unknown or other
  modified_base (445)..(445): a, c, t, g, unknown or other
  modified_base (493)..(493): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtcgggtcccgccgaggcctccggaggggaaggggcgtggagtgcgtcttctttttattatagtagtggtagtacatactcgnagactcgtgacggggcattcacatctccagacgactaataccaaagaacctcgtcttgtttactacaaatgaaacncgacctgagagccgatcgaccgacggccgtgtaattcgtgtcgcgagnggacgtcggggacccaacgtacgttacacggtctagcggtacgtgcggggactaacgggacccg

SEQ ID NO: 381939 - DNA, 638 bp, Homo sapiens
  misc_feature: GZ8MTXP02I13M1.13.76.G10.1.454.CMB.2.raw
tcagtcacgtactacacgaccggtgctcgatttagtcactcatacagggggggagaggagcccagcactgggattccgaggtatttccattcggtgatcagcactgaacacagaggactcaccatggagttttggctgagctgggttttccttgttgctattttaaaaggtgcccagtgtgaggtgcagctggtggagtcgtgggaggaggcttgatccagccgtgggggtccctgagactctcctgtgcagcctcgtggttcaccgtcagtcacacctacatgagcgtgggtcccgccgaggctccggaaggggagggctggagtgcgttcttcttttattatagtagtgtatacatacctcgacagactcgtggacggggcctattccacctatcctacagacgaactaattacccaaagaaccacgtcttacgtttactaacaaagtcgaaacagtccgtaggacgacgaccggtatacggaaccgtaccgggtcccgttagttacgttacgtcgggttacgacggtaggaacggtacggtacccgggggaccctaaacggtaaacccggttacctaacggtcgtaacggtcgggtaccggtcgggtaccggggtaccgaaaacggggtccccgg

SEQ ID NO: 381940 - DNA, 603 bp, Homo sapiens
  misc_feature: GZ8MTXP02F05XA.13.76.G10.1.454.CMB.2.raw
  modified_base (334)..(334): a, c, t, g, unknown or other
  modified_base (394)..(394): a, c, t, g, unknown or other
  modified_base (432)..(432): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtcgggtcccgccaggcctccgaggggaggggctggagtgcgtcttntttattatagtagtggtatacatactcgcagactcgtggcgggccatccacatctcaganacaatcaagacacgcttgtttactacaaaatcgaaacngcctaggacgacgaccgatacgacgacgggtccgttagttacttacgtgtcgacgtaaggacggtacggtccgggggaacccctaacggtaaaccgtttaccgtacggtaaccgttaaggtacggggtaccgttaccgggacgggggaacccctaaacgggggaacccccg

SEQ ID NO: 381941 - DNA, 548 bp, Homo sapiens
  misc_feature: GZ8MTXP02JKPY3.13.76.G10.1.454.CMB.2.raw
  modified_base (236)..(236): a, c, t, g, unknown or other
  modified_base (287)..(287): a, c, t, g, unknown or other
  modified_base (335)..(335): a, c, t, g, unknown or other
  modified_base (403)..(403): a, c, t, g, unknown or other
  modified_base (409)..(409): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataatggacagataaatntacttctggtatcagcagaagtcaggccagtcccctgtgctggtcatctancaagatgccaagccggccctgacgggactcccccgtgacgtctattcnctcggcctaccgaactcgtacgggaactcgagcccactctcgacatcacgcggacccaggctagaggngtaggngctgacttattacgtgcgagggcggtagggacaggacacgcacgtcgacccgtcgttaagtcggttccgttacgggaacgttaccggggaaaccgtaacggtacccgaaccggttacctaacggcccacggaacccccg

SEQ ID NO: 381942 - DNA, 540 bp, Homo sapiens
  misc_feature: GZ8MTXP02F2J58.13.76.G10.1.454.CMB.2.raw
  modified_base (429)..(429): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctgggggtccctgagactctcctgtgcagcctctgggttcaccgtcagtcacacctacatgagctgggtccgccaggcctccgaggggaagggctggagtgcgtcttctttattatagtagtggtagtacatactcgcagctcgtgaggggccatcacatctcagagacaattccaaagacacgcttgtttactacaaatgaaacngacctgagagccgatcgacgacggtcctagtacttactggtcgacgagagacgtcgggggaccccaaggtaaccgtaacgaccgactagtggaccgtggacggggaacccg

SEQ ID NO: 381943 - DNA, 678 bp, Homo sapiens
  misc_feature: GZ8MTXP02F6CPM.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtggttcaccgtcagtcacacctacatgagcgtgggtccgccgacgggcctaccggaggggaacggggcgtgggaggtcggtcgttcttctttttatttatagttaggtggtagtacactacctccgcacgtccgtccgtagggacggggccgtagttaccaccgtacttccctaccgaagtaacgaacctaaagttacccgaaaaggaaacccgtcgtttacgttttaccttaacctaaaacgtaaacggtaaccaacggtccgtacgaggaaccggccgaacgttacgaaccgacggtaccgttcggtaattaccttaggtgacggaggtaaggaacgtcggggtacccgaccgtaaaaccgtttacgtaaccgtcgtaacgttcgggtaccggtcggtacggggaccgaaacccgggg

SEQ ID NO: 381944 - DNA, 597 bp, Homo sapiens
  misc_feature: GZ8MTXP02ITKHD.13.76.G10.1.454.CMB.2.raw
  modified_base (299)..(299): a, c, t, g, unknown or other
  modified_base (472)..(472): a, c, t, g, unknown or other
  modified_base (508)..(508): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgactccagccgtggggggtccctgagactctcctgtgcagcctcgtgggttcaccgtcagtcacacctacatgacgcgtcgggtccnccgaggctaccggaggggagggcgtggagtgcgttcttctttatttagtagttagtggtagtactatacctcgcacgaccgttcggtggacggggacctacttccaccgtatcctccgagacaacaattaccaaagacacgtcttcgttactaacaatagaacagcctagganaacgtccgaatcgacgacggtccgttagtattacgngtacgacgaggacgacggtacgggacccctaaggtaaccgttcgaacgcgttaagcggtaaccgtggacggggaccaaacgggacccgg

SEQ ID NO: 381945 - DNA, 723 bp, Homo sapiens
  misc_feature: GZ8MTXP02I7QNM.13.76.G10.1.454.CMB.2.raw
  modified_base (306)..(306): a, c, t, g, unknown or other
  modified_base (536)..(536): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtcgtgggaggaggtcttgactccaggcccggttcggggggtccctggacgtaccttcctcctgtcgccagtcctcgtcgggttccaaccgtcagtccaccacctacntgagcgtcgggtcccgccaggcctccggaaggggaacggggctaggggagtggccggtttctttactttttatttaacgtagttaggtggttaatacctataccgtcgctaacgtaccttcgggtgggacgggccgtaacttccgaacctacgtcctaccgaagacgtaaacctaagttacccgaaaagacctacgtcttacgttttacctaactaaaacgtcgaaaacncgtacccgtagaaggtaccgacccgtaatcggaacccgtaaccggggcgttaagtttaccttagtggtaccgacggaaggtacgtaacgggttacccgggggaacccctaaacggtaaacccgtttctacggtaaccgttaggcgggtaccgtacgggtcgggggaaccctaaacggggtacccccg

SEQ ID NO: 381946 - DNA, 710 bp, Homo sapiens
  misc_feature: GZ8MTXP02FVO8X.13.76.G10.1.454.CMB.2.raw
  modified_base (249)..(249): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctatttaaaggtgcccagtgtgaggtgcagcgtggtggagtctggaggaggcttgatccagccgtggggggtccctgagactctcctgtgcngcctcgtggtcaccgtcagtcacacctacatgagcgtcgggtcccgccgacggcctaccggaaggggaacggggccgtggggagtcggtccggttctttactttttaagttttagttaggtaggttaggttaagttacctacttaccgtccgactacggaccgttccgggtggggacgggggtccgtattcccgaacctactacctcccgaaagacgtaaaccaaacttaacccgaaagaaccctaccgtctttacgtttaccttacgaaaagttcgaaaacgtacgtaccgtagacggacgccggtaaatcggaaccgtcgggtaccgttaggtacttacgtggtacgacggtaggacggtacggttccggggaaccctaaacgttaaaccggttactaacggtccgttagtacgggttaacccggtcggtacgggggaacccgaaacggggtaccccgg

SEQ ID NO: 381947 - DNA, 540 bp, Homo sapiens
  misc_feature: GZ8MTXP02FYMPK.13.76.G10.1.454.CMB.2.raw
  modified_base (265)..(265): a, c, t, g, unknown or other
  modified_base (342)..(342): a, c, t, g, unknown or other
  modified_base (371)..(371): a, c, t, g, unknown or other
  modified_base (386)..(386): a, c, t, g, unknown or other
  modified_base (466)..(466): a, c, t, g, unknown or other
tcagtcacgtactacacgaccggtgctcgatttagtcactcatacagggggagaggagcccagcactgggattcccaagtgttttcattcagtgatcaggactgaacacagaggactcaccatggagtttgggctgagctggattttcctcgctgctattttaaaaggtgtccagtgtgaggtgcaagtggtggagtctgggggggcttggttaagccgtgggggtccctcagactctcctgtgcaacctctggattcattttcnctgacgcctggttgagctgggtcccgcaggctcccgggaggctggagtggtgcgtagtaaggtgaagcatggtcganaagagactacagtgtccgtgaaaggcagntcgactatctcaagnatgactacaaagaatagatatatactgacaaatgaaacaacctagaaagcgagacacgagcgtagtacttacagtaccanagagtgggaccaggatcgacaaagtcggaccgaacggacgaacgttcggactacggtacggggacccggaacgg

SEQ ID NO: 381948 - DNA, 700 bp, Homo sapiens
  misc_feature: GZ8MTXP02IZWXY.13.76.G10.1.454.CMB.2.raw
  modified_base (329)..(329): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggtcaccgtcagtcacacctacatgagctcgggtcccgccaggcctccggaaggggaacggggcgtagggngtggccgtttctttctttttatttatagtagtggtatacctatactccgcagacctccgtggacggggcctattccacctatcctacccaaagtacaacctaaacttaccgaaacgtaaaccgaacggttcctttacgtttaccttaacctaaaattacgaaaaccgtacgtacccgttaggaacgacggaaccgttaacgaaccggaaccgtaacccggggtccgttaaggttaaacttaccggtgttcggtacgaggacggtaaacggtccgggggaaaccccctaaccggtaaaaccggttaacgtaccgtaaccgttaagtaccgggtacgtaccggtacgggggaacccggtaacgggaaccccgg

SEQ ID NO: 381949 - DNA, 574 bp, Homo sapiens
  misc_feature: GZ8MTXP02GLO0Q.13.76.G10.1.454.CMB.2.raw
  modified_base (378)..(378): a, c, t, g, unknown or other
  modified_base (471)..(471): a, c, t, g, unknown or other
tcagtcacgtactacacgaccggtgctcgatttagtcactcatacaggggagcctgggcctcaggaggcagcatcggaggtgcctcagccatggcatggatccctctcttcctcggcgtccttgcttactgcacagaatccatggcctcctatgagttgactcagccaccctccatcgtccgtcgtccccggacacgacacgcctacatccacctgctcgtggagatgtattagaactaacgagtagtggttcctggtatcagcagaggcaggccacgcccctgtccctactcacttctttacaaaactaccaggccgccctcgtcggggttccctagacgcgtacttcccgtccggcctccgcctcgtacgggaacncgacgtcactctcgaccactccgacggccgggacccacgcctagttcgagtggacgtctgtcttacttcgtgtcgagggtcgtgggacaacgngcgtgtcgtggttcggacgggtacgggaccacggtctggaccgttgtacggtcacgccgaacggcgtcccgaccccgtcggtctacctccgttcggttccccg

SEQ ID NO: 381950 - DNA, 585 bp, Homo sapiens
  misc_feature: GZ8MTXP02FSLJB.13.76.G10.1.454.CMB.2.raw
  modified_base (357)..(357): a, c, t, g, unknown or other
  modified_base (372)..(372): a, c, t, g, unknown or other
  modified_base (390)..(390): a, c, t, g, unknown or other
  modified_base (400)..(400): a, c, t, g, unknown or other
  modified_base (429)..(429): a, c, t, g, unknown or other
  modified_base (478)..(478): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggtcaccgtcagtcacacctacatgagcgtcgggtccgccgaggctccgaggggaagggcgtggagtgcgtctctttattatagtagtggtatacatacncgcagacgtcgtggngggcatcacatctcaganacataccaanaactcgcttcgtttactacaaatgaaacncgcctaggacgacgccgtatacgaccgaaccggtcgttagtacttacgngtaggacgtaggacgacggtcgggggaaccccaacggtaaccgtttaacgacgtcgttaacggtacggaccggttacgtacgggggacccgaacggggtaacccccg

SEQ ID NO: 381951 - DNA, 547 bp, Homo sapiens
  misc_feature: GZ8MTXP02GPURN.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggattcacctttagtagctattggatgagctgggtccgccaggctccgagggaggggctggagtgggtgccaacataaagcaagttggaagtgagaaatactatgtggactctgtgaagggccgattcaccatctccagacgacaacgccaaagacctcactgtactctagaccaaaatcgaaacagcctagaacgacgcccggaagggaccacgggctgtcctaattacgtggtcgacgagacgtaggttgggggacgtaaaggtctaggcaggtcggactacgtttaacg

SEQ ID NO: 381952 - DNA, 607 bp, Homo sapiens
  misc_feature: GZ8MTXP02FTZ6K.13.76.G10.1.454.CMB.2.raw
  modified_base (466)..(466): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttggatccagccgtcggggggtccctgagactctcctgtgcagcctgtgggtcaccgtcagtcacacctacatgagcgtcgggcccgaccgaggtccaccggaggggaacggggcgtgggagtgcgttcttcttttagttatagtagtcggtataccatactcgcagacctcggtgaggggccagttcacctatcctccgaagagactaaacgttaccaaagaacacgcttgtttacttacaaaatcggaaaaccncgacgtagacgacgacgtagacgaccgacggtacgttagtacgttacgtgagacgaggaggacggtaccgggaacctaacgtaaccgttacgacgtcgtacggtacggtaccgtcggtaccggggaccgtaacgggtaccg

SEQ ID NO: 381953 - DNA, 603 bp, Homo sapiens
  misc_feature: GZ8MTXP02GQMCD.13.76.G10.1.454.CMB.2.raw
  modified_base (388)..(388): a, c, t, g, unknown or other
  modified_base (419)..(419): a, c, t, g, unknown or other
  modified_base (444)..(444): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctctgtgcagcctctggtcgtaccgtcagtcacacctacatgagcgtcgggtccgcccgacggccgtccgaggggacggggacgtggaggtgcgtcttctttatttatagtagtggtagtaccatactcgcagactcgtgcgggcgtntcaccatctcgagagaaccataccagaaacncgcttgttctaacaatacgaacacncctgagacgccgatcgacgacggccgttatattacgtgggacacggaggacgtacggtaccgggggaccccctaaacggtaaccgttaacgttacggccgttaaggtttcggaacccggttcggtaacggggggacccgtaaaacggggtaacccccgg

SEQ ID NO: 381954 - DNA, 636 bp, Homo sapiens
  misc_feature: GZ8MTXP02JS49S.13.76.G10.1.454.CMB.2.raw
  modified_base (455)..(455): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtggggggtccctgagactctcctgtgcagcctctgggtcaccgtcagtcacacctacatgagcgtgggtccgccaggcctccgaggggaggggctggagtgcgtcttcttttattatagtagtggtagtaccatacctcgcagacctcgtggacggggccgtattccaccatcctcccgagagacaattccgaaagaccacgtcttgtttacttacaaaatcggtaaacccngtacgtaggaacgtacggacccgagtaccggaaccgtaccggggtaccgttagttaagtttccgtaggtcggtacggaaggtacggtacgggtcccggggaaccccgtaacggttaaccgttaccgacggtcgttaggtcggggtaccggtcgggtaccgggggaccggaaacgggtcccg

SEQ ID NO: 381955 - DNA, 588 bp, Homo sapiens
  misc_feature: GZ8MTXP02FIJLB.13.76.G10.1.454.CMB.2.raw
  modified_base (237)..(237): a, c, t, g, unknown or other
  modified_base (360)..(360): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagcccgccctcagtgtctcggggccccagggcagaggtcaccatctcctgcacgtgggancagctccaacagttggggcacattatgatgacactggtaccagctagtttccgaggagcgacggtcccagacctcctcatacaataacgtaaacaacaagtccggacccgcgacggggtcccngaaccgtattctcgtcggctccgaggtctcggactacctcgacgtccctcccgtggtcagtccacgtcgggtcctccgaggccgtggaggtataggacgggtcttaggtatttactttcgtcggtacctaacggttaccctaagtcggactacggcctaacggtccgtaggaagttcgtccggtttacgggttacgtttccggggggaccgggggtacccctaacggg

SEQ ID NO: 381956 - DNA, 811 bp, Homo sapiens
  misc_feature: GZ8MTXP02ID68J.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagcttgggttttccttgttgcttaattttaaaaggtgccagtgtgaggtgcagcgtggtggagtcgtggaggaggcttgatcagccgtgggggtccctgagctctctgtgcagcctcgtcggtccaccgtcagtccacacctacatgacgtcgtcgggtccgccgaggcctaccggaaggggaacggggtcgtgggagtcgtcgtttcttactttttaagtttaagtaggttaggttacggtaacgttaactacgtaccttccgacgtaacgtcccgttaccgggtacgggaacgggggtacccgtaactttccgaaaccctacgtaccctacccgaaaggtaaccgaaacctaaacgttaccccgaaaaagtaaaccctacggttccttttacggttttaacccttaaaacgaaaaggttccgaaaaccgacggttcccgttaagggaaaccgggaccggtacccgtaaagttaccggaacccggtaccggggtacccgtttagtttaaaaccgttacggtcgggtaacggaccgggaaaggtaaacggggtaccgggttaccccgggggaaaccccttaaaacggggtaaaacccgtttaaccgtaaacccgggtcgtttaaacggggccggggtacccggtttaccggggaacccgggggaaaccccg

SEQ ID NO: 381957 - DNA, 661 bp, Homo sapiens
  misc_feature: GZ8MTXP02JKBNF.13.76.G10.1.454.CMB.2.raw
  modified_base (171)..(171): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagcccaccctnagtgtccgtgtccccaggacagacagccagcatcacctgctctaggaaataatggcagataaatatacttctgtatcagcagaagtcaggccagtcccctgtgctggtcatctatcaagactgaccaaggtcccggccctcgaacgggtactccccccgtaggacgtcgtaacttccgtcgtcgggcctacccgaaacgttccggtaggggaaccttcgaacgccctaaaccttccgtaacgaccctaacgtccgaacgggacccgggaaccccagggtacctaggtacgggactaggacggttacgtacggtaacttacgttaaccgtggttaccgaagggggtcccggtagggggaaaccagggaccacggtaccgacgttccgggcccctagtacgttcggttaccgttaacgggaaccgttcgggaaaccctaacggggttaccctaacccgggttccttaaaacggtccgaaccggaaacccccg

SEQ ID NO: 381958 - DNA, 663 bp, Homo sapiens
  misc_feature: GZ8MTXP02HXJYK.13.76.G10.1.454.CMB.2.raw
  modified_base (362)..(362): a, c, t, g, unknown or other
  modified_base (389)..(389): a, c, t, g, unknown or other
  modified_base (437)..(437): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacgcctacatgagctgggtccgccaggctccgaggggaaggggctggagtgcgtcttcttttattatagtagtggtagtacatactccgnagactcgtggacggggccattccaccntctaccagagacaatccaaagaacacgcttgtttctacaaatgaaacncgacctagagacgaccgatacgaaccgacgggtcccgttagtaacgtttaaccgtggttacggacggtaaaggtaacggtacgggttacccggggggaaccccctaaaacggggtaaaacccggttttaaccgtaaaccggtaaccgtttaaacggttacgggggtaaccccggttaccgggttaaccgggggggtaacccctaaaaacgggggggtaaccccccg

SEQ ID NO: 381959 - DNA, 549 bp, Homo sapiens
  misc_feature: GZ8MTXP02G71XA.13.76.G10.1.454.CMB.2.raw
  modified_base (235)..(235): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcaggaggtcacatctcctgcacgtgggancagctccaacagttggggcacgattatgatgtacatggtaccagctagttccaggagcgaggtcccagactctcatactaaataacgtaaacaaacaacgtccggaccgacgacggggtccctcgaccgtacttctctggccttcgagtctggccactcacgcctcccgtgtcatcacgtggcctcgagtctgacggatgaggctagtatttacttcgtcgacctacgttccttagtcgaaccgtacgccgacgtcctggtaagtcgtaccggtttcggtacggtttccgggggaccgggggtaccctaccggg

SEQ ID NO: 381960 - DNA, 509 bp, Homo sapiens
  misc_feature: GZ8MTXP02H1AD1.13.76.G10.1.454.CMB.2.raw
  modified_base (168)..(168): a, c, t, g, unknown or other
  modified_base (230)..(230): a, c, t, g, unknown or other
  modified_base (236)..(236): a, c, t, g, unknown or other
  modified_base (263)..(263): a, c, t, g, unknown or other
  modified_base (266)..(266): a, c, t, g, unknown or other
  modified_base (283)..(283): a, c, t, g, unknown or other
  modified_base (299)..(299): a, c, t, g, unknown or other
  modified_base (370)..(370): a, c, t, g, unknown or other
  modified_base (389)..(389): a, c, t, g, unknown or other
  modified_base (397)..(397): a, c, t, g, unknown or other
  modified_base (421)..(421): a, c, t, g, unknown or other
tcagtcacgtactacacgaccggtgctcgatttagtcactcatacagggctgggcctcaggaagcagcatcggaggtgcctcagccatggcatggatccctctcttcctcggcgtccttgcttactgcacaggatccgtggcctcctatgagctgactcagccacctnagtgtccgtgtcccaggacagacagccagcatcacctgctctggaaataatggcagataaantactcnggtatcagcagaatcaggccagtcccngtnctggtcagtcatcaagntgaccaagcggccctnaggatcccccagacgcgtattctcgtggccttacaaactcgtagggaactcgagtcccaatctagacctancgagcggaccaggctaagngatagcgntagtatacgtagtgacgacgtcgngacgagacgacgacgtacgtcgcgtacgtacgtacgtacgtacgtacgtacgtaacgtacgtacgtaccgtacgtacgtacgacgacg

SEQ ID NO: 381961 - DNA, 622 bp, Homo sapiens
  misc_feature: GZ8MTXP02HMYQD.13.76.G10.1.454.CMB.2.raw
  modified_base (489)..(489): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctcgtgggttcaccgtcagtcacacctacatgagcgtcgggtcccgccgaggcctaccggaggggaacggggcgtagggaggtcgtcggttctttctttttaatttagtagtaggttggtaagtacccattacctccgactagccgtccggtggggacggggcctattccgacatcctccaagtagaactaaattaccaaagaaccacgtcttgtttacctacaaaattcgaaacncgtctagaagacgccgaatcgaacgccggcgttgtattacgtgtgcggagagtacggtccggggacccacggtaaccttacgtacgaactacggtcgggtacggtcggtaccggggacgtaaacggggacccg

SEQ ID NO: 381962 - DNA, 578 bp, Homo sapiens
  misc_feature: GZ8MTXP02I34EY.13.76.G10.1.454.CMB.2.raw
  modified_base (396)..(396): a, c, t, g, unknown or other
  modified_base (441)..(441): a, c, t, g, unknown or other
  modified_base (462)..(462): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtcgggtccgccgaggctccgaggggaggggctggagtgcgtcttcttttattatagtagtggtatacatactcgcagactcgtggacgggcattcaccatcctccaganactaattacccaaagacacgtcttagtttacttacaaatgaaacngcctagagacgccgatcgacncggtcgtagtattacgtgtcgacgtaagacgtacggtccgggggaccctaacggtaaaacgttccaacgccgttagtacgggtacgttcggacgggggacctaaacggggaccccg

SEQ ID NO: 381963 - DNA, 692 bp, Homo sapiens
  misc_feature: GZ8MTXP02HJ6D9.13.76.G10.1.454.CMB.2.raw
  modified_base (188)..(188): a, c, t, g, unknown or other
  modified_base (241)..(241): a, c, t, g, unknown or other
  modified_base (271)..(271): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagcccgccctnagtgtcgtcggggccccagggcaggaggtcaccgatctcctgcacgtggggancagctccaacagttcggggacacgtattanagatggtacacgtggtaccagctagtttccgaggagcgacggtcccagtcctctcactactaataaccgtaaacaaacaacgtaccggcccgacgacggggtccctacggacctacttcctcgtcggtcctccgacgtcgtcggacctaccctcgacgtccctcccgtcggtacctacgtccgaccgtcgggtcccttaccgacggtcgtacggagggtacgttacggaaggtccgtaggttactttaacgtttccgtacgtacccggttaaccgttaccccgttaaagtccgttaaaccggaacggtacccgtaaccggttccgttacgggtaacggtttccggttcccgggttttaccggggttaaaccggggtttccccggggggtaccccgggggggtaaacccccgttacccgggg

SEQ ID NO: 381964 - DNA, 593 bp, Homo sapiens
  misc_feature: GZ8MTXP02IKXSQ.13.76.G10.1.454.CMB.2.raw
  modified_base (365)..(365): a, c, t, g, unknown or other
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctatttaaaaggtgcccagtgtgaggtgcagctggtggagtctggaggaggcttgatccagccgtgggggtccctgagactctcctgtgcagcctctgggttcaccgtcagtcacacctacatgagctggtccgccaggctccgagggaaggggctggagtgcgtcttcttttattatagtagtggtatacatactcgcagctcggngacggggcctattccacatcctaccagacgacaacttaccaaagacacgtcttagtttctacgaaatagaacagcctagacgacgaccgagtcgaccgacggtccgttagttattacgtggttacgtaggtaggaggtacggtcggggacccctaaacggtaaccgtttaacgaaccgtacgttaagtcggggaaccgttcggtacgggggacccgtaaaaccggggg

SEQ ID NO: 381965 - DNA, 543 bp, Homo sapiens
  misc_feature: GZ8MTXP02IY8WI.13.76.G10.1.454.CMB.2.raw
  modified_base (384)..(384): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggtttccttgttgctatttaaagtgcccagtgtgaggtgcagctggtggagtctggaggaggcttgatccagcctgggggtccctgagactctcctgtgcagcctctgggttcaccgtcagtcacacctacatgagctgggtccgccaggctccgagggaaggggctgggagtgcgtctctttattatagtagtcggtagtacatactccgacagctccgtgaggggccgattcgaccntctccagagacagttccaaagaccacgcttgttactcgaaatcggaacagtcctgagacgccgatcgacacggccgtgtattactggtgacggagaggaacgtcggggacccacgtaacggtttaacacgtctaacgtcgaccgtcgtcggggaaccgg

SEQ ID NO: 381966 - DNA, 705 bp, Homo sapiens
  misc_feature: GZ8MTXP02I61GC.13.76.G10.1.454.CMB.2.raw
  modified_base (386)..(386): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtgggaggaggcttgatccaggccggtgggggtccctgagactctcctgtgcacgcctcgtggttcaccgtcagtcacacctacatgagccgtcgggtcccgccgaggcctccggaaggggacggggcgtggagtgcgttcttcttttattatagtgtgtagtacatacctcgacagaccttcgngggacgggcctattaccacctactcctaccgaagacgtaaacctaacttacccgaaaagtaaccacgttctttagtttaccttaacgaaaattcggaaaacctcggtacccgtaggaacgaccgcccgggtaaataccgggaccgtaccggggtccgttagtttaacgtttcggtaggtacggacggtaacggtaaggtaccgggttaccgggggaacccccttaaaacgggtaaacccgtttaaccgtaccgtaacggtttaaacggacgggtaacccggttcgggtaaccgggggaccgtaaaaccggggtaccccg

SEQ ID NO: 381967 - DNA, 693 bp, Homo sapiens
  misc_feature: GZ8MTXP02HIYN0.13.76.G10.1.454.CMB.2.raw
  modified_base (497)..(497): a, c, t, g, unknown or other
  modified_base (509)..(509): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttattttaaaaggtgcccagtgtgaggtgcagcgtggtggagtcgtgggaggaggcttgatccaggccgtcgggggtccctgagactctcctgtgcagcctcgtgggttcaccgtcacgtcacacctacatgagcgtcgggtccgccgaggcctaccggaggggaaggggcgtagggacggtcggtcgtttctttactttttagtttagttaggttaggtaggttagtacctactaccgtccgacacgtaccgtcggtgggacggggcctacttccgacctatcctaccgaagacgaactaacttaccgaaagaacctacgtctttcgtttacctaanaaagtcgaaacncgtaccgtaggaacgacgtaccgaatcggaaccgtaccgggtccgttagttaacttaccgtggtacggacggaggaaggtccggtaccgggggaccccctaaagggttaaacccgttacgtaaccgtcgttaacggtacgggtaaccggtccggtacgggggaacccgtaaaacggggtccccg

SEQ ID NO: 381968 - DNA, 605 bp, Homo sapiens
  misc_feature: GZ8MTXP02JNXXK.13.76.G10.1.454.CMB.2.raw
  modified_base (410)..(410): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggtcaccgtcacgtcacacctacatgagcgtcgggtccgccgaggcctccggaggggaaggggcgtgggaggtcgtcgttctttcttttaatttagtagtagtgtagtactatacctcgcagccgtcgtaggacggggcctatcacctacnctaccagacacaacttcccgaaagaaccacgtcttacgttactaactaaagtacgaactacgccgtaggaacgacgaccgagacgaccgacggtccgtagtactacgtcgtgacgaggaacgtacggaccgggaccctaacggaacgtttaacgacgtaccgttaggcggtaaccgtcgggtaccgggaaccggg

SEQ ID NO: 381969 - DNA, 621 bp, Homo sapiens
  misc_feature: GZ8MTXP02HCT5W.13.76.G10.1.454.CMB.2.raw
  modified_base (365)..(365): a, c, t, g, unknown or other
  modified_base (463)..(463): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctctgggttcaccgtcagtcacacctacatgagcgtcgggtccgccgaggctccggaggggaggggcgtggagtgcgtcttcttttattatagtagtggtatacatactcgnagctcgtggacggggctattcacctagtcctacagagaaccataccaagacacgtcttgtttaccttacaaatcgaactcgcctagacgacgccgtancggacaccggtccgtattacttacgtgtacggtacgaggacgacgggttacccgggggacccctaaaacggtaaccgtttaaacccgacgggtaacccttaaggtaccggggtaccggtacggttaccgggggacccggaaaacggggtaacccccgg

SEQ ID NO: 381970 - DNA, 633 bp, Homo sapiens
  misc_feature: GZ8MTXP02JF8QD.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtcgggtccgccgaggcctaccggaggggaacggggcgtggagtgcgttcttcttttatttatagtagtggtataccatactccgcagactcgtggacggggccagttccaccatcctaccagacgaactaacttacccgaaagaaccctacgtcttcgttttacttacaaaacttgaaaccacgaccccggaagaccgacccgagtacgaacgaccgggaccgttagttaacttcgtgtcgacggaggagacggtacggggaccccaacggtaaccgttaacgtacggtacttaaggacgggtaccgttacgggcggggaacccgaacggggaccctaacccgggg

SEQ ID NO: 381971 - DNA, 589 bp, Homo sapiens
  misc_feature: GZ8MTXP02HVWSR.13.76.G10.1.454.CMB.2.raw
  modified_base (455)..(455): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtcgggtccgccaggctccgaggggaaggggctggagtgcgtcttctttttatttatagttagtggtagtaccatacctccgcagacctccggtggacggggcctattccacctatcctcccaagacgaacaattaccaaagaacacgcttgtttctacaaatgaaacngcctaggacgagcccgaatcgaccacgggtccgtagttattacgtgtcgcgtaaggagacgtcgggggaccccaacggtaaccgttacacgctaagtacggacgtcgtacgggggaccgaaacggggtaccccg

SEQ ID NO: 381972 - DNA, 679 bp, Homo sapiens
  misc_feature: GZ8MTXP02HPFIU.13.76.G10.1.454.CMB.2.raw
  modified_base (408)..(408): a, c, t, g, unknown or other
tcagtcacgtactacacgaccggtgctcgatttagtcactcatacagggggggagaggagcccagcactgggattcccaagtgttttcattcagtgatcaggactgaacacagaggactcaccatggagtttgggctgagctggattttcctcgctgctattttaaaaggtgtccagtgtgaggtgcaagtggtggagtcggtgggggggcttggttaagccgtgggggtccctcgagactctcctgtgcaacctctggtattctattttctctgacgcctggttgagtcgtgggtcccgccgaggccgtacccggggagggcgtgggaggtgggttcggcgtaagttaaaggtagaagacagtggtacgaacaacagactaccagtcgttcccgtagaaagcaagtntacactatactacaagatatagaactaagaaaaaagaatagaataattatacgataacaaattagaaacctaaaccgtaaaggaaaacggacggaaacggaaccgaacgaacgggtacgttaggtttaaacttaacgtacgttaaaccaaacggacgtaagtacgggggaccaaaggacgtacggaaccgtaaaagtccggggaaccgtaaccggaacgtacggtttacccgaacggtaaccgggttacccgggggaccccgggtaaacgg

SEQ ID NO: 381973 - DNA, 727 bp, Homo sapiens
  misc_feature: GZ8MTXP02ITDXO.13.76.G10.1.454.CMB.2.raw
  modified_base (548)..(548): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgctattttaaaaggtgcccagtgtgaggtgcagcgtggtggagtcgtggaggaggcttgatccagccgtgggggtccctgagactctctgtgcagcctcgtggttccaccgtcagtcacacctacatgagcgtcgggtcccgccgaggcctaccggaaggggaacggggcgtagggagtcggtccgtttctttactttttaatttaagttaggttaggttaggttaacgttaaccctacttacccgttcccgacgtaacggtacccgttcccgggtggggaccgggggtacccgtaacttacccgaaccctactcctacccgaaagacgaaacctaaacttacccgaaaagaccctaccgtctttacgtttactaacaaaagttcgaaaacncgtcctaggaacgacgaccgataccggactaccgggtcgttagttacttacgtggtgacggtaaggacggtacggtaccgggggaaccccctaaacggtaaaccgtttaccgaacggtaacgttaaggtacggggtaacccgttcggggaaccgggggaccctaaaacgggggaccccg

SEQ ID NO: 381974 - DNA, 696 bp, Homo sapiens
  misc_feature: GZ8MTXP02IER1S.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtgggaggaggcttgatccagccgtgggggtccctgagactctcctgtgcagcctcgtgggttccaccgtcagtcacacctacatgagcgtcgggtcccgccgaggcctaccggaggggaacggggctagggaggtcgtcgtttctttacgtttttatttacgttagttaggttaggttaagtaccctaacttaccgtccgacacgtaccgttcccggttgggggacggggtcccgtacttaccgaaccctactaccgtacccaaaggtacgaaaccctaaaactttacccccgaaaaggaaaccctacggtctttacgttttacctaacaaagttcgaaacttacgcctaggacgacgaccgagtcgaacgccggtcgttatattacgtggtgacggtaaggaggtacgtacccgggggacctaaccggtaaacgtttcgaaaccggtgtacgtacgggacggttcggtacgggggaccctaaagggggccccc

SEQ ID NO: 381975 - DNA, 585 bp, Homo sapiens
  misc_feature: GZ8MTXP02IOUFL.13.76.G10.1.454.CMB.2.raw
  modified_base (294)..(294): a, c, t, g, unknown or other
  modified_base (362)..(362): a, c, t, g, unknown or other
  modified_base (372)..(372): a, c, t, g, unknown or other
  modified_base (432)..(432): a, c, t, g, unknown or other
  modified_base (455)..(455): a, c, t, g, unknown or other
  modified_base (495)..(495): a, c, t, g, unknown or other
  modified_base (508)..(508): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccggtcagtcacacctacatgagctgggtccncgaggctccgagggaggggctggagtgcgtcttcttttatttatagtgtggtagtacatacctcccgnagacctccgnggtacgggccgtattccgacccatcctaccaagtagaaccaagttccaaagaacacggtnttgtttacttacaaatgaaaccngcctagagagcgatgaaccgacggccgtagttacttacgngtgcgaggtacgngtacggggccctaacggtaaaccgtttacgacgtccgtaagcgggtaacctcggtccggggacaaacggggtacccg

SEQ ID NO: 381976 - DNA, 623 bp, Homo sapiens
  misc_feature: GZ8MTXP02JKR16.13.76.G10.1.454.CMB.2.raw
  modified_base (600)..(600): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggagggaggcttgatccagccgtgggggtccctgagactctcctgtgcacgtcctcgtcgggttcaccgtcacgtcacacctacatgagtcgtcggtccgaccgaggcctaccggaggggaaggggcgtggagtcgcgttctttacttttatttagtagttaggtggtagtacctataccgtccgcacgtaccgtccggtgggacggggtacctacgttacccacctactcctaccgaagacgaaacctaacgttaccaaaagaccacgttcttacgtttactaccgaaaatcgaaacacgacctaggaagacgccgatcgaacgccggtcgtaggttactcgtgtagacgagagacggtccggaccacgtaaaccgttcacgtcgtacgcggtacgnggtaccgggaccgaacggacccg

SEQ ID NO: 381977 - DNA, 616 bp, Homo sapiens
  misc_feature: GZ8MTXP02HJETH.13.76.G10.1.454.CMB.2.raw
  modified_base (237)..(237): a, c, t, g, unknown or other
  modified_base (291)..(291): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtcgtccccaggacagacagccagcatcacctgctcaggaaataatggcagataaatntacttctggtatcagcagatcaggccagtcccctgtgctggtcatctatcaagntgaccaagccggcctagacgggtactcccccgtagacgcgtacttctccgtggccttaccgaaacttccgtacggggtaaccttcgacgtaccctactcgtacgacccagtccgacgggtaccggggacccaggtactaacgcgggaatgggtacgtacgtacgttaaacgttacttacgtcgtacgacggggtcggtacgggaactcggaccgtaaggccctaacggtcccggtaccccgtattacggttcgtaccgtttacggaacgttaccggggaaaccgtacggtaccgtacccgtaacgtacggccgaacgaaccccgg

SEQ ID NO: 381978 - DNA, 685 bp, Homo sapiens
  misc_feature: GZ8MTXP02FVXES.13.76.G10.1.454.CMB.2.raw
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctcagtcgtccgtgtccccaggacagacagccagcatcacctgctctagaaataatggcagataaatatacttctgtatcagcagaagtcaggccagtcccctgtgctgtcatctatcaagatcgccaagccggcctacggacggacctccccgtgacgcgtacttcgtcgtggcctacctaaacttccgtagggaacctcgacgccctactccctgaacccagtacccgacggcccggggaacccctggggtaccttaagtggggtacttacgggacgggtaccgttagtaaccttttacgtttaaccgttcggttaaccggaacggggttccgggggttaacggggaaacccgtaaaggggcctaaacggggaccctacccgttccgggaccccggtaactttcggttaccggtttaccggtttaaccggggaacccggttaacggggaaaccccgtaaacgggttacccccggaaacccgtttaccgaaaaccggtccgtaaaacccccggg

SEQ ID NO: 381979 - DNA, 596 bp, Homo sapiens
  misc_feature: GZ8MTXP02I2TIR.13.76.G10.1.454.CMB.2.raw
  modified_base (369)..(369): a, c, t, g, unknown or other
  modified_base (377)..(377): a, c, t, g, unknown or other
  modified_base (405)..(405): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcaccacctacatgagcgtggggtcccgccgaggcctccgaggggaaggggctggagtgcgttcttcttttatttatagtagtggtataccatactcgnagactcgnggacgggccattccaccatcctccaganacaattaccaaagaacacgtcttcgtttactacaaatcgtaaacagtcctagagacgccgaatcgaccgtacggcgttagtacttagtgtgacgaggacgacggtcgggggaccctaacggtaaaccgttacgtaaccgtgttacggtcggtaaccggtcggtacgggggacccgaacggggtaaccccgg

SEQ ID NO: 381980 - DNA, 593 bp, Homo sapiens
  misc_feature: GZ8MTXP02FLDWM.13.76.G10.1.454.CMB.2.raw
  modified_base (299)..(299): a, c, t, g, unknown or other
  modified_base (328)..(328): a, c, t, g, unknown or other
  modified_base (379)..(379): a, c, t, g, unknown or other
  modified_base (486)..(486): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttattttaaaaggtgcccagtgtgaggtgcagctggtggagtcgtgggaggaggcttgatccagccgtggggggtccctgagactctcctgtgcagcctcgtggttcaccgtcagtcacacctacatgagctcgggtccnccgaggcctccgaggggaaggggctaggngtcgcgtcttctttttagtttatagtagtcggttagtacctatacctccgnagacctccggtggacggggccgtaattccacctatctccagacgacaacttacaaagaacacgtcttatttctacaaatgaaacagtcctagagagccgatcgaacncggtccgtgtatactggcgacgaggagacggtccgggacccaacgtaaaccgtaccgtacgtaacgtacgtacggccgtgggtaccggggaccgacggtaaacccgg

SEQ ID NO: 381981 - DNA, 789 bp, Homo sapiens
  misc_feature: GZ8MTXP02HC82Q.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagcgtggtttcctgtgctatttaaaggtgccagtgtgaggtgcagctggtggagtcgtggaggaggcttgatccaggccgtgggggtccctgagactctcctgtgcagcctcgtgggtcaccgtcagtcacacctacatgagcgtgggtccgccgaggccgtaccggaagggggaacggggtcgtgggtagtggtccggttcctttactttttaagtttagtaggttacgtgggttaatacctacgtaccgtccggacaacgtccgttccgggagggaacgggggtaccctagttacccaacgtacgttcctacccgaaaggtaaacaaaccctaaatttacccccgaaaaagggtaaaccccgtaccgttccgtttttacgttttaacccctaaaacgtaaaaacgttaccggaaaaccgtaccggtaccgtaagggaacggaacccggttacccggtaacggtaacccggtaaccggtacccggggttaccggtttaagttaaaccgtttacggtacgggtacggtacggtaacgggtaacgggtaaccgggtacccggggtaacccggtaaaccggtaaaccggttaaccgtaaccggtaacgttacggtaccggtaccggtaccgggtaccggggtaacccggg

SEQ ID NO: 381982 - DNA, 654 bp, Homo sapiens
  misc_feature: GZ8MTXP02FMVS9.13.76.G10.1.454.CMB.2.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggacagaataaatatacttcctggtatcagcagagtcaggccagtcccctgtgctggtcatctatacaagatcgaccaaggccggaccctgacgggactcccccgtgacgcgtacttcgtctcggcctacccgaaactcgtacggggaacctcgacgtcctaacctcttacgacctaagtccgaacgggacccgggtaacccgacgggtaccttaggtacggagttacggacggtactacggtaacctttagttaacccgttggttacccggaagggtccgggttaggggaacccagggaccctaaaggccctaaccgtcgggcccccgtattaacgttcggtccgtttaacccgggaacgttacgggaaccgtaacgggttaacccctaccgggtttacctaaacgtacccgaaccggtaaacccccgg

SEQ ID NO: 381983 - DNA, 576 bp, Homo sapiens
  misc_feature: GZ8MTXP02G9JQB.13.76.G10.1.454.CMB.2.raw
  modified_base (488)..(488): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtgggtccgccaggctccgaggggaaggggctggagtgcgtcttcttttattatagtagtggtagacatactcgcagactcgtggaggggccattccaccatcctcccaagagacaaattcccaaagaaaccacgtcttcgtttacttacaaatagaaacagcctgaagacgccgatcgaacaccggtccgtagtattacgngtgacggagagacgtcgggggaccccacggtaaaccttactacgcgtagtcgggtacgtcggtacgggggacccaaaaggggaccccg

SEQ ID NO: 381984 - DNA, 535 bp, Homo sapiens
  misc_feature: GZ8MTXP02I5CLN.13.76.G10.1.454.CMB.2.raw
  modified_base (293)..(293): a, c, t, g, unknown or other
  modified_base (360)..(360): a, c, t, g, unknown or other
  modified_base (382)..(382): a, c, t, g, unknown or other
  modified_base (420)..(420): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccnccaggctccgaggggaaggggctggagtgcgtctcttttattatagtagtggtataccatactcgcngactcgtgagggcatcacatcncagagacatcaaagacagctgtttctacaaatgaaacngcctagagacgccgaatggaacgacggccgtagtatactgcgacgagagacgtggggacccaacgtaaccgtacgtacgaacgtagtcggacgtctcgggggacaacgggacccg

SEQ ID NO: 381985 - DNA, 592 bp, Homo sapiens
  misc_feature: GZ8MTXP02FOIU8.13.76.G10.1.454.CMB.2.raw
  modified_base (432)..(432): a, c, t, g, unknown or other
  modified_base (512)..(512): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggtcaccgtcagtcacacctacatgagctcgggtcccgccgaggctccgaggggaggggctggagtgcgtcttcttttatttatagtagtggtagtacatactcgcagacctcgtggacggggcctattccacctatcctaccaagacgaactaaacttacccgaaaagaaaccncgtccttagttttactacaaaatgaaacagcctagagacgcgaatcgacgaccggtcgtagtactacgtgtcgacggagnggtacggtccggggacccaacgtaaccgttactacggcttaggacggtaccggttcgagggggacccctaacgggacccg

SEQ ID NO: 381986 - DNA, 664 bp, Homo sapiens
  misc_feature: GZ8MTXP02HX1IE.13.76.G10.1.454.CMB.2.raw
  modified_base (170)..(170): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctctaggaaataattggcaagaataaatatacttcctggtatcagcaagaagtcaggccagtcccctgtcgctggcatctatcaagatgaccaagccgcccctagacggggtactccccccgtagacgtccgtattcctcgtcgggccttacccaaacgttccgtacgggtaaacctcgaacgacccctaaccttccgtacggaaccctaactacccggaacggacccgggggaaacccccaggggttaacctaacgggttgggaaagttcggagggtaccttgggtaaccttaagtttaccggttgttaccggtaagggcgggttacggggaaaccgtaggaccgaacgggaccaaccgttacggcccccggtacgttacgttcggtaccgttaccgggtaaccgtacgggaaaccgtacggtaccgtaccgtacgtaacgaccgaacgacccg

SEQ ID NO: 381987 - DNA, 550 bp, Homo sapiens
  misc_feature: GZ8MTXP02F8LKS.13.76.G10.1.454.CMB.2.raw
  modified_base (211)..(211): a, c, t, g, unknown or other
  modified_base (231)..(231): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcactgctntagaaataatgcagataatntacttctgtatcagcagaagtcaggccagtcccctgtgctggtcatctatacaagatcgaccaaggccggccctcgacggggactccccccgtagacgcgtattctcgtcggcctccaactcgtacgggaacctcacgcccatctacgaccatcgacggaccggacccgaggactacgtaggactggaggctaggtacttattaccgtgtaccgagggtcggtagggacagacgtacgccaacgttccgcccgtctagtcgttccgttacggacgtacggaaccgtacggtcaaccgtcctaacgccgacgtaaccccg

SEQ ID NO: 381988 - DNA, 600 bp, Homo sapiens
  misc_feature: GZ8MTXP02ILXGP.13.76.G10.1.454.CMB.2.raw
  modified_base (307)..(307): a, c, t, g, unknown or other
  modified_base (336)..(336): a, c, t, g, unknown or other
  modified_base (372)..(372): a, c, t, g, unknown or other
  modified_base (410)..(410): a, c, t, g, unknown or other
  modified_base (430)..(430): a, c, t, g, unknown or other
  modified_base (444)..(444): a, c, t, g, unknown or other
  modified_base (501)..(501): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttaattttaaaaggtgccagtgtgaggtgcagcgtggtggagtcgtgggagggaggcttgatccagccggtgggggtcctgagactctcctgtgcagcctcgtgggttcaccgtcagtcacacctacatgagcgtcggccgcgaggccnccggaggggaaggggctaggagtgcgttnttcttttattatagtgtaggtataccatactccganagactcgtggacggggctattaccacatctaccaaganaacaatccaaaagacacgtnttatttacctaaanaaatacgaaacacgcgtaagacgacgacgagacgaccgacggtacgtagtattacgngtaggacgaagtacggacgtacccgggaacctaacggttaaccttaacgacgtaagtacgtacggtacggtacggtaccgggaaccggtaaacggaccg

SEQ ID NO: 381989 - DNA, 780 bp, Homo sapiens
  misc_feature: GZ8MTXP02HUKQC.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagctctcctgtgcagcctgtgggttcaccgtcacgtcacacctacatgacgtcgtcgggtccgccgacggccgtaccggaggggaacggggcgtagggaggtcggtcgttctttactttttaagtttagttaggttaggtaggttagtacctattaccgtcggaccacgtaccgtccggtacgggacgggggtacccgtaagtttcccaacctactccctacccgtaaggaactaaaccgtaaactttaccccgaaaaagaaaccccgttaacggttcctttacgtttttacccttaaacctaaaaagttccgggaaaacctaaacgggttccccgtagggaacgggaaacccgtcccgggaattacccggaacccgaaccggggtcccggtttaaatcgtttaaccgtcggttagggaccgtaaaggacggtaccgggttccgggggaaacccccctaaacggggtaaaaccgtttaacctaaccggggtcttaaacggtaccgggtaaccgggttcccgggtacggggggaaaacccccgg

SEQ ID NO: 381990 - DNA, 593 bp, Homo sapiens
  misc_feature: GZ8MTXP02ICA38.13.76.G10.1.454.CMB.2.raw
  modified_base (295)..(295): a, c, t, g, unknown or other
tcagtcacgtactacacgaccggtgctcgatttagtcactcatacagggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctcgtggggttcaccgtcagtcacacctacatgagctgggtccnccaggctccgaggggaaggggctggagtgcgttcttctttttaattatagtagtggtagtaccatactcgcagtacctccggtggacgggggccattccaccatctccagagactaattccaaagaacacgtcttgtttactacaaatcgaaacagcctagagagccgatcgaacacggtccgtgttattacgtgtgacggaagacggagtaccgggggaccctaacggtaaaccgtttacgtaacggcgttacgtacggggtacgtcggtacgggggaccgaaacgggggaaccccg

SEQ ID NO: 381991 - DNA, 768 bp, Homo sapiens
  misc_feature: GZ8MTXP02J3A6H.13.76.G10.1.454.CMB.2.raw
  modified_base (296)..(296): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtggggggtccctgagactctcctgtgcagcctcgtgggttcaccgtcagtcacacctacatgagctcgggtccnccgaggcctaccggaggggacggggctggagtggtcgttctttactttttattagtagttagtggtaagtacccactaccgtcccgactagacccgttccgggtgggacgggggcccctagtttccaaccgtatttacctaccccgaaaggaaccgtaaacctaaactttaccccgaaaacggaaaccctaacccggggtctttacgggtttttacctttaaacccgaaaagttacggaaaacccttacggaccccgttaggaaacggtacggaccccggttaagtaccggaaacccggaccgggtcccggttaggtttaaccttaaccgtgggttacgaccgggaaaggttaggaaccgggttaccgggggacccctaaacgggtaaacccgttttaaccgaccggtaaccgttaaggtcggggtacccggtttacggtccgggggaaaccaaaccggggggtaacccccg

SEQ ID NO: 381992 - DNA, 601 bp, Homo sapiens
  misc_feature: GZ8MTXP02GZLAR.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtgggtccgccgaggctccgaggggaggggctggagtgcgttcttcttttatttatagtagtggtagtacatactccgcagactcgtgggaggggcccagttccacctatcctccagacgaacaacttaccaaagaaccacgtcttagtttcttacaaaagtcgaaacacgacctagagacgaccgtagtacgacgacggtccgttagtacttacgtgtcgacgagaggacggtacgggggaccctaacggtaacccgttacgtacgtcgtacgtacgggacgttcgtacgggggacccgaacggggaaccccg

SEQ ID NO: 381993 - DNA, 575 bp, Homo sapiens
  misc_feature: GZ8MTXP02J1OGM.13.76.G10.1.454.CMB.2.raw
  modified_base (493)..(493): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctcgtgggttcaccgtcagtcacacctacatgagcgtcgggtcccgccaggctccgaggggaacggggctgggagtgccgtcttcttttatttatagtagtggtagtacctactactccgcagacctcggtggcggggccactcgacctatcctccagagacaaacttccaaagaaccacgcttagtttactacaaatgaaacagacctgacgagccgatcgacgacggcgtatatacgtgngcgaagagacgtcgggggacccaacggtaaaccttacgtacgcgtagtacgggacttcggacgggacccgaaagggaccccg

SEQ ID NO: 381994 - DNA, 711 bp, Homo sapiens
  misc_feature: GZ8MTXP02JJRDI.13.76.G10.1.454.CMB.2.raw
  modified_base (375)..(375): a, c, t, g, unknown or other
  modified_base (392)..(392): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggaggaggcttgatccagccgtgggggtccctgagactctcctgtgcagcctcgtgggttccaccgtcagtcacacctacatgagcgtcgggtccgccgaggcctccggaggggaacggggctaggagtgtccgtctttcttttaatttatagtagtggtagtaccataccnccgacacgaccgtcggngggacgggggcctacgttaccaccgtactcctaccgaagacgaaacctaaagttacccgaaagaaacccgtaccgtccgtttacgttttaccttaaccaaaagtacgtaaaaccgacgtcccgttaggacggacgtaccggtaataccggaaaccggtccgggtccgttaggttacttaccggtggtacggacggaagggtacggacggggttacccggggaccctaaaccggttaaaccggtttaccacggtaaccgttacggtaccggggtaccgttaccggggacgggggaaccccgtaaacggggaaacccccgg

SEQ ID NO: 381995 - DNA, 598 bp, Homo sapiens
  misc_feature: GZ8MTXP02GPF9T.13.76.G10.1.454.CMB.2.raw
  modified_base (248)..(248): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggcagataaatatactctgtancagcagatcaggccacgtcccctagtcgctggtcatctatcaagatgaccaagccgcctacgaggtactcccccgtagacgcacttcacgtcggcctaccgaactcgtagggaacctcgacgcccactctacgacccatacgacggaccgggacccacggggctagtacgggagttggaacggtccttaggaactttacgttaaccgttgtacccgtaggggacgttcgggggaaccaggaccgacgaccgacgttccggacccgtcgttacgtcgttacgttaccggtacgtaccggggaaccgtaaccgggtcctaacccggtacgttaacgccaaccggaaccccgg

SEQ ID NO: 381996 - DNA, 615 bp, Homo sapiens
  misc_feature: GZ8MTXP02IRXLW.13.76.G10.1.454.CMB.2.raw
  modified_base (375)..(375): a, c, t, g, unknown or other
  modified_base (408)..(408): a, c, t, g, unknown or other
  modified_base (413)..(413): a, c, t, g, unknown or other
  modified_base (430)..(430): a, c, t, g, unknown or other
  modified_base (474)..(474): a, c, t, g, unknown or other
  modified_base (505)..(505): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaagaggtgtccagtgtgaggtgcaactgttggagtcgtgggggaggcttggttcagccgtgggggtccctgagactctcgtgtgcagcctctggtattttagtttagctagttatgccagtgagcgtggggtcccgcgaggcctccggaggggaaggggctggaggttggggtttcggtattggtgtcttgttgatgatagccacatactntgcagcgtccggttaaggcctcttccacatccncaganacaaattccaaagaacncgtactaatactactgacaagtatagaacacggcgtaggggacncccggaaggaccgtaacgggttccctttaancccgtaacgttagggtacgaaaccggtaaaagtacttacgtttacgtaaagttggaaagtttgggaacgtcttacggtaccttaaactttacctttaaacgtttttccgg

SEQ ID NO: 381997 - DNA, 586 bp, Homo sapiens
  misc_feature: GZ8MTXP02JUZDF.13.76.G10.1.454.CMB.2.raw
  modified_base (382)..(382): a, c, t, g, unknown or other
  modified_base (402)..(402): a, c, t, g, unknown or other
  modified_base (408)..(408): a, c, t, g, unknown or other
  modified_base (493)..(493): a, c, t, g, unknown or other
  modified_base (569)..(569): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtcgggtccgccaggcctccgaggggaaggggctgggagtgcgttcttctttttattatagtagtggtagtacatactcgacacgcgtccggnggacggggcctattcgaccncttccnccgaagacgaactaacttacccgaaagaaccacgtctttagtttactacaaagttcgaaactacggcctagacggacgccgtaancggaacgaccggtccgtattacgttacgtggtcgagtacgagacgtcgggacccaagtaacgtaacgacgactcgnggacgtcgcgggaaccg

SEQ ID NO: 381998 - DNA, 610 bp, Homo sapiens
  misc_feature: GZ8MTXP02FMRQT.13.76.G10.1.454.CMB.2.raw
  modified_base (295)..(295): a, c, t, g, unknown or other
  modified_base (362)..(362): a, c, t, g, unknown or other
  modified_base (389)..(389): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagctgggtccnccaggcctccgaggggagggctggagtgcgtcttcttttattatagtagtggtagtaccatactcgnagactcgtggacggggcattccgactntcctccagagaccaattcccaaagacacgcttagtttacctacaaaatgaaacacgtcctaggaacgtacgacccggtaagacgaaccgtacggtcgttagttacttacgtgacgacggaggacggtacgggtaccgggaccctaaacggtaaaccgttacgaccgtaacgttacggtacgggtaccggtcggtaccgggggacccgaacggggtaacccg

SEQ ID NO: 381999 - DNA, 616 bp, Homo sapiens
  misc_feature: GZ8MTXP02JAK8F.13.76.G10.1.454.CMB.2.raw
  modified_base (371)..(371): a, c, t, g, unknown or other
  modified_base (385)..(385): a, c, t, g, unknown or other
  modified_base (473)..(473): a, c, t, g, unknown or other
  modified_base (498)..(498): a, c, t, g, unknown or other
  modified_base (577)..(577): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtctgggaggaggcttgatccagccgtgggggtccctgagctctcctgtgcagcctcgtgggttcaccgtcacgtcacacctacatgagcgtcgggtccgccgaggcctccggaggggaaggggcgtggagtcggcgttcttacttttatttatagtagtggtagtacatacncgacacgacgtcgnggacggggcctatccaccatcctaccgagacaactaacttaccgaaagaacctacgtcttacgtttacttaccgaaaatacggaaacncgtacctaggacgacgacccggtanacgaaccgacggtaccgtagtacgttacgtgtcggacgtaggagtacggtcggggaccctaacgtaaacgttccaacgntaacggtcggacgtcggacggggaccgtaacgggacccg

SEQ ID NO: 382000 - DNA, 556 bp, Homo sapiens
  misc_feature: GZ8MTXP02JZ006.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgagggaggggctggagtgcgtcttcttttatttatagtagtggtagtacatactccgcagctccgtggacggggccgattccgaccatcctccgagacgaacaacttccaaagaaccacggcttgtttactacaaatgaaacagccctagacgagcccgatcgacgaccggccgttgtattacgtgtgcgagtagagtcggggaccctacggaaaccttcgacgctacgtggacgtcggtacgggacccgg

SEQ ID NO: 382001 - DNA, 595 bp, Homo sapiens
  misc_feature: GZ8MTXP02GO2N0.13.76.G10.1.454.CMB.2.raw
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtggttccaccgtcagtcacacctacatgacgcgtcgggtcccgccgaggcctacccggaggggaaggggctgggagtgcgttcttctttttattatagtagtggtagtacatactccgacacgactccggtgacgggggcctagttccaccattcctccgagacgaacaacttaccaaagaacacgtcttcgtttacttacaaatcgaacagcctagacgacgccgatcgacgacggtccgtgtagtactggtcgacgagaagtcggcgggaccccaacgtaaccgttacaaccgtctacggtacggaccggtcggtacgggggaccgtaaaccgggg

SEQ ID NO: 382002 - DNA, 760 bp, Homo sapiens
  misc_feature: GZ8MTXP02H4S85.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagcttgggtttttccttgttgcttaattttaaaaggtgcccagtgtgaggtgcagcgtggtggagtcgtgggaggaggcttgactccgaggccggtcggggggtccccgagactctcctgtcgcacgtccttcgtgggttccaccgtcacgtccacacctacatgagcgtcgggtcccgcgacggctaccggaagggggacgggcgtgggagtcgtcgttctttactttttatttagtaggtagttaggtagtacactacgtccgcacgtacgtcggtgggcggggtcctattaccgactactccgtacagaacgtaacaaacttacccgaaagtaaccgaccgttcgttttaaccgttttaccttaaacaaaagttcgaaaacctacggtcccttagggaacgtacggacccggtaagttacggaaccgtaaccgggtaccggtttaagtacgtttaaccggtgggtaggaaccggaacggtaaaggggtccggttacccgggggaaacccccttaaacggggtaaaacccgtttaaccgacggtaaccgttaagggtacggggttaaccggtacggggtaaccgggggaacccgaaaacgggggtacccccgtaccgggg

SEQ ID NO: 382003 - DNA, 721 bp, Homo sapiens
  misc_feature: GZ8MTXP02IDE8U.13.76.G10.1.454.CMB.2.raw
  modified_base (236)..(236): a, c, t, g, unknown or other
  modified_base (290)..(290): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgccctcagtgtcgtggggccccagggcagaggtcaccatctcctgcactggggancagctccaacattggggcacattatgatgtacactggtaccagcagttccaggngcaggtcccagactcctacactacaataacgtaaacaacaacgtccggacccgccgtaacggggtcccctaggaacccggtatttcccgtccgttcggggccttacccgacgggttcccgttcggggaccctacccgtcccgtaacggtcccccttccccgtcgggttacccaaccgtttcccgaaccgtgggggtccccttacccggaacgggtcccgttagggaaccggggaagtttacgggaaacggggtcgtttacgggttaactttttaacgttttccgtacggtaccccgttacggttaccccgtttaagttacggaaaccgttacggacccgtaacggtccccttagggtaacgtttcgggtccgtttttaccgggggtaacggtttcccgggggacccggggggtaaccccttaacccggggg

SEQ ID NO: 382004 - DNA, 598 bp, Homo sapiens
  misc_feature: GZ8MTXP02IF0Q6.13.76.G10.1.454.CMB.2.raw
  modified_base (453)..(453): a, c, t, g, unknown or other
  modified_base (550)..(550): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtctgggaggaggcttgatccagccgtgggggtccctgagactctcctgtgcagcctcgtgggttcaccgtcagtcacacctacatgagccgtgggtcccgccaggctccgaggggagggctggagtgcgtcttcgttttattatagtagtgtataccatactccgcagaccgtccgtgggacgggccgattccacctatctccaaagagaacaaataccaaagaaccacgtctttgtttacttacaaaatgaaacnggacctggacgagacccgatgacgaccggtcgtagttattactgtgacgaagaggacggtaccgggggacccaacggtaaaccggtttacaaccggngttacggtacggaccgttcgggtacggggaacccgaacggggaccccg

SEQ ID NO: 382005 - DNA, 628 bp, Homo sapiens
  misc_feature: GZ8MTXP02GLSDG.13.76.G10.1.454.CMB.2.raw
  modified_base (402)..(402): a, c, t, g, unknown or other
  modified_base (446)..(446): a, c, t, g, unknown or other
  modified_base (456)..(456): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttccaccgtcagtccacacctacatgagcgtcgggtcccgccgaggcctccggaggggaaggggctggagtgcgttcttctttttatttatagtagtggtataccatacctcgcagacctcgtggacggggcctattcaccntcctccagacgaacaataccaaagaaccacgcttgtttacttanaaatgaaacngacctagagacgacccgatcgacgacgggtccgtagttaacttacgtggtcgacggaaggtaggacggtaccgggggacccctaaaccggtaaaaccgtttaccgtaacggtaaccgttaggtacgggtacccggtacgggtacgggggaacccggaaacggggaacccccg

SEQ ID NO: 382006 - DNA, 659 bp, Homo sapiens
  misc_feature: GZ8MTXP02IMMGA.13.76.G10.1.454.CMB.2.raw
  modified_base (534)..(534): a, c, t, g, unknown or other
  modified_base (577)..(577): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtcgggtcccgccgagggcctccggaaggggaacggggcgtagggaggtcggtcgtttctttctttttaagtttagttaaggttaggttagggttaagtaccctaacttaccgtcccgacaacggtaccgttccgggtggacgggggcccgtactttacccaaccgtactcctaccgaaagacgtaaacctaaacgttacccaaaagaaccctacgtccttagttttacctaccaaaagtcgaaacncgacctagagacgccgaatcgacgacggccgtagtacttacgngtcgacgtagacgacgtccggggaccacgtaaccgttacacgtcgtagtcggtacgtacggcggggtaccgaacgggacccg

SEQ ID NO: 382007 - DNA, 546 bp, Homo sapiens
  misc_feature: GZ8MTXP02F6GYX.13.76.G10.1.454.CMB.2.raw
  modified_base (395)..(395): a, c, t, g, unknown or other
  modified_base (470)..(470): a, c, t, g, unknown or other
  modified_base (477)..(477): a, c, t, g, unknown or other
  modified_base (534)..(534): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcacgcctctgggttcaccgtcagtcacacctacatgagctgggtccgccaggctccgaggggaaggggctgggagtgcgtcttcttttattatagtagtggtagtacatactcgcagctcgtgaggggccattcacatctcaganacaattccaaagacacgcttgtttactacaaaatcgaaactacggcctagagagcccgatcgacgacggtccgtntattacngtgagagagcgtcggggaccccaggtaaacgttaacgacgactaagtcggacgtcgngggggaaacccg

SEQ ID NO: 382008 - DNA, 632 bp, Homo sapiens
  misc_feature: GZ8MTXP02I2U9W.13.76.G10.1.454.CMB.2.raw
  modified_base (480)..(480): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtctggaggaggcttgatccagccgtgggggtccctgagactctctgtgcagcctcgtgggttcaccgtcagtcacacctacatgagcgtcgggtccgccgaggctccggaggggacggggcgtaggagtgcgttcttcttttattatagtagtaggtagtaccatacctcgacacgaccgtcggtgggacggggcctacttccgacctatcctaccgaagaacgaactaacttaccgaaagtaaccacgtctttacgttttacctaacaaaattcgaaacncgtccgtagaagacgaccgatacgaccgacggtccgtagttacttcgtgtcgacggagacgtacggtccggggaaccctaacgtaaaccgttaccacggtaactaggtacgggtacggtacggtaccgggggaaccgaaacggggtaccccg

SEQ ID NO: 382009 - DNA, 787 bp, Homo sapiens
  misc_feature: GZ8MTXP02HHPGF.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggtttccttgttgctattttaaaaggtgcccagtgtgaggtgcagctggtggagtcgtggaggaggtcttgactccgaggcccggtcggggggtccctggacgtacctcttccgtggtcgcgacgtcccgttcgttcgggttccaacccgtcacgtaccaccaccttaacagtggacggtccgttcggggcccgccgacggcctaccgggaaggggaacggggcgtgggagtcgtcgttctttactttttaagttagtaaggttaggtggttaactaccctactaccgtccgacgtacgtaccgtccgggtggggaccgggggtcctacgttccaacctactctaccgaagtaacgaactaactacgaaagaacctacgtcttacgttttacaaaccaaagtacgaaaaccgcgaccgtaaggagtaaccggtacgacgtaccgggaacctaccggggtccgtttaggttaaacttaccgtggtaccgggtaaggacggttaaacgggaccgggttaacccgggggaacccccttaaaacgggttaaacccgtttaaccgtaacggtaaccgttaaaacggtcggggtaaacccggtttccggggtacccgggggaaaacccgttaaccgggggtaaacccccg

SEQ ID NO: 382010 - DNA, 554 bp, Homo sapiens
  misc_feature: GZ8MTXP02HOVR0.13.76.G10.1.454.CMB.2.raw
  modified_base (475)..(475): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagtcagcatcacctgctctggaaataaatggcagataaatatacttctggtatcagcagaagtcaggccagtcccctgtgctggtcatctatcaagatgaccaagccggccctcaggggactccccccgtgaagccgtatttctccgttgggccctacccgaaacttccgtcggggaaacctcgaacgtccccaactcctacggacccactcgacggccgggaacccagggacctagtcggatggaggccttgtactagttactgtcgagggcgtgggacngacgagcacgtcgcccgcttatcgtcgttcggaaacgtcggaaccgtaaggacctaccgtactacgtacgacgaacccg

SEQ ID NO: 382011 - DNA, 602 bp, Homo sapiens
  misc_feature: GZ8MTXP02JA2C4.13.76.G10.1.454.CMB.2.raw
  modified_base (282)..(282): a, c, t, g, unknown or other
  modified_base (298)..(298): a, c, t, g, unknown or other
  modified_base (448)..(448): a, c, t, g, unknown or other
tcagtcacgtactacacgaccggtgctcgatttagtcactcatacagggggggaggaggagcccagcactgggattccgaggtgtttccattcggtgatcagcactgaacacagaggactcaccatggagttttggctgagctggggttttccttgttgctattttaaaaggtgcccagtgtgaggtgcagctggtggagtctggaggaggcttgatccagcctggggggtccctgagactctcctgtgcagcctctggggttcaccgtcagtcacacctanactgagctgggtcccncaggcctcgagggaggggctggagtgccgtcttctttattatagtagtcggtatccatacctcgcagcctacgtggaggggcccgtattcacccatcctaccagacgactaaattcccgaaagaactacggctttaggtttacccttaanaaatcgaaacgacgtccaggacgacggacaagtcgacgacggtcgttagtacgttcgagtacgacggaagacggtacgggtcgggaaccctaacgtaaaccgttacgaccgtgttacgacgggtaccgtacggaccggggaccgtaacgggtcc

SEQ ID NO: 382012 - DNA, 679 bp, Homo sapiens
  misc_feature: GZ8MTXP02F7UZM.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctgggtggagtctggaggaggcttgatccagccgtgggggtccctgagactctcctgtgcagcctcgtggttcaccgtcagtcacacctacatgagcgtcgggtccgccgaggcctaccggaaggggaacggggcgtgggacggtcggtccgtttctttactttttaagtttaagtaaggttaggttacggttaacgttaacctagttacccgttccgaccgtaacggtacccgttcccgggtagggtacggggtaccggtacccgttactttacccgaaccttacttacccgtaacccgaagaaaccgtaaaccttaaacgtaaaccgaaacgtaactaccgttcttacgtttactaaacaaagtacgaactcgacgtaggaagtaccgactagacgaaccggtcggtcttagtactagtcggagacgagacgcggaccggacctaaacgtaaccgtacgacgtcgagtcggacgtcggaaccggg

SEQ ID NO: 382013 - DNA, 655 bp, Homo sapiens
  misc_feature: GZ8MTXP02IBNA5.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctgtggggttcaccgtcagtcacacctacatgagcgtcgggtccgccgaggctaccgaggggaaggggctggagtcggcgtcttcttttattatagtagtagtagtacatactcgacagacgtcgtggacggggcctattccgaaccatcctacccgaagtaacaaacctaaacttcccaaaaggaacctaccggactttacggttttccttaaaccaaaattacggaaaactcggtaccctaagggaacgaacggaccccggtaaataccggaaacccggtaccggacccggttagtaacgtttaactgggtacgaccgaggtacgacggtaccgggggaccctaacggtaaccgttactacggctaagtcgggactcggacgggacccgaacggggacccc

SEQ ID NO: 382014 - DNA, 703 bp, Homo sapiens
  misc_feature: GZ8MTXP02HTNS9.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtgggaggaggcttgatccagccgtgggggtcctgagactctcctgtgcagcctcgtgggttcaccgtcagtcacacctacatgagcgtcgggtccgccgaggcctaccggaaggggaacggggcgtgggagtcggtcgtttctttctttttatttagtagttaggtggttaagtaccctattaccgtccgacaagtaccgttccgggtgggacgggggtcctacgttacccaaccctacgtacctacccgaaagaacgaaacctaaacgtttaccccgaaaaggaaaccctaccggtctttacgttttaccttaaacgaaaattacggaaaccacggtaccttaggaagacgacccggatacggaaccgaccgggtccgttagttaacttacgttggacgacggaagaggaacgtcgggggaccccaaacggtaaccgtttaacaccggtaacgttacgacggggtaccgtcggtaccgggggaaccgaaacggggaccccg

SEQ ID NO: 382015 - DNA, 568 bp, Homo sapiens
  misc_feature: GZ8MTXP02FP204.13.76.G10.1.454.CMB.2.raw
  modified_base (400)..(400): a, c, t, g, unknown or other
  modified_base (431)..(431): a, c, t, g, unknown or other
  modified_base (437)..(437): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagctgggtcccgccaggcctccgaggggaaggggctggagtgcgtctcttttatttatagtagtggtagtaccatactcgcagactcgtggacgggccgattccaccatctcaganacaataccaagacacgcttgttctacaaatnaaacancctgagacgaccgatcgacacggccgtgtattacgtgtgacgagagcggtacggggacccaacgtaaaccgttactacgaacgttaacgtcgggtaccgtcggtacgggggaccgaaacggggaaccccgg

SEQ ID NO: 382016 - DNA, 696 bp, Homo sapiens
  misc_feature: GZ8MTXP02IKM1L.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtcgtgggaggaggcttgatccgagccgtcgggggtccctgagactctctgtgcacgcctcgtcggttcaccgtcagtcacacctacatgacgcgtcgggtccgccgacggcctaccggaggggaacggggcgtggagtgtcgtttctttactttttattagtacgttagtaggtacgtacctactaccgtccgacgacgtaccgttcggtggggacggggacctacgttacccgacctatacctacccgaagaacgaacctaaacttaaccaaagtaaacctacgtactttacgtttactaaacaaaagttcgaaaccacgtccgtaaggaacgtacgaccgtaagtcggaaccgtacgggtaccgttagttaacttaccgtggtacgacggtaggaacggtacggtaccgggggaccctaacgggttaaaaccgtttcgaacggtaacgttacgggtacggtaccggtacggtacgggggaacccaaaggggaccccg

SEQ ID NO: 382017 - DNA, 629 bp, Homo sapiens
  misc_feature: GZ8MTXP02G1CDA.13.76.G10.1.454.CMB.2.raw
  modified_base (429)..(429): a, c, t, g, unknown or other
  modified_base (510)..(510): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtgggtcccgccgaggcctccggaggggaaggggctggagtcggcgtcttctttttatttagtagttagtggtagtaccatactccgcagtacctccggtggacggggctatccaccactcctacagagacaactaccgaanaacacgtcttgtttcctaacaaatcgaaactcgacctggagacggccgaatcgaaccgacggtaccgttagtactttacgnggttacgcggaggaggtacggtaccggggacccctaacggtaaaccgtttccgaacgtaacgttacgtacgggggtacccgttaggccgggggtaacccgaaacgggggtaacccccgg

SEQ ID NO: 382018 - DNA, 765 bp, Homo sapiens
  misc_feature: GZ8MTXP02HEPX2.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctattttaaaaggtgcccagtgtgaggtgcagcgtggtggagtcgtgggaggaggcttgatccagccgtgggggtccctgagactctcctgtcgcagcctcgtcgggttcaccgtcagtccacacctacatgacgcgtcgggtccgccgaggcctccggaagggggaacggggcgtacgggaggtcggtccgttcgtttactttttaagtttagtaggttaggtagggttacgtaaccctattaccgtacccgacgtacggtaacccgttccgggtcggggacgggggtaccgtacttacccgaacctactccctacccgaaagaacgtaaacctaaactttaacccgaaaaggtaacccaccgttcctttaggtttttaccttaacaaaacgttcgaaaaacgtccgtaccgttaagggacgtaaccggaccgggttaaacgacggaacccgtaccgggtcccgttaaggtttacgttacgtagggtacgaccggtaaggacggtacgggttaccgggggaccccaaacgggttaaaccgttaaccgtacgaaccgttaaggcggggttaaccgtcgggtacgggggacccgaaaacggggtcccg

SEQ ID NO: 382019 - DNA, 645 bp, Homo sapiens
  misc_feature: GZ8MTXP02GWCNN.13.76.G10.1.454.CMB.2.raw
  modified_base (467)..(467): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctcgggttcaccgtcagtcacacctacatgagctcggggtcccgccgaggcctccgaggggaaggggcgtggagtgcgtcttcttttattagtagtagtggtagtaccatacctcgcagactccgtggacgggcgtattccaccgtatcctacccgagacgtaactaacttaccaaagaaccacgtcttgtttaccttacaaattcggaaacncgcctaggagacgaccggtatacggaaccgacgggtccgttagtaacgtttcgtaggtacgacggaaggacggtacggtaccgggggacccctaaacggggtaaccctttaaccgaccggtaacttaacggtacgggtaccggtcggtaccgggggacccgaaaggggtaacccccgg

SEQ ID NO: 382020 - DNA, 593 bp, Homo sapiens
  misc_feature: GZ8MTXP02F321M.13.76.G10.1.454.CMB.2.raw
  modified_base (397)..(397): a, c, t, g, unknown or other
  modified_base (508)..(508): a, c, t, g, unknown or other
  modified_base (548)..(548): a, c, t, g, unknown or other
tcagtcacgtactacacgaccggtgctcgatttagtcactcatacagggggcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtggttccaccgtcagtccacacctacatgagcgtcgggtcccgccgaggcctccgaaggggaacggggctgggagtgcgttacttcttttatttagtagttagttggtaagtacatacctccccgacacgactccggtggacggggtcctnttccaccctatccctaccgaagaacgaactaaacgttcccaaaagaccacgtcttgtttactacaaatcgaaactgcctagacgagccgatcgacacgcctagtacttcgngtgcgagagagtcgggacccagtaaccgttacacgctagnggaacgttcggacggggacccaagggtacccacggtactacccgg

SEQ ID NO: 382021 - DNA, 564 bp, Homo sapiens
  misc_feature: GZ8MTXP02FVIGR.13.76.G10.1.454.CMB.2.raw
  modified_base (296)..(296): a, c, t, g, unknown or other
  modified_base (361)..(361): a, c, t, g, unknown or other
  modified_base (383)..(383): a, c, t, g, unknown or other
  modified_base (386)..(386): a, c, t, g, unknown or other
  modified_base (391)..(391): a, c, t, g, unknown or other
  modified_base (417)..(417): a, c, t, g, unknown or other
  modified_base (427)..(427): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctctgggtcaccgtcagtcacacctacatgagcgtgggtcccncaggctccgaggggaggggctggagtgcgtcttcttttatttatagtagtggtatacatactcgnagactcgtgacgggcattcacntcncaganacataccagacacgcttgttactaanaaatcaaacngctagagacgacgagtcgacgcggtcttagtacttacgtgtacgacggtagacggtacggtaccggaaccctaaacgtaaccggttacgacgaacgttacggtcggaccggtcggtacggggaccaacggggtaccc

SEQ ID NO: 382022 - DNA, 682 bp, Homo sapiens
  misc_feature: GZ8MTXP02JFE47.13.76.G10.1.454.CMB.2.raw
  modified_base (281)..(281): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactcctcctgtgcagcctcgtgggttcaccgtcagtcacacctanactgacgcgtcgggtccgccgacggctccggaaggggaaggggcgtaggacgtgcgttcttcttttatttatagttagtggtatacgtataccgtcgacagaccgtccgtgggacggggcctacttccgaacctacgtacctacccaaagtaacgaactaaacgttacccaaaaggaaaccctacgtccttagttttacctaacaaaacttacgaaacacgtcccgtaagacgacgacccggatacgaccgacgggtccgtagttacttacgtcgtaggcgtaagggacgacggtaccgggggaccccaaacgggttaaacccgtttacgtaaaccggaaccgttaggtaccgggtaacggtcgggtacccgggggaaacccgaacgggggtaacccccgg

SEQ ID NO: 382023 - DNA, 557 bp, Homo sapiens
  misc_feature: GZ8MTXP02FLV90.13.76.G10.1.454.CMB.2.raw
  modified_base (238)..(238): a, c, t, g, unknown or other
  modified_base (263)..(263): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagcccgccctcagtgtctcggggccccagggcagagggtcaccatctcctgcacgtgggancagctcaacagttcgggcacattangatgtacactggtaccagctagttaccgaggagcgacggtcccagacctcctcatacaatacgtaacaacactccgcccgcgacgggtcctcgacgtattcgtcgtcgctccgagtctcgcacctcgacgcccgtcctgtccacttcgacgtcgggtacctccgacggtcgtagaggtatcgagtcgtagtacttacttcgacgtcgtacgttacgtacgtacgaaacgtcgacgtacgtcctaggtcgttcggtccgttacgggtacggttccggggaccggggaccgtacgg

SEQ ID NO: 382024 - DNA, 616 bp, Homo sapiens
  misc_feature: GZ8MTXP02JWU2G.13.76.G10.1.454.CMB.2.raw
  modified_base (394)..(394): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagctgggtccgccgaggcctcgagggaaggggctggagtgcgtctcttttattatagtacgtggtagtaccatactccgcacgacctcgtggacggggcgtacttcgaccntacctcccgaagagaacctaacgttaccaaagtaaccacgtccttagtttctacaaactgaaaactcgacctagacgacgccgaagtcgaaccggacggtccgttacgtaatttacgtagtcggacgagggtagacggtccgggggaccctaaaccggtacgttaccgacgtaacctaggtaccggtacggtcgtaccgggggaccgaacgggtaaccccgg

SEQ ID NO: 382025 - DNA, 604 bp, Homo sapiens
  misc_feature: GZ8MTXP02F1BZD.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtcgggtcccgccgaggcctccggaaggggaagggggctgggagtcggcgttctcttttatttagtagtagtggtagtacatactcgcacgactccgtggacggggccgtattccaccatcctaccagacgaacctaacttaccaaagaaccacgtcttgtttactacaaaatcgaaacagcctaggacgacgcccggaatcggaaccaccgggtccgttaggttattacgtgtacgagagagacgtcggggacccaacgtaacgttactacgaacgtacgcggtacgtcggtacggggaccgtaacggggaacccg

SEQ ID NO: 382026 - DNA, 582 bp, Homo sapiens
  misc_feature: GZ8MTXP02GF57X.13.76.G10.1.454.CMB.2.raw
  modified_base (195)..(195): a, c, t, g, unknown or other
  modified_base (234)..(234): a, c, t, g, unknown or other
  modified_base (257)..(257): a, c, t, g, unknown or other
  modified_base (273)..(274): a, c, t, g, unknown or other
  modified_base (284)..(284): a, c, t, g, unknown or other
  modified_base (297)..(297): a, c, t, g, unknown or other
  modified_base (299)..(299): a, c, t, g, unknown or other
  modified_base (301)..(301): a, c, t, g, unknown or other
  modified_base (312)..(312): a, c, t, g, unknown or other
  modified_base (340)..(340): a, c, t, g, unknown or other
  modified_base (342)..(342): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcgtggtttctgtagctattttaaaagtgccagtgtgaggtgcagctggtggagtntgggaggaggcttgatccagccgtggggggtccctgganctctcctgtgcagctctggttcnccgtcagcacacacanngcgcgcgcgngcgcgagggaggngngngtgtcttcttntttattatagtagtagtagtactatacncncgacgacgtcgtcggacgggcgtactacacactctacagacgaacaactaacaaacgaacacgtacttacgttacttaactaatacgaacgacgacgtacgacgacgacgacgacgacgacggtcgtacgtacgttacgtagtacggacggaggaggtacggtaccgggtaccgtaacgtaaaccgtaacgtacgtaacgtacgtacggtacggtacggtacggacggaaccggtaaccg

SEQ ID NO: 382027 - DNA, 790 bp, Homo sapiens
  misc_feature: GZ8MTXP02GL7JW.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtcgtggaggaggcttgatccagccgtgggggtccctgagactctcctgtgcagcctcgtggttcaccgtcacgtcacacctacatgagtcgtcgggtcccgccgaggccgtaccggaaggggaacggggtcgtaggggacgttcggtccgtttctttacgtttttaagtttagtaaggttaggttacggttaagtaacctacgttaccgtccgacgtaacgtaccgttccggtagggacgggggtaccctagttacccaacctactcctaccgaagaacgaaacctaaacttacccgaaaacgtaacccgtaacgtccgtttacgttttacctaactaaaagttcgaaaaccgtacgtaccgtagaacggacgacccgagttaccggaaaccggtaccgggttacccgttagtttaaacgtttaccggttaggttacgggtaaccggaacgggtagggtaaccggggttacccgggggaaacccccgttaaacggttaaaacccggtttaaccgtaaaccccggttagttacccggggttacgggtaaacccgggttccggggttaaccgggggtaaaacccccgggg

SEQ ID NO: 382028 - DNA, 768 bp, Homo sapiens
  misc_feature: GZ8MTXP02F8B62.13.76.G10.1.454.CMB.2.raw
  modified_base (259)..(259): a, c, t, g, unknown or other
  modified_base (283)..(283): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttgggactgagctggattttccttttggcttattttaaaaggtgtccagtgtgaagtgcagctggtggagtcgtgggggaggcttggtacagcctggcaggtccctgagactctcctgtgcagcctntggacttcacctttgatgtattangccatcgcacgtcgggtccgacaagccgtaccggaaggggaacgggccgtgggaggtcggggttcctacggtaggttaagtttaggttagggtaaagttagggttagggtaagtacgtaagttagggtccttagcgggtaccgggtacttcgttagggtagggaaacggggtacccgtaactttacccgaacccgtaacttcccgtaccgaaacggaaccggaaaccgaaacccgtaacccaaaacgtaacccttacccgttaggttaaccttaccgttaggaaacctaaaacgttacggaaaacctacggtacccgtaggaacggacggacgtacgggaacggtaaccgtaccgggtacctttacggttaacgtttacgttaggttaacgaaacgtaaaaacggtaaccctttaaaccccgttaaaaccccggtttaacggtttaacggtttttacgggaacggtttaacggtttaaacccggg

SEQ ID NO: 382029 - DNA, 551 bp, Homo sapiens
  misc_feature: GZ8MTXP02F4SZ7.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggggttcaccgtcagtcacacctacatgagctggggtccgccaggctccgaggggaaggggctggagtgcgtctctttttattatagtagtggtagtaccatacctcgcagactccgtgacgggggccattcacctatctccaagagacaattccaaagacacgctgtttacttcaaatgaaacagcctagacgagaccgatcgacgacgccgtagtacttactgtgcgagagagtcggggacccacgaacgttacacgctagtacggacgtcgtacggggaccgaagggaacccg

SEQ ID NO: 382030 - DNA, 653 bp, Homo sapiens
  misc_feature: GZ8MTXP02FNYK3.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggtcaccgtcagtcacacctacatgagctgggtcccgccgaggctccgaggggaaggggctggagtgcgtcttctttatttatagtagtggtagtactatactcgcagacctcgtggacggggctatccaccatcctaccagacgacaacttaccaaagaaccacgcttagtttacttaacgaaaatcgaaacacgaccctaggaacgacgacccgtaataccggaaccgtaccgggtcccgttagttaacgtttaaccgtggttacggaccggaggtaaggtacggtcccgggggtaaacccccaccggttaaaaccgttccgtaaaccggtccgtaaaggttcggggacccggttacgggtaccgggggacccgtaacgggggaaacccccgg

SEQ ID NO: 382031 - DNA, 625 bp, Homo sapiens
  misc_feature: GZ8MTXP02GFHGB.13.76.G10.1.454.CMB.2.raw
  modified_base (385)..(385): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtcgggtccgccgaggcctccggaggggaacggggcgtgggagtgcgttcttcttttatttatagtagtggtataccatacgtccgcacgacctcggnggacggggccgtacttccacctatcctaccgaagacgaacctaatacccgaaagaacctacgtctttagttttacctaacaaatcgaaacacgtcctagaacgacgaccgataccggaccgtacgggtccgttagttacgttacgtggtagacggaggacgacgggtccgggaccccaacggtaaaccgtttacacgcgttagcgggtacgttccggacggggacccgtaagggaccccg

SEQ ID NO: 382032 - DNA, 679 bp, Homo sapiens
  misc_feature: GZ8MTXP02HQFIR.13.76.G10.1.454.CMB.2.raw
  modified_base (310)..(310): a, c, t, g, unknown or other
  modified_base (570)..(570): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggagggaggtcttgactccgacggtccgggttcggggggtccctggacgactcctccgtgtgcgacgtcctcggttcgggttccaccggtcacgtcaccaccctaanagtgcgcggtcggccgcgacggccgacgggaggggacgggcgtggtgtcgtcgtttctttattttagttagttaggttaggttaggtaacgtacctactaccgtacgacgtacgtaccgtcgggtcggggacgggtactactaccactactacacgagactaactaactacgaaacgactcgttctttacgtttaacaataacgacgaactcgtcgaggacgacgacgacgtcgacgtcggtacgttagttacgttacgngtacgacggagggacggtaccggtaccgggaaccctaacggttaaccgttacgaccgtaagttacggtaccgggtacggtacggggaccgggaaccggtaaccggaccg

SEQ ID NO: 382033 - DNA, 596 bp, Homo sapiens
  misc_feature: GZ8MTXP02I8ZG2.13.76.G10.1.454.CMB.2.raw
  modified_base (388)..(388): a, c, t, g, unknown or other
  modified_base (448)..(448): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtcggggttcaccgtcagtcacacctacatgagcgtggggtcccgccgaggcctccgaggggaggggctggagtgcgttcttctttttatttagtagttagtggtagtaccataccgtccgcagaccttccgnggacggggcctattccacctatctccagagacaactaccaagaacacgtcttgtttctanaaatgaaacagcctagacgacgaccgagtcgaacgacggccgtagtacttacgtgtgacggagaggacggtcgggggaccccacgtaaaccgttactaacggtctacgtcgggtacggtcggtacggggacccgaaacggggtacccg

SEQ ID NO: 382034 - DNA, 796 bp, Homo sapiens
  misc_feature: GZ8MTXP02H3OT9.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagcgtggtggagtcgtggaggaggcttgactccagccggtcgggggtcctgacgactctcctgtgcacgtcctcgtcgggttccaccgtcacgtcaccacctacatgacgcgtcgggtccgccgacggcctaccggacgggacggaacggggtcgtagggtaggtcggtcgtttcttttactttttagtttaaagttaggttaaggttaggttaacgtacgtaccttaccgtcccggacgtaacggtacccgttccggggtacggggacgggggtaccccgtaacgttacccaacccgtacttacccgtaacccgaaaggaacgtaaacctaaaccttaacccgaaaacgtaaacctaccggttccgtttacgtttttaaccctaaacgtaaaacgttacgaaaaccctcggtaaccctttagggaaacggttacggacccgtaagtacggaaccggtaaccgggttccgttagtttaaacgtttcgtacggttcggaacgggtaggaacgggtaccgggtaccggggtaacccctaacggttaaccgttaaccgtaaccgtacgtacggtacggtaccggtaccggtacggggaaacccgaacgggg

SEQ ID NO: 382035 - DNA, 689 bp, Homo sapiens
  misc_feature: GZ8MTXP02GH6KH.13.76.G10.1.454.CMB.2.raw
  modified_base (237)..(237): a, c, t, g, unknown or other
  modified_base (290)..(290): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataatggacagaataaatntacttctggtatcagcagaagtcgaggccacgtcccctgtgctggtcatctanacaagatacccgaagccgacccctgagggtactcccgtgacgtcgtattcctagtcggaccctaccgtaaaccttcggtaacggggtaaacccctccgaacggaccccctacttacccgtacggtaaaccccaagttacccgaaccggacccggggtaaaccccgaaggggtacccttaacggtcggaaacgttgggaaaccgggtcttaacggttaacctttaacgtttaacgtcgggtttaacccgaaggggtccggggttaaggggaccaggacgacggtaccaccgttcgaccccggtagttacgttacgtaccgttacgggtaacccgtacgggaaccgtaacggttcccgaacccggttaccgtaaacggtccaaccgggacccaaaccccgg

SEQ ID NO: 382036 - DNA, 649 bp, Homo sapiens
  misc_feature: GZ8MTXP02G37U1.13.76.G10.1.454.CMB.2.raw
  modified_base (377)..(377): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagctgggtcccgccgaggcctccggaaggggaacggggctgggagtcgtcgttcttcttttaatttatagtagtggtagtacatactcganagcgtccgtggacggggcctagttcacctatcctaccaaggaacactaaattcccgaaaagaccacgtcttgtttacttacaaaattcgaaactacgtcctagaagacgacccgattacggaacgtaccgggtccgttagttaacgttaaccgtgggtacgacggtaacggaaggtacgggttccggggaaccccctaacggttaaaacccgttaaccgtaacggtaccgttaaggtacgggtacccggttacggtacgggggaaaccccgg

SEQ ID NO: 382037 - DNA, 705 bp, Homo sapiens
  misc_feature: GZ8MTXP02FN46L.13.76.G10.1.454.CMB.2.raw
  modified_base (560)..(560): a, c, t, g, unknown or other
  modified_base (582)..(582): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtcgccagtgtgaggtgcagcgtggtggagtcgtgggaggaggtcttgactccagtccggtcggggggtcctgagtactctcctgtgcacgtcctcgtggtccaccgtcagtccaccacctacagtgagtcgtcgggtcccgccgaggcctccgggaaggggaacggggcgtgggagtcggtccgtttcctttacttttttaagtttaagtaaggttaggttagggttaacgtaaccctaacttaaccgtcccgacaacggtacccgttccgggtggggaccgggggcctaacgttacccaaccctaattccctaccgaaagacgtaaacctaaacttaacccgaaaagaaaccctcgtctttagtttacctaacaaaaagttcgaaaacncgcctaggacgacgaccgtaanacgaccgccggtacgttagttatacgtgacggacgagacggtacgggccgggaaccctaaacggtaaccgttacgacgtaacgtacggtcgggtacgtcggacggggaaccgaacggtacccg

SEQ ID NO: 382038 - DNA, 749 bp, Homo sapiens
  misc_feature: GZ8MTXP02G0Y2D.13.76.G10.1.454.CMB.2.raw
  modified_base (337)..(337): a, c, t, g, unknown or other
tcagtcacgtactacacgaccggtgctcgatttagtcactcatacagggggggaggaggagcccagcactgggattccgaggtgtttccattcggtgatcagcactgaacacagaggactcaccatggagttttggctgagctgggttttccttgttgtcttattttaaaaggtgtacccagtgtgaggtgcagctggtggagtcgtgggagggaggtcttgactccgacggtccggtcggggggtcccctggacggtacctccttccgtgttcgcgacgtccgttcgtcgggttccgaccgtcacgtccaccacctacatgacgcgtcgggtcccncgacggccctaccggaaggggacggggtcgtagggagtcgtcgttctttacgttttattagtagtagtaggtagtacctagtactcgactacgtaccgtcggtcggggacggggtaccgtacttaccgaacctacgtcctacccgaaggtaactaaacctaaacttaaccccgaaaagaacccgtaacggtctttaccttttaactaaccaaagttacgaaacgtacgtaccctaggaaacgaccgtacggtaataccggaacgacccgggttcgtaacgttacgttaccgtggccggtaacggagttaaggaccgggtacccggggacctaaaccgggttaactaaccggtacgaacgttacggtacggtacccggtcgggtaaccggggaaccggtaaccggggtaaccc

SEQ ID NO: 382039 - DNA, 720 bp, Homo sapiens
  misc_feature: GZ8MTXP02F82RG.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagtcgtcggtccgccgaggcctaccggaggggaacggggcgtaggtagtcggtcgttcttacgtttttatttagtaggttaggtggttacgtacctataccgtccgacgagtaccgtcggtcgggacggggtccgtacttaccgaccatcctaccaaaggactaaacaacgttacccaaaggaaacctccgtactttacggttttacctaacgaaaagttcgaaaaccgtggtccctaggaaacgggtaccgaccgggtaatccggaaaacccgtccggggtcccgtttaggttaaactttcggtacggtggaccggaaggtacggaccgggttaccgggggaccccctaaaacggtaaaccggtttaaccgaccggtaagttaacggtcgggtaacccggtttcgggacgggggaacccgaacgggggtaaccccg

SEQ ID NO: 382040 - DNA, 690 bp, Homo sapiens
  misc_feature: GZ8MTXP02HBU37.13.76.G10.1.454.CMB.2.raw
  modified_base (596)..(596): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtctgggagggaggcttgactccgacggccggtggggggtccctggacgactcctccgtgtcgcacgcctcgtcgggttcaccgtcagtcacacctacatgagcgtcgggtccgccgaggcctccggaggggaacggggtcgtgggaggtcggtcgtttctttctttttaatttagtaggttaggtaggttacgtacctactaccgtccgacgtacgtaccgtcggtgggacggggtaccgtacgttaccgacctactcctacccgaagtacgtaacctaattacccaaaggaaccctacggttctttacgtttaccttaaacaaaacgtcgtaaaaccgcgtaccgtaggaacgacgtacccgtagtcgaaccgtaccggtacgttagttattacgngtacgacgaggtagcggtaccgggacctaacggtaaccttacgacgtccgtaggtcgggtaccgtcgggaccggggacgaaaccggggtacccg

SEQ ID NO: 382041 - DNA, 578 bp, Homo sapiens
  misc_feature: GZ8MTXP02IMMQD.13.76.G10.1.454.CMB.2.raw
  modified_base (366)..(366): a, c, t, g, unknown or other
  modified_base (374)..(374): a, c, t, g, unknown or other
  modified_base (390)..(390): a, c, t, g, unknown or other
  modified_base (397)..(397): a, c, t, g, unknown or other
  modified_base (438)..(438): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtcccgcgaggctccgaggggaacggggctggagtgcgttcttctttttattatagtagtggtataccatactccgnagactcgnggacgggcattcacanctcaganactaatcaaagaacacgcttagtttactacaaatcgaaacngcctagacgagaccgatcgacacggtccgtgtaactactgcgacgagaggactcgggggacccctaaacggtaaccgtttaacgaccgtaacgttagtacgggtactccggtcggggaacccgtaaacggggaacccccg

SEQ ID NO: 382042 - DNA, 551 bp, Homo sapiens
  misc_feature: GZ8MTXP02I5TJ5.13.76.G10.1.454.CMB.2.raw
  modified_base (288)..(288): a, c, t, g, unknown or other
  modified_base (293)..(293): a, c, t, g, unknown or other
  modified_base (316)..(316): a, c, t, g, unknown or other
  modified_base (319)..(319): a, c, t, g, unknown or other
  modified_base (326)..(326): a, c, t, g, unknown or other
  modified_base (355)..(355): a, c, t, g, unknown or other
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctagaaataattggcagataaatatacttctgtatcagcagagtcaggccagtcccctgtcgctggtcatctancaagntgccaagcgcctgaggactcccngancgtatcnctggctccaatctgggaactcagccatcngaccatccagccggaccaggactagtcggatggacggtacgtagtaccttagtttaacgtgtacgtaacggggcggttacgggaccagggacacggaccacgttacgccccgtagttaacttcggttaccttcggggtaaacttcggggaacccgtaacggtacccgaaccgttaccgtaaacggttcaaacccgg

SEQ ID NO: 382043 - DNA, 738 bp, Homo sapiens
  misc_feature: GZ8MTXP02HE5I6.13.76.G10.1.454.CMB.2.raw
  modified_base (280)..(280): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctctgtgcagcctcgtggttcaccgtcagtcacacctanatgacgcgtcggtccgccagggcctccggaggggaaggggcgtcgggagtcgcgttcgttcttttagtttataggtagtggtatacactctccgcagtccgtccgtggacggggcacttacacctagtcctcccgaagacgaactaacttacccgaaaagaaccgaccgtcgtttacgttttaccttaacgtaaaaacgttcggaaaaccgtggtaccccgtaggaacgggtaaccgcccggtaaagtcggaaacccggtaaccggggtccgtttaaggtttaaacgtttaccgttacgggggtacggaccgggtaaaaggtaacggggtacggtttacccgggggaaacccccttaaaaccggggttaaaacccgtttaaaccccggttaaaggttaccccggttaaggttaccggggtaaccggtttaccggggtaaccggggggtaaacccccgg

SEQ ID NO: 382044 - DNA, 616 bp, Homo sapiens
  misc_feature: GZ8MTXP02IC5TK.13.76.G10.1.454.CMB.2.raw
  modified_base (196)..(196): a, c, t, g, unknown or other
  modified_base (295)..(295): a, c, t, g, unknown or other
  modified_base (297)..(297): a, c, t, g, unknown or other
  modified_base (309)..(309): a, c, t, g, unknown or other
  modified_base (312)..(312): a, c, t, g, unknown or other
  modified_base (331)..(331): a, c, t, g, unknown or other
  modified_base (334)..(334): a, c, t, g, unknown or other
  modified_base (343)..(343): a, c, t, g, unknown or other
  modified_base (376)..(376): a, c, t, g, unknown or other
  modified_base (380)..(380): a, c, t, g, unknown or other
  modified_base (391)..(391): a, c, t, g, unknown or other
  modified_base (420)..(420): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggtagttttggctgagcttgggtttttcctttgttgtcttaattttaaaaggtgcccagtgtgaggtgcagngtggtggagtcgtgggaggaggcttgactccagccggtggggggtccctgagacctctcctgtgcagcctcgtgggttccaccgtcagtcacacctaanangcgcgtcggccncgnggcgacggaggggaggcgnggngtgtctttntttatttttattagtagtgtgtataccataccncganacgtcgtcggnggacgggtctactaccactactctacganaacaactaactacgaaacgaactacttctttcgtttaacaaactaactacgaaacctcgacgtagaacgacgtacgagtaccgacgtacggtacgttagttactcgtgtcgacggaggtacggacgtccgggaacctaaacgtaaccgttacgacgtaacgtacgtacggtcgtcggaccggaaccgtaacggccg

SEQ ID NO: 382045 - DNA, 595 bp, Homo sapiens
  misc_feature: GZ8MTXP02I1JWI.13.76.G10.1.454.CMB.2.raw
  modified_base (449)..(449): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggtcaccgtcagtcacacctacatgagcgtcgggtccgccgaggctccggaaggggaacggggcgtgggagtcggtccgttcttactttttaatttatagttagtggtagtacatactcgcagctccgtggacgggtccgattcacatctccagagaacaattaccaaagaaccacgcttagtttacctanaaactgaaacagcctagagacgaccgatagacgaacggccggttataacttaacttgagacggaaagaggtacgtcgggggaaccccaacgtaaaccggtttaacgaacgtacgttaagcggacggttacggacgggggaacccgg

SEQ ID NO: 382046 - DNA, 504 bp, Homo sapiens
  misc_feature: GZ8MTXP02I0JJ2.13.76.G10.1.454.CMB.2.raw
  modified_base (235)..(235): a, c, t, g, unknown or other
  modified_base (432)..(432): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatntacttcctggtatcagcagaagtcaggccagtcccctgtgctggtcatctatcaagatgccaagcggcctcagggactcccccgtgacgcgattctcctggctccaaactctgggaactcagcccactctgaccatcagcggaccccaggctagtgattgaggctggacttattacgtgtccgaggcgtggggaacngacgacgcacgtcgaccgtctacgtcgtcgtacggacgtcggaaccgagtccgaccgtcgacgtcacgaccg

SEQ ID NO: 382047 - DNA, 836 bp, Homo sapiens
  misc_feature: GZ8MTXP02IONA2.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggtagttttggctgagcttgggttttccttgttgcttaattttaaaaggtgccagtgtgaggtgcagcgtggtggagtcgtgggaggaggcttgactccgaggtccggtcggggggtccctgacgacctctccgtgtgcacgcctcgtcggtccaccgtcacgtcaccacctacatgacgcgtcgggtcccgccgacggcctccgggaaggggaacggggcgtaggaggtcgtcgtttctttactttttaatttagtaaggttaggtaggttaagtaccctaacgttaccgtccgacgtaacgtaccgttccggtggggaccgggggtccctaactttacccaacccgtactacctacccgaaagaacgtaaacctaaacgttaacccaaaacggtaaaccctacggtaccttttacggttttacccttaaacaaaaacgtttacgaaaacccgtacggtacccttaagggaacggtaacggaacccccggtaaagttaacccggacccgggtaaacccggggttccccggttagtttaaaaccgtttaaccgggtttggtaccgggtaacccgggaaaggggtaaccggacgggttaaccccggggggaaccccctaaacggttaaaacccggtttaccgtaaccgtaacgttacggtacggggtacccgtaccgggtaccgggggaacccgtaaacggggtaacccccgg

SEQ ID NO: 382048 - DNA, 672 bp, Homo sapiens
  misc_feature: GZ8MTXP02G168G.13.76.G10.1.454.CMB.2.raw
  modified_base (361)..(361): a, c, t, g, unknown or other
  modified_base (458)..(458): a, c, t, g, unknown or other
  modified_base (523)..(523): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtgggtccgccaggctccgaggggagggctggagtgcgtctcttttattatagtagtggtagtaccatactcgnacgactccgtggacggggctacgttcaccatcctaccagacgaactaacttaccaaagtaaccacgtcttacgtttacttacaaaagttacgaaacncgtaccgtaggaagacgcccggaatcggaaccgtaccggggtaccgttagttaaactttaccggnggttacggaccgaaagggttaggacgggtttacccggggggaccccctaaacggggtaaaacccgtttacccgtaacggtaacccgtaggttaccgggggtaccgtttccgggtaacgggggtaccccgaaaacggggggtaacccccg

SEQ ID NO: 382049 - DNA, 677 bp, Homo sapiens
  misc_feature: GZ8MTXP02FYF1M.13.76.G10.1.454.CMB.2.raw
  modified_base (246)..(246): a, c, t, g, unknown or other
  modified_base (278)..(278): a, c, t, g, unknown or other
  modified_base (508)..(508): a, c, t, g, unknown or other
  modified_base (530)..(530): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctatttaaaaggtgcccagtgtgaggtgcagctggtggagtcgtggaggaggcttgatccagccgtgggggtcctgagactctcctgtncagcctcgtggtcaccgtcagtcacacctacntgagtcgtcgggtcccgccgaggcctccggaaggggaacggggtcgtaggaggtcggtccggtttactttacgtttttaagtttattaggtaggttagggtaacgtaaccctactaccgtccggacacggtaccgtccggtggggaccgggcacttccgacctatcctaccgaagactaactaactaccaagtaacctacgtctttcgtttactacaaaagtctaaaccngcctaggaacgtacggccgaanccgaccgaacgggtccttagtaacttcgtgacgacggaagaggtacggtacccgggggaccctaaacggttaaaacccgttcgtaaaccggcgttaacggtccggggtaccggttcgggaaccgggggaaccgtaacgggtaacccg

SEQ ID NO: 382050 - DNA, 694 bp, Homo sapiens
  misc_feature: GZ8MTXP02JFLIF.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctattttaaaaggtgcccagtgtgaggtgcagctggtggagtctggaggaggcttgatccagccgtgggggtccctgagactctcctgtgcagcctcgtcgggttcaccgtcagtcacgccctacatgagcgtcgggtcccgccgaggcctccggaaggggaacggggcgtggagtcggcgttcttctttttattagtagtagtggtagtactatactccgacagtacctcgtgggcgggtccgacgttccaccactcctacccaagacgaacaaacttaccgaaaagaaccacgtctttacgttttactaacaaaactcgtaaaccagtacccgttagaacggacgaccgagtacggaaccgtaaccgggtccgttagttaaacttaccggtgtacggtaacggtaggaacggtacgggttaccgggggaaccccctaaacgggttaaaacccgtttacgtaaaccggcgtttaacggacggggtacccggttacggggtaccgggggtaacccggaaacggggtaaacccccgg

SEQ ID NO: 382051 - DNA, 590 bp, Homo sapiens
  misc_feature: GZ8MTXP02GPYND.13.76.G10.1.454.CMB.2.raw
  modified_base (291)..(291): a, c, t, g, unknown or other
  modified_base (309)..(309): a, c, t, g, unknown or other
  modified_base (337)..(337): a, c, t, g, unknown or other
  modified_base (500)..(500): a, c, t, g, unknown or other
tcagtcacgtactacacgaccggtgctcgatttagtcactcatacagggggggagaggagcccagcactgggattccgaggtatttccattcggtgatcagcactgaacacagaggactcaccatggagttttggctgagctgggttttccttattactattttaaaggtgtccagtgtgaggtgcagttggtggagtctggaggaggcttggtccaggccgggggggtcctgagactctcatgtgcggcctgtggctcaccgtcaacaccaactacatgagctgggtccnccaggctccgagggaagnggccggagtgggtctcgagttatttagngtcgacggtgccacattcaccgcagactccgtggacggggccgttcaccgatctccaggaacgactaaattacccaaagaacgacggtagtattcttacaaatcgaaacgacctagagaaggtcgaaggacacggtaccgtactacttactgtgacgaaaagntagacagacgacgggcccccgtaagcgggtacctggggtacgtacgggttcttcgttgtacgtcggcgtcggggaccgacgggtaacccg

SEQ ID NO: 382052 - DNA, 583 bp, Homo sapiens
  misc_feature: GZ8MTXP02I5QRA.13.76.G10.1.454.CMB.2.raw
  modified_base (315)..(315): a, c, t, g, unknown or other
  modified_base (409)..(409): a, c, t, g, unknown or other
  modified_base (487)..(487): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagcgtgggcccgccaggctccgaggggagggcnggagtgcgtcttcttttatttatagtagtggtataccatactcgcagactcgtggagggcatcaccatctccagagacaattccaaagacgacncgttattttctacaaaatgaaaccagtccctagaagtacacccgatacggactaaccgggtccgtattaatttaccgngtacgacggagacgcggtaccgggaccctaaacgtaaacgttacgtaacgaacgtacgtacggtaccggtcggacggggtaaccgaacgggtcccg

SEQ ID NO: 382053 - DNA, 639 bp, Homo sapiens
  misc_feature: GZ8MTXP02H2BO9.13.76.G10.1.454.CMB.2.raw
  modified_base (170)..(170): a, c, t, g, unknown or other
  modified_base (452)..(452): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctctaggaaataattggacagtaataaatattacttccgtaggtatcagacaagagtcaggcccacgtcccctgtcgcgtggtcatctaatacgaaacgtatcgaccgaagcccggacctcggaacgggtacctccccgtaggacgtcgtactttctcgtcggccctacctaacgtccggtagggtaacctcgaccgtccctacgtcctacgaccctagtacccgacgggacccgggaacccngggactaggtgaagtggaggtctagtacttaacgttcgtacgtacgcggggtacggtacggggactacgggcacgaacccgtacgttccggacccgttagttacggttcgttaccgttacgggaaccgtacggggtaaccgtccggggtaaccacccggttacgtaacggtccaaccggaaaccccg

SEQ ID NO: 382054 - DNA, 665 bp, Homo sapiens
  misc_feature: GZ8MTXP02H89ET.13.76.G10.1.454.CMB.2.raw
  modified_base (283)..(283): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggaggaggcttgatccagccgtgggggtccctgagactctccgtgtgcagcctcgtggtcacgtcagtcacacctanatgagctcgggtccgccgacggcctcggaaggggaaggggcgtgggacgtggtccgttctttactttttatttagtagttaggtaggtagtactataccgtccgacacgtccgtccgggtaggaccgggggcctacttccgaacctctcctaccgagtaacgactaaactacccaaagacctacgtcgttacgtttacctacaaaagttcgaaaccgacgtacgtacggaggaccgacccgagtaccgacgtaccgggtcgtagtacgttacgtgtcggacgagtaacggacggtaccggggaacccgtaccggtaaaacgttaaccggtaaacgtcgttaacggtacgggtccggtttacgggaccgggggaaaccccggg

SEQ ID NO: 382055 - DNA, 647 bp, Homo sapiens
  misc_feature: GZ8MTXP02G9MJO.13.76.G10.1.454.CMB.2.raw
  modified_base (467)..(467): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtcgggtcccgccgaggcctccgaggggaaggggctggagtgcgttctttctttttatttagtagttagtggtagtaccatactccgcagaccgtcgtggacggggcctacttccacctatcctaccaagacgaacaacttaccaaagaaccacgtcttgtttacttacaaaatcgaaacncgtacctgaagacgacccgtatcgaaccgacgggtccgtagttacgttacgtggtacggacggaggaggtacggtaccgggggaccccctaacgggtaaaccgtttaccgtaacggtaaccgttaggttaccggggtaccgttcgggtaccgggggaacccgaaacgggggtaacccccg

SEQ ID NO: 382056 - DNA, 653 bp, Homo sapiens
  misc_feature: GZ8MTXP02IA1N5.13.76.G10.1.454.CMB.2.raw
  modified_base (375)..(375): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtcgggtccgccgaggcctccggaggggaacggggcgtagggagtcgcgttcttactttttattatagtagtggtagtacatactcgnacgactcgtggacgggcacttcacctatctccagtacgaactaacttaccaaagaacctacgtcttacgtttactaacaaatacgaaacgtacgccttaggaacgacggcccgaagtacggaaccgtaccgggtccgttagttaacgttaccgtggtacggccggaaggaggtaacggtccgggggaacccctaacgggtaaaccggtttacctaacggtcgttacggtacgggtaccggtaccgggtaccgggggaccgtaaacgggggacccccgg

SEQ ID NO: 382057 - DNA, 620 bp, Homo sapiens
  misc_feature: GZ8MTXP02HSES9.13.76.G10.1.454.CMB.2.raw
  modified_base (284)..(284): a, c, t, g, unknown or other
  modified_base (378)..(378): a, c, t, g, unknown or other
  modified_base (451)..(451): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacactacatgngctcgggtccgcgaggcctaccgaggggaacggggctagggagtcggcgttctttctttttatttagtagttaggtggtagtaccatacctccncagacctcggtggacggggcgtattccactatcctccagacgacaacttaccaaagaaccctacgtccgtttnttttacctactaaaagtcgaaacacgacccgttaggaacgacgtaccggatacggaaccgtccgggtacgtagttaattcgagtggacgtagacggtaacgtcgggggacccaacggtacgttaacgacgtcgtagtcggacggtcgtacggggaccgaacggacccgg

SEQ ID NO: 382058 - DNA, 654 bp, Homo sapiens
  misc_feature: GZ8MTXP02HATUP.13.76.G10.1.454.CMB.2.raw
  modified_base (410)..(410): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtgggtccgccgaggcctccgaggggaaggggctggagtgcgttcttcttttatttatagtagtggtagtaccatactccgcagactccgtggacggggccgattccacctatcctaccaganacaatccaaagacacgtctgtttactacaaatgaaacagaccctggacgacgacccgagacgaaccgaccgggtaccgttaggttaatttaaccgttgggtaggtaccggtaaagggaggaaacgggttcccggggggaaccccctaaaaccgggtaaaaccgtttaccgaaaccggtccgttaaaggtccgggggtaaaccggttccgggtacgggggaaccccgaaaacgggggaacccccg

SEQ ID NO: 382059 - DNA, 735 bp, Homo sapiens
  misc_feature: GZ8MTXP02IJGG7.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggtcaccgtcagtcacacctacatgagctgggtccgccaggcctccggagggaaggggctggagtggcgtcttcttttatttatagtagtgtagtacctatactcgcagactccggtggacggggccgacttcacctatcctaccaagacgtaaccaaacttacccgaaaagaaacccgtaccggtccttttacggttttaccctttaacaaaaacttcggaaaaccgtacggtaccccgttaggggaacgacgggacccccggtaaagttccggaaacccgtaaccgggggtccccgttaaggtttaacgtttaaaccgtgggttacggtacgggtaaggacgggtaacgggttacccggggggaccccctaaaacggggttaaaacccggttaacccgtaacggtcccgttaaaagggttccggggtaaccgggttccggtacggggggaccccgtaaaacgggggtaacccccgg

SEQ ID NO: 382060 - DNA, 653 bp, Homo sapiens
  misc_feature: GZ8MTXP02JS5I0.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtccctgagactctcctgtgcagcctcgtgggttcaccgtcagtcacacctacatgacgcgtcgggtccgccgaggcctaccggaggggaaggggctaggagtcgcgttcttacttttattagtagtagtggtataccatacctccgacacgaccgtccggtgggacggggtccgtacttaccaccgtatccgtaccaaggacaaactaaacttccaaaagaaccctacggtcctttagttttacctaacaaaagttcgaaaacgcgtccctaggacgaccggtaccgaagttcgaaccgacggtaccgtagttacttacgtgacgacgaagcggacggtccggggaccctacgtaaaaccgttccgaacgtcgttaacggtacggtacccggttcggaacgggggacccgaaagggtacccccg

SEQ ID NO: 382061 - DNA, 610 bp, Homo sapiens
  misc_feature: GZ8MTXP02F5OSS.13.76.G10.1.454.CMB.2.raw
  modified_base (362)..(362): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtgggtccgccaggctccgaggggaaggggctggagtgcgtcttcttttatttagtagtagtggtagtacatacncgacacgaccgtcgtggacgggcctagttccacctatctaccaagacgaactaacttaccaaagaacctacgctttagtttacctacaaaatcgaaaccgacgaccgtagacgacgaccgaatacgacgaccggtccgtagttactacgttggagaccggtaagacggtacgtcgggggacccctaacggtaaaccgttctaacgcgtacgtacggaccgttcggacgggggaccgaaggaaccccgg

SEQ ID NO: 382062 - DNA, 579 bp, Homo sapiens
  misc_feature: GZ8MTXP02JRRSE.13.76.G10.1.454.CMB.2.raw
  modified_base (251)..(251): a, c, t, g, unknown or other
  modified_base (448)..(448): a, c, t, g, unknown or other
  modified_base (459)..(459): a, c, t, g, unknown or other
  modified_base (498)..(498): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtggggggtccctgagactctcctgtgcngcctcgtgggttcaccgtcagtcacacctacatgagctcgggtccgccgacggcctccggaggggaacggggcgtggagtgtcgttcttctttttatttatagtagtcggtagtacatactcgacagacgtcgtggacgggctattccacctatcctccagaacgactaattccaaagacacgtcttgtttacctanaaatcgaaacngcctggacagccgaatcgaccgacggcgtgttattacgngtgacggacgaggacggccgggacctaacggtaaccgttacacgtcgtacggtcggacgtcggacgggaccgaacggaccg

SEQ ID NO: 382063 - DNA, 626 bp, Homo sapiens
  misc_feature: GZ8MTXP02HU9PE.13.76.G10.1.454.CMB.2.raw
  modified_base (432)..(432): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctgtgggttcaccgtcagtcacacctacatgagcgtcgggtcccgccagggcctcccggaagggggaacggggctggggagttggtccgttctttcgtttttaatttagtaggttagtggtagtacatacctcgacagccgtcggtgacgggggccctagttcactatcctaccaganacaacttaccaaagaacctacgtcttgtttacctacaaaattacgaaactacgtcctagagacgaccgagtacgacgcggtaccgttagtacttacgtgtacggacgaagacgtacgtccgggggaccctaaacggtaaccgttaacgtacgtcgttaacggtacggtaccggttacggtacgggggaacccgg

SEQ ID NO: 382064 - DNA, 634 bp, Homo sapiens
  misc_feature: GZ8MTXP02HL196.13.76.G10.1.454.CMB.2.raw
  modified_base (432)..(432): a, c, t, g, unknown or other
  modified_base (474)..(474): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcacgcctcgtcgggttcaccgtcagtcacacctacatgacgcgtcgggtccgccgaggcctccggaggggaacggggcgtgggaggtcgtcgttcgtttctttttaatttagtagttaggtggtagtaccatacctcgcacgccgtcggtggacggggctacgttccacctactcctaccaganactaattaccaaagaacacgtcttgtttctacaaatgaaacncgtcctaggacgacgaccgaagtcgaaccggaccggtccgttaggttaactttacgtggtacggacggtaaggacggtacggtccgggggaacccctacggtaacccgttactacgaacgtaagtcgggacggttcgaccggggaccgtaacgggacccg

SEQ ID NO: 382065 - DNA, 740 bp, Homo sapiens
  misc_feature: GZ8MTXP02JXEZD.13.76.G10.1.454.CMB.2.raw
  modified_base (297)..(297): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggtcaccgtcagtcacacctacatgagcgtggggtcccnccgagggcctccgaggggaaggggctgggagtgtccgtcttctttttaattagtagtaggtggtataccatactccgacagaccgtcgtggacgggggtcccattccaccaacttcctacccgaagacgaactaaacttacccaaaagaaccacggtcttacggtttacctttaaccaaaagttcgaaaccgacgtacccgttaggaacggaaccgaccccggaattacggaacccggtaccgggtacccccggtttagttaccgtttaaacccgtgggttaacggacccgggtaaagggaaacgggtaccggggttaccgggggaacccccgtaaaccgggttaaaacccggtttaacccgtaaccggtaaccgtttaaggtaccggggtaaccggttaccggggtaccgggggaaccccgaaacgggggtaaaccccccgg

SEQ ID NO: 382066 - DNA, 713 bp, Homo sapiens
  misc_feature: GZ8MTXP02IP2ET.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctattttaaaaggtgcccagtgtgaggtgcagcgtggtggagtcgtgggaggaggcttgactccgagtccggtgggggtccctgagactctcctgtgcacgcctcgtcggttcaccgtcagtcacacctacatgagcgtcggtccgccgaggcctccggaaggggaacggggcgtgggagtcgcgtttctttactttttattagtagttagtaggtaagtacctactaccgtccgagtacgtaccgttccggtggggacggggaccgtaacttccaaccctacgtcctacccaaagacgaaacctaaactaacccgaaagtaaacccaccgttcctttacgtttttacccttaacgaaaacgttacgaaaacctacggtaccctaggaaacgaccggtaccgaacgtacggaacccgtaccgggtaccgttagttaacgtttacgcggtacgacggaggtaaggccggttaccgggggacccctaacggtaaaccgttaaccgacgtaacgtagtcgggtaccgtacggtaccgggaccggtaacgggaaccccg

SEQ ID NO: 382067 - DNA, 712 bp, Homo sapiens
  misc_feature: GZ8MTXP02HUXRY.13.76.G10.1.454.CMB.2.raw
  modified_base (520)..(520): a, c, t, g, unknown or other
  modified_base (576)..(576): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctaattttaaaaggtgcccagtgtgaggtgcagctggtggagtctgggaggaggcttgatccagccgtgggggtccctgacgactctcctgtgcagcctcgtggttcaccgtcagtcacacctacatgagcgtcgggtccgccgacggcctccgggaagggggaacggggtcgtggggaggtcggtcgtttctttactttttaatttagtaggtttaggttaggtacgttacctactacctccgacacgtaccgtcgggtgggacgggggtcctagttacccacctactcctacccgagtaagaacctaaacttaccgaaagtaaccctacgtctttagtttacctaactaaaatacgaaacncgtaccgttaggaagcgaccgtagtacggaccgaccgggtcctagttaaccttagnggtgaccggaaggtacggacggtacccgggggaaccccaaacgggtaaacccgtttaaccgtaccggtaacgttaacgggtaccgggttaccggtcgggttaacccgggggaacccgtaaacgggggtaacccccg

SEQ ID NO: 382068 - DNA, 683 bp, Homo sapiens
  misc_feature: GZ8MTXP02JHK84.13.76.G10.1.454.CMB.2.raw
  modified_base (362)..(362): a, c, t, g, unknown or other
  modified_base (412)..(412): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagcgtcgggtcccgccgaggcctccgaaggggaaggggctgggagtcgcgtcttctttatttatagtagtggtagtanatactccgcagccgtccgtgggacgggggccctagttccaaccattcccncccgaagacgaacaaacttacccgaaagaaacccacgtcttacgttttaccttaacctaaagttacgaaactaacttccgtggaaacgtacgaccgtaatacggaaccgaaccgggtcccgttaggttaactttaccggtggttacgcggaaaggacggtaacggtcccggggggaccccctaaaaccggggtaaaccgtttaaccgttaaaccggaccgttaaaggttcgggtaaaccggttccgggggtacgggggaaaacccccgggg

SEQ ID NO: 382069 - DNA, 705 bp, Homo sapiens
  misc_feature: GZ8MTXP02JRNKN.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttattttaaaaggtgcccagtgtgaggtgcagctggtggagtctgggaggaggcttgatccagccgtgggggtccctgagactctcctgtgcagcctcgtggtcaccgtcacgtcacacctacatgacgcgtcgggtccgccgaggccgtccggaaggggaacggggcgtcgggagtcggtccgtttctttacgtttttaatttagtagttaggtaggtatacctactaccgtccgactacgaccgttcgtggggacggggcctacgttaccacctactcctaccgaagactaacctaacttacccgaaagtaaccacgttcctttagtttacctaacgaaaattcggaaacctaggtaccctaggaacgtaccgacccggaagttacggaaccgtaacccgggttccgttagtttaaccgttacgttgggaccgtaacgggaagacgggtaacggtccgggggaacccctaaacggttaaacgtttccgaacggtcgtacggtacgggtaccgtagggtaccggggaacccgaacgggtaccccg

SEQ ID NO: 382070 - DNA, 755 bp, Homo sapiens
  misc_feature: GZ8MTXP02G5WPZ.13.76.G10.1.454.CMB.2.raw
  modified_base (249)..(249): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtcgtggaggaggcttgatccagccgtgggggtccctgagactctcctgtgcncgcctcgtggttcaccgtcagtcacacctacatgagcgtcggtccgccgaggcctccggaggggaacggggcgtggagtggtcgtttctttactttttagtttagtaggttagtggttataccctataccgtccgactacgtacctcccgggtgggacggggacctacttcccgaccctaacgttccctacccgaaagtaacgtaacctaaaacgttacccgaaaacggtaaccctacggttaccctttacgttttaaccttaaccaaaagttccgaaaacctacgtaccccgttaggaaacggaccggtacccggtaagtacggaacccgaaccggggttcccgttaagtttaacgttaccgtagggttacggacggaaggtacggtaccggggttaccgggggaaccccctaacgggttaaacccgtttacgtaaacgggtccgttacgggtacgggtaccggttaccgggtaccgggggaaacccgtacgggggtaacccccg

SEQ ID NO: 382071 - DNA, 712 bp, Homo sapiens
  misc_feature: GZ8MTXP02H1R83.13.76.G10.1.454.CMB.2.raw
  modified_base (308)..(308): a, c, t, g, unknown or other
  modified_base (652)..(652): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggaggaggcttgactccgaggccggttggggggtcctgacgactctcctgtcgcagcctcgtcgggttcaccgtcacgtcacacctacatgagcgtcgggtcccncgaggcctaccggaggggacggggctagggagtcggtccgtttctttacttttttaagttagttaaggttaggtaggttaacgtacctaattaccgtccgactacggtaccgttccggtgggggacgggtcccggtacttacccaaccgtactcctaccgaaggacaaccggtaaacttaccgaaaagaacctacggttcttacgtttttacaacaaaagttcgaaacgtcgtaccgtaggaacgacgtaccgtagaccggacgtaccggtcggttattacttacggcgtacggacggaaggtaacggcggtaccgggggaaaccctaacggtaacgttaaccncggtaacgttacggtaacgggcccggttagggaccgggggtaaccgaaaacgggtccccg

SEQ ID NO: 382072 - DNA, 640 bp, Homo sapiens
  misc_feature: GZ8MTXP02HFMQY.13.76.G10.1.454.CMB.2.raw
  modified_base (499)..(499): a, c, t, g, unknown or other
  modified_base (548)..(548): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtcgcagcctcgtcgggttccaccgtcacgtcacctacctacatgagtcgtcgggtccgccgaggcctccggaaggggacggggcgtggagtcgtcgttcttacttttatttagtagtagtggttagtacctatacctccgacacgtacctcggtgggacggggtcctacttccgacctactccctacccgaaagacgaaactaaacttaccgaaaagaaccctacgtcttagtttcctaactaaaatcgaaacncgacctggaacgcgacgagtacgaccgacggtccgttagtacgttacgngtcgacggagtacggacgtcgggggaaccctaacgtaaccgttacacgtcgtaaggtcggtacggtcggtaccggggacgaacggtaccccg

SEQ ID NO: 382073 - DNA, 590 bp, Homo sapiens
  misc_feature: GZ8MTXP02JO7JD.13.76.G10.1.454.CMB.2.raw
  modified_base (294)..(294): a, c, t, g, unknown or other
  modified_base (454)..(454): a, c, t, g, unknown or other
  modified_base (469)..(469): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccnccaggctccgagggacggggctggagtgcgtcttcttttatttatagtagtggtataccgattactccgcagaaccgtccgtggacgggggccagtttccaccgatcctacccagagaccaaattccaaagaccacgcttgtttactacaaatcgaaacngcctgagagccgtancgacacggtccgtgttaagtacgtgcggacgaggtagaacggtcggggaccccaacggtaaccgtacttaccggcttacggtcggtaacggttccgacgggggacccaacggggaaccccg

SEQ ID NO: 382074 - DNA, 622 bp, Homo sapiens
  misc_feature: GZ8MTXP02I8TZP.13.76.G10.1.454.CMB.2.raw
  modified_base (298)..(298): a, c, t, g, unknown or other
  modified_base (407)..(407): a, c, t, g, unknown or other
  modified_base (417)..(417): a, c, t, g, unknown or other
  modified_base (463)..(463): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtctggaggaggcttgatccagccgtggggggtccctgacgactctcctgtgcagcctcgtgggttcaccgtcagtcacacctacatgagcgtgggtccnccgaggcctccgaaggggaaggggctagggagtgcgtcttctttttaattatagtagtggtagtaccatactccgcacgactccgtgggacggggcctattccacatcnccaagacaanaactacaaagaaccacgtccttagtttactacaaaatgaaaaccgngaccagacgacgaccgagacgaccgacggtcctagtacttagtgacgacggaagaggtacggacccgggaaccctaaaacggtaaaccgttaaccgtacgtaacgttaaggtaccgggtaccggtaccgggtaacgggggaacccgaaaacgggacccg

SEQ ID NO: 382075 - DNA, 579 bp, Homo sapiens
  misc_feature: GZ8MTXP02GENS2.13.76.G10.1.454.CMB.2.raw
  modified_base (448)..(448): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtcgggtcccgccgaggcctccgaggggaacggggcgtggagtgcgttcttctttttatttatagtagtggtagtaccatacctcgcagacctccggtggacggggcctattccaccatctccagagaactactaccaaagaaccacgtcttagtttacctanaaagtgaaactgcctagagacgaccgatacgaccgacggtccttagtattaagtgtgacgagagacgtcggggacccacgtaacgttactacgcgtagcggtacgtcggtacggggaccgaaggtaccccg

SEQ ID NO: 382076 - DNA, 639 bp, Homo sapiens
  misc_feature: GZ8MTXP02HWDYH.13.76.G10.1.454.CMB.2.raw
  modified_base (489)..(489): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctattttaaaaggtgcccagtgtgaggtgcagctggtggagtcgtgggaggaggcttgatccagccgtgggggtccctgagactctcctgtgcagcctcgtcgggttcaccgtcagtcacacctacatgagcgtcgggtccgccgaggcctaccggaggggaacggggcgtggagtcgtcgtctttctttttattagtagttagtggtataccatacctcgcagactcggtggacggggcctacgttccacctactcctaccgaagaacgaaactaaacttacccaaagaaacctaccgtacttcgttttacctaactaaaatacgaaacncgtacctaggacgacgaccgtatacggaaccgaccgggtacgtagttaaagttccgtagtacggacggtaggacggacgtccgggggaaccctaacggtaacgttactacgaactagcggtacgtcggtcggggaaccgaacggtacccg

SEQ ID NO: 382077 - DNA, 638 bp, Homo sapiens
  misc_feature: GZ8MTXP02FSWT0.13.76.G10.1.454.CMB.2.raw
  modified_base (170)..(170): a, c, t, g, unknown or other
  modified_base (237)..(237): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtgtcccgtgtccccaggacagacagccagcatcactgctctaggaaataatggacagaataaatntacttcctggtatcagcagaagtcaggccagtcccctgtgctggtcatctatacaagatgaccaaggccggccctgaacggggactccccccgtagacgcgtacttctacctggccctaccaactcgtacgggaacttcgacgcccacgtcctacgacccataccgaggaccgggacccaggaccgtagtaggagttaggacggtacttacggaacttagttaaccgttagttacccgaaggggtcggtaggggaacgacggacgaagcctaacgtccggacccgtacgttaacgtcggttaccgtttaaccggggaaccgtttacgggggaaaccccgtaaacgggttccgtaaaacccccggttaccgttaaaacggtacccgaacgtaaaccccccgg

SEQ ID NO: 382078 - DNA, 569 bp, Homo sapiens
  misc_feature: GZ8MTXP02IDFM7.13.76.G10.1.454.CMB.2.raw
  modified_base (297)..(297): a, c, t, g, unknown or other
  modified_base (329)..(329): a, c, t, g, unknown or other
  modified_base (352)..(352): a, c, t, g, unknown or other
  modified_base (364)..(364): a, c, t, g, unknown or other
  modified_base (443)..(443): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctcgtgggttcaccgtcagtcacacctacatgagctggggtccnccgaggcctccgagggaggggctggagtgctntctttttattatagtagtggtanacatactccacngactccgtgacggggcacgttcaccagtctcccagacgaactaattccaaagaatacgtcttgtttcacaaatgaaacngaccagagacgacaatcgacgacggtcgtagtattcgtgtacgacgaggagacgccggggacccaacgtaacgttaaccgacgtcgtacgtacggtacggtcggtacggggaaccgaacgggcccg

SEQ ID NO: 382079 - DNA, 555 bp, Homo sapiens
  misc_feature: GZ8MTXP02GW140.13.76.G10.1.454.CMB.2.raw
  modified_base (294)..(294): a, c, t, g, unknown or other
  modified_base (405)..(405): a, c, t, g, unknown or other
  modified_base (430)..(430): a, c, t, g, unknown or other
  modified_base (439)..(439): a, c, t, g, unknown or other
  modified_base (466)..(466): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctggggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccnccaggctccgaggggaaggggctggagtgcgtcttcttttattatagtagtggtagtaccatactcgcagactcgtgaggggcattccacatctccagagacaatccaaanacacgctgtttctacaaatgaaacncgcctgagngccgaatcgacacggcgtgtattacgngtgcgagagacgtcggggaccccaaggtaaccgtttacacggcttaaaggtcggaacgtcggtacgggggacccaaacggggaaccccg

SEQ ID NO: 382080 - DNA, 652 bp, Homo sapiens
  misc_feature: GZ8MTXP02HZ8J8.13.76.G10.1.454.CMB.2.raw
  modified_base (188)..(188): a, c, t, g, unknown or other
  modified_base (286)..(286): a, c, t, g, unknown or other
  modified_base (317)..(317): a, c, t, g, unknown or other
  modified_base (322)..(322): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcgtgggttttctgttagctatttaaaaggtgccagtgtgaggtgcagntggtggagtctgggagaggcttgatccagccgtggggggtccctgagactctcctgtgctagccctgtcggggttcaccgtcagtcaccacctacagngcgcgtcggccgccgcgcgacggagggaggngaggngtgtcttctttatttattagtagtagtagtatacctatactcgcacgtacgtcggcggacgggtacgtactacacctactactacaagaacgaaactaaactaacgaaacgaacgtacgtacttacgttacttaactaagtaacgtaacgtacgtacgtacggacgacgacgacgacgaccggaccggtacggtacgttacgttacgtacgtacggacggaaggacggtacggtaccggtaacccggtaaccggtaaaccgttaaccgtaaccgtaacgtaacggtaacggtacggtacgggtaccgggtaaccgggtaaccggaaccgg

SEQ ID NO: 382081 - DNA, 712 bp, Homo sapiens
  misc_feature: GZ8MTXP02INTDK.13.76.G10.1.454.CMB.2.raw
  modified_base (292)..(292): a, c, t, g, unknown or other
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagcccacctcagtcgtccgtgtccccaggacagacagccagccatccacctgctacgtaaggaaataagttggacaagtaataaatatacttcgtagtatcagcagaagtcacggcacgtcccctgtcnctggtctagtctatacgaagactcgaccgaacggtcccgacccttacggaccgggtaccctaccccgtggacgtaccgtactttccgtccgtcgggtaccctacccgtaaccgttccgtacggggtaacctcgaacccgacctacgtcctacggaacctacgtaccggacggtccccggggaaccgtacgggtaccgttaacggagggtaacgtacgggtaaacggaccgttaagttacccgtttaattaaccggttcgtaacggtcgggacggttagggacctaaagcgacgttaccgacggttcgaccccggttaagtcgttaccggttaaccgtaccgggaaaacggtaaccgggtaaaacccggaacgggttccccgtaaacccggttacgtaaaccggtacccgaaaaccccggg

SEQ ID NO: 382082 - DNA, 603 bp, Homo sapiens
  misc_feature: GZ8MTXP02GTQOK.13.76.G10.1.454.CMB.2.raw
  modified_base (269)..(269): a, c, t, g, unknown or other
  modified_base (297)..(297): a, c, t, g, unknown or other
  modified_base (441)..(441): a, c, t, g, unknown or other
  modified_base (452)..(452): a, c, t, g, unknown or other
  modified_base (469)..(469): a, c, t, g, unknown or other
  modified_base (493)..(493): a, c, t, g, unknown or other
tcagtcacgtactacacgaccggtgctcgatttagtcactcatacaggggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtnagtcacacctacatgagctcggggtccnccgaggctccgaggggaggggctgggatgcgtctcttttatttatagtagtggtagtaccatactccgcagacctccgtggacgggggccattccgactatcctccaagacacaattaccaaagaacacgcttgtttacctaanaaatcgaaacncgacagacgacgacgancgacgacggtcttagtacttacgnggtacggacgtaggaggacggtccggggaaccctaacggttaaaccgttacgtacgaacgtaacggtacgggtaccggtccgggacgggggaacccgtaacggggacccg

SEQ ID NO: 382083 - DNA, 564 bp, Homo sapiens
  misc_feature: GZ8MTXP02FQHNY.13.76.G10.1.454.CMB.2.raw
  modified_base (368)..(368): a, c, t, g, unknown or other
  modified_base (473)..(473): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactcccctgtgcagcctctgggttcaccgtcagtcacacctacatgagctgggtccgccaggctccgaggggaaggggctggagtgcgtctcttttattatagtagtggtagtacatactccgcagactccgngaggggccgattcaccatctccagagacaattccaaagaacacgtctgtttcttacgaaatcgaactagcctagagagcccgatagaccacggccgtgtattacngtgcgtagagagtcggggcccaacggaaccgttacgtaccgctaagttcgggaacgtcggtagggggacccaaacggggaccgtacccggg

SEQ ID NO: 382084 - DNA, 557 bp, Homo sapiens
  misc_feature: GZ8MTXP02FJKG7.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgccaggctccgaggggaaggggctggagtgcgtctcttttatttatagtagtggtagtaccatactcgcagactccgtgagggggccattccaccatctccagagacaattaccaagaacacgcttacgtttacttacaaaattgaaacagaccctgaagacgaccgatacgacacggccgtgtattactgcgacgagagagtcggggacccaacgtaacttactacgcgtagtcggacgtcgtacggggaccacgggaacccg

SEQ ID NO: 382085 - DNA, 702 bp, Homo sapiens
  misc_feature: GZ8MTXP02GHK66.13.76.G10.1.454.CMB.2.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcacgcccaccctcagtcgtccgtcgtccccaggacagacagccagcatcacctgctctaggaaataagtggacagaataaatatacttcctggtatcagacaagaagtcgacggcccacgtcccctggtcgtcgtggtactatcgtaatacgaagtacgtcgacccgaacggcccggaccctacggacggtacctcccccgtaggacgtacgtacttcgtcgtacggtcctacccgaacgttcgtaccgggacctcgaccgtccctactctaccgaccacgtaccggacggacccggacccgtaggtaccgtagtaggacgttagggacggtcgtacgttaacgtttacgttaacggttcggaccggtacggggtacgggtacgggaacgacggtaccgaaccgtaccgtaccggtacccgtcccggttaacgtttaccggttccggttacccggtttaaccgggaacccggttacgggaaacccgttaacggtacccgtaacccggttaaccgttacggaacccgtaacccggaaacccccg

SEQ ID NO: 382086 - DNA, 622 bp, Homo sapiens
  misc_feature: GZ8MTXP02G5F5Y.13.76.G10.1.454.CMB.2.raw
  modified_base (297)..(297): a, c, t, g, unknown or other
  modified_base (468)..(468): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtctggaggaggctagatccagccgtggggggtccctgagactctcctgtgcagcctcgtgggttcaccgtcagtcacacctacatgagcgtgggtccnccgaggcctccgaggggaaggggcgtggagtgcgttcttcttttatttagtagtagtggtagtaccatactccgcagactccgtggacggggcctagttaccaccatcctaccaagacgaacctaatacccgaaagaaccacgtcttgtttactacaaaagtcgaaaaccngtcctaggacgacgccgatcggacgacggtccgtagttactacgtgacggacgaggtagacggtcgggggaacccctaacggtaaccgtttacacgtaacgttaacgtcgggtaaccggttccggtacggggaaacccgaacggggtaaccccg

SEQ ID NO: 382087 - DNA, 704 bp, Homo sapiens
  misc_feature: GZ8MTXP02FHIV6.13.76.G10.1.454.CMB.2.raw
  modified_base (354)..(354): a, c, t, g, unknown or other
  modified_base (358)..(358): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctatttaaaaggtgcccagtgtgaggtgcagctggtggagtctggagaggcttgatccagcctggggggtccctgagactctcctgtgcagcctcgtgggtcaccgtcagtcacacctacatgagcgtggggtcccgccgaggctccgaggggaaggggctggagtgcgtctctttatttatagtagtggtagtacntacncgcagacctccgtgacggggcctattccacctatcctccaagacgaaactaaacttacccaaagtaaacccaccgctttacgtttaccttacaaaaacttggaaaaccacggccccttaggaacggaccggacccgggaatccgggaaaccgaccccggggtacccgttaggttaactttaaaccgttgggtcggaccggaaagggtacggaaacggttccggggggaaccccctaaaccgggtaaaaccccggtttacctaaaacccggggtcttaaacggtcgggggtaaccccggttccgggttacggggggaacccccgtaaacgggggtaaaaccccccgg

SEQ ID NO: 382088 - DNA, 570 bp, Homo sapiens
  misc_feature: GZ8MTXP02FRG84.13.76.G10.1.454.CMB.2.raw
  modified_base (476)..(476): a, c, t, g, unknown or other
  modified_base (495)..(495): a, c, t, g, unknown or other
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggcagataaatatacttctgtatcagcagaagtcaggccagtcccctgtcgctggtcatcatcaagtatcgacctaagccggccctacgacgggacctccccgtgacgtcgtacttcctcgttcgggcctacccaaacgttccgtaggggaaacctcgacgaccctactccgtagaccctagttacggaccgggacccaggcttagacggatggagctagacttagttactgtacgagggcgtgggacngacgacgctacgcgcccgntacgtcggttaccgttacggaactcgggggaacctaacggtccgtaccgttaccgtaaacgccgaacgaaccccg

SEQ ID NO: 382089 - DNA, 696 bp, Homo sapiens
  misc_feature: GZ8MTXP02FV1TT.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctattttaaaaggtgccagtgtgaggtgcagcgtggtggagtcgtgggagggaggtcttgactccgacggtcccggttcggggggtccctggacgtaccttccttccctggtcgcacgcccttcgttgggttccaccgtcacgtccaccacctacatggacgcgtcgggtccccgccgacggcctccggaaggggaacggggcgtggaggtcggtcgttctttacttttatttagttagtaggtaggtacgtacctactaccgtcgactacgaccgttcggtggggacggggccgtactaccacctactcctaccgaagaacaactaaactaccgaaagtaaccaccggttctttacgtttactaacaaaagtcgaaaacgcgtccgtaggaacgacgacccgtataccggacgacgggtcttagttactagtgcgaggaagaggtacgggtcccggaaaccctaacggttaaacgttaccgacgaacgtttacggacggggtaccgtcgggaccggggaaccgaacggggtaccccg

SEQ ID NO: 382090 - DNA, 629 bp, Homo sapiens
  misc_feature: GZ8MTXP02JY7Z7.13.76.G10.1.454.CMB.2.raw
  modified_base (396)..(396): a, c, t, g, unknown or other
  modified_base (418)..(418): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtcgtgggaggaggcttgatccagccgtggggggtccctgagactctcctgtgcagcctcgtgggttcaccgtcagtccacacctacatgagcgtgggtcccgccgaggcctccggaggggaacggggctgggagtggccgttcgtttctttttatttatagttaggtggtagtaccatacctccgacagaccgtcgngggacggggcctagttccaccntcctccagagaacattaccaagaacacgcttcgtttactacaaatcgaaactgcctagagacgccgtatcgacgtacgggtccgtagtacttacgtgtacggacgaggaggacggtaccgggggaccctaacggtaaaaccggtttcaacggtcgtaacggttacgggaaccggttcgggacgggggacccggaaacgggtaacccccggg

SEQ ID NO: 382091 - DNA, 656 bp, Homo sapiens
  misc_feature: GZ8MTXP02JPC1Q.13.76.G10.1.454.CMB.2.raw
  modified_base (268)..(268): a, c, t, g, unknown or other
  modified_base (377)..(377): a, c, t, g, unknown or other
tcagtcacgtactacacgaccggtgctcgatttagtcactcatacagggggggagaggagcccagcactgggattccgaggtgtttccattcggtgatcagcactgaacacagaggactaaccatggagttttggctgagctgggttttccttgttgctattttaaaggtgcccagtgtgaggtgcagctgggtggagtctgggaggaggcttgatccagccgtgggggtccctgagactctcctgtgcagcctcgtggtccaccgtnagtcacacctacatgagcgtcgggtccgccgaggcctaccggaggggacgggcgtggagtgcgttctttcgtttttattagtagtagtggtagtactacgtactccganacgtacgtccggtgggcgggggtccctagttcccacctactcctaccagaacgtactaaaccttaccaaacgtaacgtaccgtactttacgtttacttaacgaaagtacgaacgtacgaccgtagaacgtaccgacgagtacgaaccgtccggtacgttagttacttaccgtgtacgacggtagacggacgggtacggacccgtaaaggtaacccgttaacgaccgtacgtaagtacggtacggtaccgggcggtaccggaaccggaccgtaacccggg

SEQ ID NO: 382092 - DNA, 563 bp, Homo sapiens
  misc_feature: GZ8MTXP02FPGZQ.13.76.G10.1.454.CMB.2.raw
  modified_base (448)..(448): a, c, t, g, unknown or other
  modified_base (533)..(533): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccgtgagctctcctgtgcagcctcgtgggtcaccgtcagtcacacctacatgagcgtcgggtcccgccgaggcctccggaaggggaaggggcgtggagtgcgttcttcttttatttatagtagtggtagtacatacctcgcagacctcgtggacgggctattccacatctcagagacaataccaaagaccacgctttagtttctacgaaaatcgaaacngcctagacgcgaccgatcgaaccgcgggtccttagtacttacgtggagacgagagtagtccggggacccaacggtaactcctagngtacgtggacgtcgtcggacgacggaaccg

SEQ ID NO: 382093 - DNA, 670 bp, Homo sapiens
  misc_feature: GZ8MTXP02IVYIT.13.76.G10.1.454.CMB.2.raw
  modified_base (621)..(621): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgtcttaattttaaaaggtgcccagtgtgaggtgcagcgtggtggagtcgtgggagggaggtcttgactccgacggtcccggtcggggggtccctggacgacccctcctgtgcacgtcctcgtcgggttccacccgtcacgtcacacctacatgagcgtcgggtccgccgacggccgtccggaggggaaggggcgtggaggtcgtcgtctttctttttatttattagtagttggtagtactactacctccgcagccgtcggtcggcggggtccgtattaccacctactcctaccaggaacgaactaaacttaccaaagaaccgtacgtctttacgtttactaacaaaatcgaaaacacggtcctaggagtacgacgattaacggaccgtaccgggtctagtaacttacgtggtgaacggtacgagtacgggtccgggacccaaacggttaaccgttacgtacggntaacgtgggaccggttcggacgggggaccgaaacggggtcctaacccgg

SEQ ID NO: 382094 - DNA, 560 bp, Homo sapiens
  misc_feature: GZ8MTXP02IMUSG.13.76.G10.1.454.CMB.2.raw
  modified_base (494)..(494): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagcttgggttttccttgttgctattttaaaaggtgcccagtgtgaggtgcagctgggtggagtcgtgggaggaggcttgatccagccgtgggggtccctgagactctcctgtgcagcctctgggttcaccgtcagtcacacctacatgagctgggtcccgccaggcctccgaaggggaagggctgggagtgcgttcttcttttaattatagtagtggtagtacatactcgcagcgtccgtgacggggccagttcaccatctcagagacatacccaaagaccacgcttgttactacaaatcgaaacagccctgacgacgccgatgacgacggccgttagtacttacgtgtacgngagagagtcggggacccagtaaacgttaacgtaccgcgtagtacggaccgttcggacgggaacccg

SEQ ID NO: 382095 - DNA, 543 bp, Homo sapiens
  misc_feature: GZ8MTXP02FGDBY.13.76.G10.1.454.CMB.2.raw
  modified_base (449)..(449): a, c, t, g, unknown or other
  modified_base (486)..(486): a, c, t, g, unknown or other
  modified_base (534)..(534): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtcccgccaggcctccgaggggaggggctgggagtgcgtcttcttttattatagtagtggtagtacatactccgcagtctccggtggagggggccgattcacctatcctccagagacaattacccaaagaacacgcttgtttcttacaaaatgaaacngcctgaagagcccgatcgacacggccgtagtattacngtgcgagagatcggggacccagtaacgtaacacgctagtggacgtcgnggggacccg

SEQ ID NO: 382096 - DNA, 588 bp, Homo sapiens
  misc_feature: GZ8MTXP02H7RYR.13.76.G10.1.454.CMB.2.raw
  modified_base (249)..(249): a, c, t, g, unknown or other
  modified_base (362)..(362): a, c, t, g, unknown or other
  modified_base (464)..(464): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcngcctctgggttcaccgtcagtcacacctacatgagctcgggtccgccgaggctccgaggggagggctggagtgcgtcttcttttattatagtagtggtagtaccatcctccgnacgtacctcgtgggacggggtccattccaccagtcctaccgaagacgaactaaactcccaaagaaaccacgtccgttgtttaccttacgaaaatcgaaaacngaccctaggagtacgcgaatcgacgacggtccgtatattactggtgcgaggagacggtccgggacccacgtaacgttacgacgtcgtacgtacggaccgtggtaccgggaccgacgggtacccg

SEQ ID NO: 382097 - DNA, 716 bp, Homo sapiens
  misc_feature: GZ8MTXP02FYSFA.13.76.G10.1.454.CMB.2.raw
  modified_base (251)..(251): a, c, t, g, unknown or other
  modified_base (377)..(377): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagcgtggtggagtcgtggaggaggtcttgatccagccgtcggggggtcctgagactctcctgngcagcctcgtggtcaccgtcagtcacactacatgacgcgtgggtcccgccgaggcctaccggaggggaaggggcgtggagtgccgttctttctttatttagtagttagtggtagtacctactaccncgagacgtaccgtcggtggggccggacgttacttacccaacctactacctacgaaacggacaaacccttaaacgtaaccgaaaacgtaacctacggtccttttacgtttaactaactaaagtcgtaaaccgagtcccgtaaggaagacccgtacgtagtacccgaaccggcggttaccgttagttaacctaggtgaccggtacgggaagaccggggtacgggttaaccccggggacccgttaaaaccggttaaaccggttaccgtaaccggtaacgttaacggtacgggttaccggtcccgggggtaacgggaacccggttaaaccggggtaaccccgg

SEQ ID NO: 382098 - DNA, 601 bp, Homo sapiens
  misc_feature: GZ8MTXP02HRPQH.13.76.G10.1.454.CMB.2.raw
  modified_base (453)..(453): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctggggttcaccgtcagtcacacctacatgagctcggggtccgccgaggcctccgaggggaaggggcgtggagtgtcgttcttactttttatttatagtagtggtagtaccatacctccgcagacctcgtggacggggccattccacctatctacccagagaactaacttacccaaagaaccacgtctttgtttacttanaaatgaaacacgtcctagagacgaccgatcgaaccgtacggtccgttgttattacgtgtcgacgtaggagtacggtcggggacccctacggtaaccgttacgtacggtctaagtcggtacgtcggtacggggacctaacggggacccg

SEQ ID NO: 382099 - DNA, 620 bp, Homo sapiens
  misc_feature: GZ8MTXP02JI0WU.13.76.G10.1.454.CMB.2.raw
  modified_base (439)..(439): a, c, t, g, unknown or other
  modified_base (451)..(451): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttgatccagccgtggggggtccctgagactctcctgtgcagcctctgggtcaccgtcagtcacacctacatgagcgtcgggtccgccgaggcctccgaggggaaggggctggagtgcgtcttctttttattatagtgtggtagtacatacctcgcagactccgtggacggggccgattccaccatctccagagaccaattaccaaagaacctagcttgttttcctaaanaaatacgaaacncgctaggacgacgaccggaatacggaaccgtaccgggtcgttagttaacgttacgtggtacggacggaaggaacggtacgggtaccggggaccctaaacggttaaaccggttacaccgtaacgtacggtacgggtaccggtacgggaccggggaccgaaaccggggccg

SEQ ID NO: 382100 - DNA, 643 bp, Homo sapiens
  misc_feature: GZ8MTXP02G35BJ.13.76.G10.1.454.CMB.2.raw
  modified_base (268)..(268): a, c, t, g, unknown or other
  modified_base (309)..(309): a, c, t, g, unknown or other
  modified_base (314)..(314): a, c, t, g, unknown or other
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcacgcccaccctcagtcgtccgtcgtccccaggaccagacacgccagcatcacctgctcgtaggaaattaagtggacaagtaataaattatacttccgtagtactnagcagaagtcaggccagtcccctgtcgtcgtggtcatctancaagntcgacaacgccgtccctagacggtacctcccgtaggacgtacgtattccgtacgtcgggccttacccaacgtccgtacggggtaacctcgaccgtaccctacttacctacgacctacgtccgaaccgggacccggggaacccgacgggtactacggtaggtatcggggaaagtccgttacgtaacgttagtttacgcggtacggtaacgggtcggtacgggacgtacgacgacgacgtacgtccggtacgtccttggtcgttaccggtacggtaccggtaacggaacctaacggtaccgtaccgtaacccgttacggacccaaacccgg

SEQ ID NO: 382101 - DNA, 556 bp, Homo sapiens
  misc_feature: GZ8MTXP02JMA7E.13.76.G10.1.454.CMB.2.raw
  modified_base (295)..(295): a, c, t, g, unknown or other
  modified_base (448)..(448): a, c, t, g, unknown or other
  modified_base (488)..(488): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggaattggggctgagctgggttttccttgttgctattttagaggtgtccagtgtgaggtgcagctggtggagtcgtgggggaggcttggtccaggccgtggggggtccctgagactctcctgtgcagcctctggattcacctttagagctattggatgagcgtgggtccncgaggctccgaggggaaggggctgggagtggggtgaccaacgataaagcaaagttggaaagtgaagaaatactatgtggactcgtgtgaagggccgtattcacatctaccagagacaacgccaaagactcactgtatctagacaaatgaaacngcctagaagcgaccgaggtaccacggctgtactattacgnggtacgacgagagtaggttacgggggagtaaggtgtaaggctagggtcgactaacggttactttacgg

SEQ ID NO: 382102 - DNA, 660 bp, Homo sapiens
  misc_feature: GZ8MTXP02FQW15.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggtttccttgttgctatttaaaaggtgcccagtgtgaggtgcagctggtggagtctggaggaggcttgatccagccgtggggggtccctgagactctcctgtgcagcctcgtggttcaccgtcagtcacacctacatgagcgtcgggtcccgccgaggcctccggaaggggaacggggcgtgggaggtgccgttcttactttttagtttagtagtagtggtagtaccatacctccgacagaccgttccgtgggacgggggcccgtattccacctattcctacccgaagaacgtaaacctaaattacccaaaagaacctacgtctttagttttaccctaacaaaactgaaaaccagtcctaggacgacgacccggaatcgaacgtaccgggtccgttaggtattacgtgggtacgacggaaggaggtaacggtcgggggaaccccaaacggtaaaccgttactaacggccgttaaggtcggtaacgtcggtacgggggacccgaaacggggtaccccg

SEQ ID NO: 382103 - DNA, 646 bp, Homo sapiens
  misc_feature: GZ8MTXP02F2E8O.13.76.G10.1.454.CMB.2.raw
  modified_base (448)..(448): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctcgtgggtcacccgtcagtcacacctacatgagccgtgggtcccgccgaggcctccgaggggaggggctggagtgcgtctcttttattatagtagtaggtagtaccatactccgcagacgtccgtggaggggcccgattccaccatctccagagaaccaattacccaagaaaccacgctttgttttacccttaaanaaagtacgaaacgtacggtacgtagaacggacggaccgaagtcggaaccgtaccgggtaccgttagttaacgttacgtggtacggacggtaaaggacgggtacggtacccgggggacccctaaacggttaaacccgttacaccggtaagttacggtacgggtaccgtcgggtacggggaacccgaaacggggtacccg

SEQ ID NO: 382104 - DNA, 778 bp, Homo sapiens
  misc_feature: GZ8MTXP02JOFDB.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggaggaggtcttgactccgagccggtcgggggtccctgacgtactctcctgtcgcacgtcctcgtcggtcaccgtcacgtcacacctacatgacgcgtcgggtccgccgaggcctccggaaggggaacggggtcgtgggagtcggtcgttctttactttttaagtttacgtaggttaggtacggttacgtacctacttaccgtccgacgacgtaccgttccggtggggacgggggtcctacgttcccgaacctactcctacccgaaagactaaacctaaacttacccgaaaagtaacccgtacgttcgtttaacgttttaccttaaacgaaaacttacgaaaacctcggtaccctagggaacggtacggtaccgagttaccggaaccggacccgggttcgttaagttaccgtttaacgtggtaacgacggaaggtaacggtacggggttacccggggaaaccctaaaccgggtttaaaccgtttaaacccggtacgttaaccgtaacggggttaccggggtacccgggtacgggtacccgggggtaaaccggaacccggggtttaaacccccggg

SEQ ID NO: 382105 - DNA, 661 bp, Homo sapiens
  misc_feature: GZ8MTXP02I72ED.13.76.G10.1.454.CMB.2.raw
  modified_base (484)..(484): a, c, t, g, unknown or other
  modified_base (498)..(498): a, c, t, g, unknown or other
  modified_base (613)..(613): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtgggaggaggcttgatccaggccgtgggggtccctgagactctcctgtgcacgcctcgtgggttccaccgtcagtcaccacctacatgagcgtcgggtcccgccgaggcctaccggaggggacggggcgtggagtcgtcgtttctttctttttatttagtagtagtaggtagtaccataccgtcgcagaccgtcggtgggacgggcctagtccacctacgtcctacgagaacgaacctaaacttaccgaaagtaacccgtacgttcttacgttttaacccanaaaagttcgaaacngtaccgtaggaacgacgaccgagtacgaccgacgggtaccgtagttacgttacgtggtacgacggaaggacggtacggtccgggaaccccctaaggtaacccgttacgtaaccgngtaacgggtcgggtaaccgtcggtacggggacccggaagggtaccccg

SEQ ID NO: 382106 - DNA, 718 bp, Homo sapiens
  misc_feature: GZ8MTXP02IK3S7.13.76.G10.1.454.CMB.2.raw
  modified_base (284)..(284): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtgggaggaggcttgatccagccgtgggggtccctgagactctcctgtgcagcctcgtggttcaccgtcagtcaccacctacntgacgcgtcgggtcccgccgaggcctccggaaggggacggggctgggagtcgtcgttctttctttttattagtagtaggttggtacgtacctactacccgacgacgtacgtaccgttcggtgggggccgggtaccttacgtacccaccgtactacctaccgaaagtacgaaaccttaactaaccgaaaacgtacccgtacgtttccgttttaactttacctaaaactaaaacgacgaaaccgaaccggttccgtaaagggacgacccgtacgtaaccttacggaaaccggttccccggggtatttaagttacgtttcggagacggaaggaacgtacggggtaccgggtaccccgggaaaccctaaccggtttaaaccgcgtaaccgtgtaacgtacggggtacgtcgggacccgggaacgtaaccggtacccgg

SEQ ID NO: 382107 - DNA, 580 bp, Homo sapiens
  misc_feature: GZ8MTXP02GOB4I.13.76.G10.1.454.CMB.2.raw
  modified_base (269)..(269): a, c, t, g, unknown or other
  modified_base (366)..(366): a, c, t, g, unknown or other
  modified_base (464)..(464): a, c, t, g, unknown or other
  modified_base (493)..(493): a, c, t, g, unknown or other
tcagtcacgtactacacgaccggtgctcgatttagtcactcatacagggggggagaggagcccagcactgggattccgaggtgtttccattcggtgatcagcactgaacacagaggactcacccatggagttttggctgagctgggttttccttgttgctattttaaaaggtgcccagtgtgaggtgcagctggtggagtctgggaggaggcttgatccagccgtggggggtccctgagactctcctgtgcagcctctggttcaccgtnagtcacacctacatgagcgtgggtcccgccaggcctccgaggggaaggggctggagtgcgtcttcttttattatagtagtggtagtacatactccgnacgactccgtggacggggccattccacactcgtccagagacaagttccaaagaacacgcttagtttacttcaaatcgaaactagcctagagcgaccgntacgacacgggccgtagttatactggtcncgagagacggtacgggggacccaaccggtaacgtaactacgtaaccgtagtcggtaccgtcgtacggggccgtaaacggggaccccg

SEQ ID NO: 382108 - DNA, 759 bp, Homo sapiens
  misc_feature: GZ8MTXP02IEIPO.13.76.G10.1.454.CMB.2.raw
  modified_base (264)..(264): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtccctgagactctcctgtgcacgcctcgtgggttcnccgtcagtcacacctacatgagcgtcgggtccgccgaggcctaccggaggggaacgggggcgtaggggtaggtcggtccggtttctttacttttttaagtttaattaaggttaggttaggggttaacgttaccctaacgttaaccctcccggtacaacggtaacccgttcccgggttacggggacggggggtaccccgtaacgttttacccgaacccctaacttcccttaccccgaaagggaacgaaccctaaaacgtttcccaaaaaacggaaacccgtaaccggtccttttaggtttttaccccttaaaactaaaacgttacgaaaccgtaccggtaccgtagggaacgaccggaccgtagtaccggacggtaccggttacgttacgttacttacggtggacggacggaggtacggtacggtaccgggaaccctaacggtaacgtttacgacgtcgtagtacggtacggtcggacggggaaccgaacggtccg

SEQ ID NO: 382109 - DNA, 608 bp, Homo sapiens
  misc_feature: GZ8MTXP02HSGF5.13.76.G10.1.454.CMB.2.raw
  modified_base (271)..(271): a, c, t, g, unknown or other
  modified_base (344)..(344): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtcgggttcaccgtcngtcacacctacatgagcgtcgggtcccgccgaggctaccggaggggaaggggcgtagggagtggcgttctttnttttatttagtagtagtggtagtaccatacctccgcagacctcgtggacggggccagttccaccatctaccagtacacaacttaccaaagaaccagtcttgtttactacgaaatgaaactcggacctggaagcgccgaatcggaacacgggccgttagtaattcgtgtcgacgaggagtacggtcggggaaccccacgggtaaacctttaccgagaaccttagtacggggaccgttcggacgggggacaaaccgggggtacccg

SEQ ID NO: 382110 - DNA, 638 bp, Homo sapiens
  misc_feature: GZ8MTXP02GKZSZ.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtgggtccgccgaggctccgaggggaggggcgtggagtgcgtcttcttttattatagtagtggtataccatactcgcagactcggtggcggggcctattccaacctatcctccaagacgaactaaacttaccaaaacgaacacgtccttgtttaccttacaaaattcgaaactacgtcctaggacgacgtccgaatacgaccgaccgggtaccgttagttacttaccgtgggttcgacggtaacggaggtacgggtaccggggaccccaacggttaaaaccgttacgaaccgtaacgttaacggtcggggtaacgttccgggacgggggaccggtaaaacggggacccccgg

SEQ ID NO: 382111 - DNA, 569 bp, Homo sapiens
  misc_feature: GZ8MTXP02HHLRH.13.76.G10.1.454.CMB.2.raw
  modified_base (295)..(295): a, c, t, g, unknown or other
  modified_base (386)..(387): a, c, t, g, unknown or other
  modified_base (394)..(394): a, c, t, g, unknown or other
  modified_base (405)..(405): a, c, t, g, unknown or other
  modified_base (424)..(424): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagctgggtccnccaggcctccgagggaggggctggagtgcgtcttcttttattatagtagtggtataccatactccgcagacctcgtggaggggcatcaccnnctcaganacatcaagacngctgttctacaaatgaacngcctgacgacgccgaatcgaacgacggtccgttagttacttacgtgtacgacgaggaggtaggtccgggggaccccaaacggtaaccgtttacctacgtcgttaagtcggaccggttcgcgggggaacccgaacgggggaccccg

SEQ ID NO: 382112 - DNA, 701 bp, Homo sapiens
  misc_feature: GZ8MTXP02HA3R4.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttcctgttgctatttaaaggtgccagtgtgaggtgcagctggtggagtcgtggaggaggcttgatccgagccgtgggggtccctgagactctcctgtgcagcctcgtgggtcaccgtcagtcacacctacatgagcgtcgggtccgcaggctaccggaggggagggctgggagtgcgttcttctttttaattagtaggttagtggttaagtactataccgtccgacgacgtacccgtcgggacggtacgggggcctattccaacctactcctacccgaaggaacgtaactaacttaacccaaagtaaccgacgtactttcgtttacttaacaaaagttacgaaaccgagttacccgtaggaaacggtaacgccccgtaaaagtccggaaaccggtaaccggggttcccgtttaggtttaaaacttaccgggtttacggggtacgggaacgggtaaacggggtaacgggtaccgggtacccggggaaccctaaaccggtaacgttaaccgtacggtacgtacgggtcggtaccggtcgggaaccgggaccgg

SEQ ID NO: 382113 - DNA, 661 bp, Homo sapiens
  misc_feature: GZ8MTXP02HBMFC.13.76.G10.1.454.CMB.2.raw
  modified_base (256)..(256): a, c, t, g, unknown or other
  modified_base (468)..(468): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagccctntgggttcaccgtcagtcacacctacatgagcgtgggtcccgccgaggctccggaggggaggggctggagtgcgttcttcttttattatagtgtggtagacctatactcgacacgactcgtggacgggccgattccgacctatcctcccaagacaacctaattccgaaaagaacctcgtctttcgttttacctaactaaaagtggaaaacccncgtaccgtagaacgacgtaccgtagtaccgaccgtaccgggtacgttagttacgttacgtggtacggacggtaagggtacggccgggttaacccggggacccctaaaacggttaaacccgttaccgtaacggtcggttaacggtccggggttacggtcccggggtaccggggaaacccggaaccgggtacccg

SEQ ID NO: 382114 - DNA, 761 bp, Homo sapiens
  misc_feature: GZ8MTXP02H3VHR.13.76.G10.1.454.CMB.2.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagcccaccctcagtcgtccgtcgtccccaggaccagacagccagcatccacctgctactaggaaaataattggacaagaataaaatattaacttccgtaggttatcagacaaggaacgtcgaggacccacgtccccgtaggtcgtccgttggtaccattcctaatacgtaaagtatacgacccgaacggcccggtacccctcggaacgggtacctcccccgtagaccggcgtatttccgtcgtcggtccttacccgtaaagtcccgttacggggaaccttccggaaaccctaccctaccgtaccgtaccgtacctacgtaccggaaccgggtaccccgggaacccgtacggtacgtaacggtggtaacgtacgggtacggtaccttaacggttaacgtttaacgtttacggtccggtacggtacggggtcggtacggaacgacggaccgacgtaccgtaccggtcccgtacccgttacgttaccggttaccggtttaccggttaaccggggtaaccggtacccggggtaaaaccgttaacccggttaccccgttaaaccccgggttaacccgtaaccggtaacccgaacccggaacccccg

SEQ ID NO: 382115 - DNA, 567 bp, Homo sapiens
  misc_feature: GZ8MTXP02HZYH3.13.76.G10.1.454.CMB.2.raw
  modified_base (405)..(405): a, c, t, g, unknown or other
  modified_base (419)..(419): a, c, t, g, unknown or other
  modified_base (441)..(441): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtggttcaccgtcagtcaccacctacatgagctcgggtccgccaggctccgaggggaacggggctggagtgtcgttcgttcttttattagtagttagtggtagtactatactcgcagcgtccgtgcggggccgtatcacatctacaganacaatccaaagacngctgtttactacaaatgaaacngacctgaagcgaccgatcgaacgcggccgttagtacttacgttggacgagaggacgacgtacgggggccccaaaggaacctttaacgaccgtacgttaagcgggtaacgtcgtacgggggaacccg

SEQ ID NO: 382116 - DNA, 601 bp, Homo sapiens
  misc_feature: GZ8MTXP02I8B8W.13.76.G10.1.454.CMB.2.raw
  modified_base (457)..(457): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtcggggggtccctgagactctcctgtgcagcctcgtgggttccaccgtcagtcacaccacatgacgcgtcgggtcccgccacggcctccggaggggaaggggcgtgggagtgcgttcttcttttatttatagtagtgtatacatactcgcagacgtccgtggcggggcctagttcacctatcctaccgagagaacaacttaccaaagaacactcttgtttactaacaaatcgaaancgcctagagacgccgaagtcggaccgacggtccgtaggttattaccgtggacgacgagaggacggtacgggggacccctaacggtaaaccgttccaacgccgtagtcgggacgtcggtacgggggaccgtaaacggggaccccg

SEQ ID NO: 382117 - DNA, 521 bp, Homo sapiens
  misc_feature: GZ8MTXP02G3EH1.13.76.G10.1.454.CMB.2.raw
  modified_base (295)..(295): a, c, t, g, unknown or other
  modified_base (359)..(359): a, c, t, g, unknown or other
  modified_base (422)..(422): a, c, t, g, unknown or other
  modified_base (427)..(427): a, c, t, g, unknown or other
  modified_base (431)..(431): a, c, t, g, unknown or other
  modified_base (434)..(434): a, c, t, g, unknown or other
  modified_base (443)..(443): a, c, t, g, unknown or other
  modified_base (465)..(465): a, c, t, g, unknown or other
  modified_base (471)..(471): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtctggaggaggcttgatccagccgtgggggtccctgagactctcctgtgcagcctctgggttcaccgtcagtcacacctacatgagctgggtccnccaggctccgagggaagggctggagtgcgtcttcttttattatagtagtgtagtacatactcgnagctccgtgacggggccgattcaccatctccaagagacaatcccaaagacacgctgttctaanaaatnaacngcngagacgcancgacgacggcgtatatacgtgngagagngacgcgggacccaagaacgtaacgacgactagcggacgtcggacgggacg

SEQ ID NO: 382118 - DNA, 758 bp, Homo sapiens
  misc_feature: GZ8MTXP02IA2ST.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagctgggtggagtcgtgggaggaggtcttgactccaggccggtgggggtccctgagactctctgtgcacgtcctcgtcgggtcaccgtcagtcaccacctacagtgacgtcgtcgggtcccgccgacggccgtaccggaggggaacggggcgtggaggtcgtcgtttcttctttttaattagtagttagtggtataccactacctccgacgacgtaccgtcggtgggaccgggggtcctacgttccaacctacgtacctacccaaggtaacaacctaaacttacccgaaaacgaaaccgtaccgttactttacgttttacctaaccgtaaaattacgaaaaccgtcggtaccccgtagggaacgtaccggaccggtaagtacggaaacccggaccggggttcccgttaagtttaaccgttcggttacggttcggaaccggtaaaggtacgggtaaccggtacccgggggaaacccctaaaccggtaaaccggtttaccgtaaccggtaacgttacggtacgggtaaccggttccgggtaccgggggaacccgaaaccggggtacccccgg

SEQ ID NO: 382119 - DNA, 700 bp, Homo sapiens
  misc_feature: GZ8MTXP02GNF4C.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactaaccatggagttttggctgagctgggttttccttgttgcttattttaaaaggtgcccagtgtgaggtgcagctgggtggagtcgtgggaggaggcttgatccagccgtgggggtccctgagactctcctgtgcagcctcgtgggttccaccgtcagtccacacctacatgagcgtcggggtccgccgacggcctaccggagggggaagggccgtagggacgtgtcgttctttctttttatttagtaggttacgtggtagtacacgtacctccgacacgtaccgtaccggtgggacgggggccctattaccgacctactccctaccgaagaacgaacctaaacgttacccaaaacgtaaccgaaccgtcgtttacgttttacttaaccaaaagttacgaaacctacggtcccgtaaggaacggtacgacccgagttacggaaccctaaccggggtcccgttaggtactttaccggtgtacggacgaaggtagacgggtacccggggacccctaacggtaaaccgttaccgacgtactaaggtcggacgttccggacggggaccgaaaacggtccccgtacgg

SEQ ID NO: 382120 - DNA, 633 bp, Homo sapiens
  misc_feature: GZ8MTXP02JTA2Q.13.76.G10.1.454.CMB.2.raw
  modified_base (242)..(242): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcacgccgccctcagtgtccgtcggggccccagggcaggagggtccaccatctcctgcactggggancagctaccaacagttgggcacattatgatcgtacacgtggtacccagtctacgtttccgaaggtacgcgacggtccccaacggtacctcctacactactaaactaaccgtaaacaaaccgtaaacgtcccggacccgaccggtacggggtcccctacggacccgtacgttccgtcgtcggccctccgtacgtcgtccggcctaccctcgacccgtccctcccgtcggtacctactccgtacgtcgggccttccgacggtccgtaggacggtagtcggaggtcgttgtagtttacttcgtcgtacctacgtactagtacgaacgcgacgacggtccgtggtaacggtcgttacgttcggtacgggttccggggaccgggggtaccgtacggg

SEQ ID NO: 382121 - DNA, 580 bp, Homo sapiens
  misc_feature: GZ8MTXP02I38QB.13.76.G10.1.454.CMB.2.raw
  modified_base (295)..(295): a, c, t, g, unknown or other
  modified_base (418)..(418): a, c, t, g, unknown or other
  modified_base (486)..(486): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctggggttttccttgttgctattttaaaaggtgcccagtgtgaggtgcagctggtggagtctggaggaggcttgatccagcctgggggtccctgagactctcctgtgcagcctctggggttcaccgtcagtcacacctacatgagctgggtcccnccaggctccgagggaggggctggagtgcgtcttcttttatttatagtagtggtagtaccatactccgacagtacctcgtgacggggccattccaccatctccagagacaataccaagacacgntgtttctacaaagtgaaactagccctaggacgtagccggaatcgaacgaccggtcgtagtacttacgngttagacggtagagacggtcgggggaccctacggaaacgttacgtaacgaaccgtagtacggacgttcggcggggacccgaaaggggaaccccg

SEQ ID NO: 382122 - DNA, 619 bp, Homo sapiens
  misc_feature: GZ8MTXP02FX2N2.13.76.G10.1.454.CMB.2.raw
  modified_base (459)..(459): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggtcaccgtcagtcacacctacatgagcgtgggtcccgccgaggcctccgaggggaaggggctggagtgcgtcttcttttatttatagtagtggtagtacatactcacagacctccgtggacggggccgtattccacctatcctaccaagacgaactaacttacccaaagaacacgcttgtttactacaaaatgaaaaccncgctagacgacgaccgaatacgacgtacggtcgttagtacttacgtgtacggacggaggaggtacggtaccggggaccctaaacggtaaaccgttaccgtaacggtaacgttacggtaccgggtacggttcggacgggggaacccgtaacggggtacccg

SEQ ID NO: 382123 - DNA, 607 bp, Homo sapiens
  misc_feature: GZ8MTXP02JETVI.13.76.G10.1.454.CMB.2.raw
  modified_base (278)..(278): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggactagataaatatacttctggtatcagacagaagtcaggccacgtccccngtgctggtcatctatcaagactgacctaaggccgacctcgacgggactccccccgtagacgccgtactttcgcgttcggcctacccaaacgttcgtacgggaacctcgacgccctactctacgaccactcgacggacccggaccaggtctagaggataggacgtctacggtacttagttacgtacggtacgacgggtcggttaggggaacacgggacgaacgtccgtaacgtccggaccccgtaagttacgttacggttaccgtttaacggaacgtacgggaacccgtaagggtaccctaccggtacgttacgtaccgaaccgaccccg

SEQ ID NO: 382124 - DNA, 626 bp, Homo sapiens
  misc_feature: GZ8MTXP02IEFZS.13.76.G10.1.454.CMB.2.raw
  modified_base (446)..(446): a, c, t, g, unknown or other
  modified_base (476)..(476): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggtcaccgtcagtcacacctacatgagctcgggtcccgcgaggcctcgaggggaaggggctggagtgcgttcttctttttattataggtagtcggtaagtacataccgtccgacacgaccgtccggtagggacgggggccctagttcaacctatccctcaagagaacctaattacccaaagaaccncgtcttgtttacctataaaattcgaaaacncggtaccctagggacgaacgacccgagtacgaacgaaccgggtccgttagtaaacttcgtggtacggacggtagaggacgtccgggggaaccctaacggtaaacctaacgtacgacttacggtcggtaccggtcggtacggggaacccgg

SEQ ID NO: 382125 - DNA, 714 bp, Homo sapiens
  misc_feature: GZ8MTXP02JD8VD.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttttggcttattttaaaaggtgtccagtgtgaagtgcagctggtggagtcgtgggggagcttggtacagcctggcaggtccctgagactctcctgtgcagcctcgtggattcacctttgatgattatgccatgcacgtggtccgcagctcgagggacggctggaggtggtctcgaggttattagttggaagtgtggtagctagtaggctagtcggcggactcgtggtagaacggggtcctaattcccaccctatccctacccgaagacgaacccaaaccgacccgaaacgtaaccccttcccgtagttaacttaccttacggaaacctaaaaagttacgaaaacccgtacggtaccccgttaagggaacggtaaaggccggtaggaaaccgggaaccgtaaccgggttacccgtttacgttaagtttagtttacggtaacgtaaaaccgtaaaaacggtaaacccttaacccccgttaaaacccccgtttaaggttaacgtttttttacggggaacggtttacgggtttaaaccgtttaaaccggtacggggtttaccggggg

SEQ ID NO: 382126 - DNA, 566 bp, Homo sapiens
  misc_feature: GZ8MTXP02JYT0O.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagctgggtccgccaggctccgaggggaggggctggagtgcgtcttcttttattatagtagtggtagtacatactcgcagactcgtggagggccatcacatctccagagacaataccaaagacacgcttgtttctacaaatgaacagcctgagagaccgatcgacgacggccgtagtacttacgtgtcgacgaggagacggtacgggggaccctaacggtaacgttaccgtacgtcgtacgtacgggacggtccggtacgggggacccgaacggggaccccgg

SEQ ID NO: 382127 - DNA, 604 bp, Homo sapiens
  misc_feature: GZ8MTXP02JHTIB.13.76.G10.1.454.CMB.2.raw
  modified_base (298)..(298): a, c, t, g, unknown or other
  modified_base (347)..(347): a, c, t, g, unknown or other
  modified_base (360)..(360): a, c, t, g, unknown or other
  modified_base (503)..(503): a, c, t, g, unknown or other
tcagtcacgtactacacgaccggtgctcgatttagtcactcatacagggggggagaggagcccagcactgggattccgaggtatttccattcggtgatcagcactgaacacagaggactcaccatggagttttggctgagctgggttttccttattactattttaaaggtgtccagtgtgaggtgcagttggtggagtctggaggaggcttggtccgagggccgggggggtccctggagactctcatgtgcggcctcgtgggctcaccgtcaacaccaactacatgagctgggtcccnccaggcctccgaaggggacgaggccggagtgggctcgagtttatttagngtcgacgtgccanattcacgcagactccgtggacggggccgttcgaccatcctaccagacgacaattaccaagaaccacggtgtatcttacaaagtacgaacgacctagagagtcgaggacaccggccgtacgtacttacgtggtagacgtaaagngtgacaggacggaccggaccccgtaaggtcggggccgttagggtcggtaggtttccgttcgtttcgacgtcggtacgtccggggtacgacgggtaacccgg

SEQ ID NO: 382128 - DNA, 632 bp, Homo sapiens
  misc_feature: GZ8MTXP02HN396.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtctgggaggaggcttgatccagccgtgggggtccctgagactctcctgtgcagcctgtcgggttcaccgtcagtcaccacctacatgagcgtgggtccgccgaggcctccggaggggaaggggctggagtgcgttcttcttttattatagtagtggtagtacatactccgacagacgtccgtggacggggccattccacctatcctaccgaagaacgaactaactaccgaaagtaaccacgtcttacgtttactaacaaatacgaaactagccgtagagacgacgatcgaaccgacgggtccttaggtacttacgtggtgacgaaggacggacgtccgggggaaccctaacggtaaaccgtttaccgaacggtaacgttaacggtacgggtaccggttacggaccgggggaacccgtaaacggggaaccccgg

SEQ ID NO: 382129 - DNA, 697 bp, Homo sapiens
  misc_feature: GZ8MTXP02HWX3M.13.76.G10.1.454.CMB.2.raw
  modified_base (170)..(170): a, c, t, g, unknown or other
  modified_base (234)..(234): a, c, t, g, unknown or other
  modified_base (244)..(244): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcactgctctagaaataatggacagataaatntactcagtancagcagagtcaggccagtcccctgtcgctggtcatactatacaagatcgacctaaggcccggaccctacggacgggtaacctcccccgtaggacgccgtactttcgtaccgtcggtcctacccgtaaccttccggtaccggggtaaacctccggaactacccctaccttaccgtacggaacccagtaccgaaccgggacccgggaccccgagggtacctaggtacgggtaactagggtaacgggtacttacgggtaacttaacgtttacggtacggttaccgaggggtacggtaacgggacgaaggccaacggtaccgtaacgtccggtccccgtagttacggttaccgttacgggtttacccgggaacggttaccgggggaaaacccgttaacggttacccggtaaacccggttaccgttaaacccggtaccgtaacccggtaaacccccgg

SEQ ID NO: 382130 - DNA, 550 bp, Homo sapiens
  misc_feature: GZ8MTXP02I2D5M.13.76.G10.1.454.CMB.2.raw
  modified_base (455)..(455): a, c, t, g, unknown or other
  modified_base (475)..(475): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggttcaccgtcagtcacacctacatgagctgggtccgccaggctccgaggggaggggctggagtgcgtcttcttttatttatagtagtggtagtaccatactcgcagacctccgtggacggggccattccaccatctccagagacaatccaaagaacacgcttgtttcttacaaatgaaacagcctagagacgcgangacacgggtcgtgtattacnggtgcgagagagtcgggggacccacggaaccgttcacgcgtagtcggacgtcgtcggggacctaacggggacccg

SEQ ID NO: 382131 - DNA, 647 bp, Homo sapiens
  misc_feature: GZ8MTXP02JS6XF.13.76.G10.1.454.CMB.2.raw
  modified_base (115)..(115): a, c, t, g, unknown or other
  modified_base (138)..(138): a, c, t, g, unknown or other
tcagtcacgtactacacgaccggtgctcgatttagtcactcatacagggggggagaggagcccagcactgggattccgaggtgtttccattcggtgatcagcactgaacacaganactcaccatggagttttggctgngctgggttttccttgttgctattttaaaaggtgcccagtgtgaggtgcagctggtggagtctggaggaggcttgatccaggccgtggggggtccctgacgactctcctgtgcacgtcctcgtcgggttcaccgtcacgtcacacctacatgagcgtcgggtccgccgacggcgtccgagggaaggggcgtggagtcgtcgttcttacttttattatagtagtaggtagtaccactactccgacagcgtcggtcggacgggggtccctacgtcaccactactccaacgagaacaaacttaccaaacgaacgacgtcttacgttacttacaaactacgacacgctacggagacgaccgaagtcccgacgtaaccggtaccgttagtagttaaccgtggtacggacggaacggagaacggtccggggtaacccgaaccgtaacgttaaccgtaccgtaacgtacggtcgggtaccggtacggtaccggggaacccggaacgggaaaccccgg

SEQ ID NO: 382132 - DNA, 676 bp, Homo sapiens
  misc_feature: GZ8MTXP02H370K.13.76.G10.1.454.CMB.2.raw
  modified_base (300)..(300): a, c, t, g, unknown or other
  modified_base (336)..(336): a, c, t, g, unknown or other
  modified_base (481)..(481): a, c, t, g, unknown or other
  modified_base (523)..(523): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttattttaaaaggtgcccagtgtgaggtgcagcgtggtggagtctgggaggaggcttgatccagccgtgggggtcctgagactctctgtgcagtcctcgtcggttcaccgtcagtcaccacctacatgacgcgtcggtccnccgaggcctccggaggggagggcgtggagtgcgttntttacttttatttagtagtaggtacggtagtacctatacctccgatacgtaccgcgtgggacggggtactacgttccaccgtactcctaccgaagtacaacctaaacgttacccaaagaacctacgtctttacgtttacctaaanaaattacgaaaccgtagtacctaaggacgacggaccgttaanacggaccgaccgggttacgtagttaccgttaaggtgttaaacgggacggtaaacggtaggaccggtaccgggaacccgtaaacggttaccgttaacgtacgtaacgttacggtaccgggtcgtacgggaccggggtaaccggaaaccgggccg

SEQ ID NO: 382133 - DNA, 609 bp, Homo sapiens
  misc_feature: GZ8MTXP02IPJJR.13.76.G10.1.454.CMB.2.raw
  modified_base (370)..(370): a, c, t, g, unknown or other
  modified_base (395)..(396): a, c, t, g, unknown or other
  modified_base (405)..(405): a, c, t, g, unknown or other
  modified_base (445)..(445): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtccctgagactctcctgtgcagcctcgtggttcaccgtcagtcacacctacatgagcgtcgggtccgccaggcctccggaggggaaggggcgtggaggtgccgttcttcttttattatagttagtggtagtacatactcgnagactccgtggacgggcgatcaccnncctcagtanactaataccaagaacctacgcttgttctacaaatcgaacngtcctgagagcccgaatcgaaccgtacggccgtagttacttacgtggtagacggaaggaggtacggtaccgggggaccccctaaacggggtaaaacttttccgaaccgcgtttacgtacggggtaccgtccgggtacgggggaacccgtaaacggggaaccccg

SEQ ID NO: 382134 - DNA, 582 bp, Homo sapiens
  misc_feature: GZ8MTXP02JUZLT.13.76.G10.1.454.CMB.2.raw
  modified_base (462)..(462): a, c, t, g, unknown or other
  modified_base (504)..(504): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtcgggtccgccgaggcctccggaggggaaggggctgggagtggcgttcttacgtttttattatagtagtggtataccatactccgcagactcgtggaggggccgtattccaccagtcctccaagagaacaacttaccaaagaaccacgtcttgttttacctacaaatcgaaacncgtacctgagagcccgatcgaacgacggccgtagtattacgngtcgacgagagagtacggggacccacggaaccgttacacgcgtagtcggtacgtcggtcggggaccaacgggtacccg

SEQ ID NO: 382135 - DNA, 594 bp, Homo sapiens
  misc_feature: GZ8MTXP02IVF60.13.76.G10.1.454.CMB.2.raw
  modified_base (295)..(295): a, c, t, g, unknown or other
  modified_base (362)..(362): a, c, t, g, unknown or other
  modified_base (376)..(376): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagctgggtccnccaggctccgagggaggggctggagtgcttcttacttttatttatagtagtgtagtaccatacctcncagacctccgtggngggccattccaccatcctaccagacgacaacttaccaaacgaacacgtccttagtttaccttacaaatgaaacgacgtcctagacgacgaccgatcgaccgacggtccgtagttacgttacgtgttcggacgaaggagacggtacggggaccctaacggtaaaccgttacgtaacgcgttagtacggacgtcgtacgggggacccaaaggggtacccg

SEQ ID NO: 382136 - DNA, 577 bp, Homo sapiens
  misc_feature: GZ8MTXP02G04GW.13.76.G10.1.454.CMB.2.raw
  modified_base (423)..(423): a, c, t, g, unknown or other
  modified_base (437)..(437): a, c, t, g, unknown or other
  modified_base (531)..(531): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtccacaccctacatgagcgtgggtcccgccgaggcctccggaggggaaggggctggagtgcgtcttcttttatttatagtagtggtataccatactcgcagacctcggtggacgggctattccaccatctccagagacaaatccaaagaaccncgtcttgttactanaaatgaaactgcctaggactagcccgaatacgacgaccgggtccttagtacttacgtgtgacgagagcgtacggggacccaacgtaaccgttanaccgctagtacgggtaccgtcggtacggggaccaaacgggaccccg

SEQ ID NO: 382137 - DNA, 791 bp, Homo sapiens
  misc_feature: GZ8MTXP02F1BH6.13.76.G10.1.454.CMB.2.raw
  modified_base (251)..(251): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctatttaaaaggtgcccagtgtgaggtgcagctggtggagtcgtggaggaggcttgatccagccgtcggggggtccctgagactctcctgtgcngcctcgtgggtcaccgtcagtcacacctacatgacgcgtcgggtcccgccgcggcctccggaaggggaaggggcgtgggagtcggcgttcttctttttagtttagtagtaggtaggtagtaccatacctccgacacgaccgttccggtgggacggggtaccgtacttaccgaaccctactcctacccaaggaactaacctaaacttacccgaaaagtaaaccctaccgtctttcgttttaaccttaacaaaaacgttcgaaaaccgtacggtacccgttaagggaaacgaccgggtacccgtaaagtaccggtaaacccggtaccggggtacccggtttaagttaacgtttaaccggtggggttacgggaaccggaaaaggggtaacgggtaaccggggttacccggggggaaaccccctaaaaccgggggttaaaaccgttttacccggtaaacccggtaaccggtttaaacggtccgggggtaaacccgggtttcgggaaccggggggtaacccccgaaaacgggggtaaacccccgg

SEQ ID NO: 382138 - DNA, 522 bp, Homo sapiens
  misc_feature: GZ8MTXP02F781Q.13.76.G10.1.454.CMB.2.raw
  modified_base (234)..(234): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagcccgccctcagtgtctggggccccagggcagaggtcaccatctctgcactgggancagctccaacattggggcacattatgatgtacactggtaccagcagtttccaggagcacggtcccagactcctcatcaatacgtaacaacaatccggcccgcgacggggtcccctgaccgtattcctcgtcggctccgagtctcggcacctcacgtccctccctgtccatacacgtcgggcctcgacggtcgtagacggatgaggctagtatttattctgcctagtcctatcgactacgcacgccgtagaagtcgtcgttcggtacgttcgggccgggggacctacgg

SEQ ID NO: 382139 - DNA, 734 bp, Homo sapiens
  misc_feature: GZ8MTXP02GXEG9.13.76.G10.1.454.CMB.2.raw
  modified_base (383)..(383): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagctctcctgtgcagcctctgggttcaccgtcagtcacacctacatgagcgtgggtcccgccgaggcctccggaggggaggggctggagtgcgtcttcttttattatagtagtggtagtacccccccatactccgacagacttccggnggacggggccgtacttccaccctatcctacccgaaagacgaaacctaaacttacccgaaaagtaaacccgaaccgtcctttaggttttacccttaacaaaaacgttcggaaaacctcgggtacccttaggggaaacggacggtaccccgggtaaataccgggaaccgaacccggggtcccgttaggttaagtttaaccgtagggtccggtacggtaacgggtagaaacgggtttcccggggggaaccccctaaacccgggttaaaaccgtttaacccgtaaacggcgttaacggttacggggtaaccggttcccgggtacgggggaaccccgtaaacgggggaacccccgg

SEQ ID NO: 382140 - DNA, 718 bp, Homo sapiens
  misc_feature: GZ8MTXP02H6V4B.13.76.G10.1.454.CMB.2.raw
  modified_base (250)..(250): a, c, t, g, unknown or other
  modified_base (395)..(395): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtctgggaggaggcttgactccagccgttgggggtccctgagactctctgtgcngcctcgtggttcaccgtcagtcacacctacatgagcgtgggtccccgccgaggcctccggaggggaaggggctaggagtgtcgttcttactttttattagtagttagtggtactaccgactacctccgacgacgtaccgttcggngggacggggtcctacgttccacctatcctacccagacgacctaacttacccgaaaagaacccgtaacgttcctttacggtttaccttaacaaacttaggaaaccaggtaccctaggacgtaacggcccgagttacggaacccgtacgggtacccgggtttaatttaaaccgtttacgtggggtttaaccggacggtaacggaagggtacggttacccgggggaaaccctaaccggggtaaaccgttttaaccacggtaaccgttacggttacggggaaccggtttcgggaacgggggtacccgaaaacgggggtaaccccccg

SEQ ID NO: 382141 - DNA, 644 bp, Homo sapiens
  misc_feature: GZ8MTXP02FXDBS.13.76.G10.1.454.CMB.2.raw
  modified_base (212)..(212): a, c, t, g, unknown or other
  modified_base (236)..(236): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctntaggaaataatggcagaataaatntacttctggtatcagcagaagtcaggccagtccccctgtcgctggtcatctatacaagatgaccaaaggccggacccctgaacgggactccccccgtagacggctacttctctcgggcctacctaaacgtcgtacggggaaccttacgaacggcccaaacttccgtacgtaaccctaactaccgaaccgggacccgggaaccccgttaaggggaccctttaacgtacggggaacttagggacgggtaccttagggtaacccttaatttaaacccggtgttacccgaaggggttccgtaggggaaaccgacgtaccgacgtacgaccgtcgaccgtacgtacgttacgtacgtacggaacgtacggaaccgtaacgtaccgtaaccgtacgtaacgaccgaccgaaccg

SEQ ID NO: 382142 - DNA, 640 bp, Homo sapiens
  misc_feature: GZ8MTXP02JVB64.13.76.G10.1.454.CMB.2.raw
  modified_base (480)..(480): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgacgcgtcgggtccgccgaggcctccggaggggaaggggctggagtgcgttcttcttttattagtagtagtggtagtacactactccgcacgacgtcggtgggacggggccgtattccgacctactctcccgaagacgaacctaacttaccgaaaagaacctacgtccttagttttacctaacaaaagttgaaaccngacctaggagacgaccgatacgaccgacgggtaccgtgttactacgtgtacggacggaagtacgacgggttaccggggacccctaaacggtaaaccgtttacccgaagtccgtaggttacgggaccggttcggaccgggggaccaaacgggggtaccccg

SEQ ID NO: 382143 - DNA, 764 bp, Homo sapiens
  misc_feature: GZ8MTXP02ILRFW.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggaggaggcttgatccagccgtagggggtccctgagactctcctgtgcagcctcgtcgggttcaccgtcagtcacacctacatgagtcgtcggtcccgccgacggcctaccgggaggggaacggggcgtagggtacgttcggtccggtttcttttcgttttttaatttaagttaggttaggttgggtaacgttaacctaacgttacctcccggactaacggtacccgttccggtgggggacgggggtaccctacgttccccaacctactccctacccgaagtaacgaaaccttaaacgttacccgaaaagtaacccgtaccggttacctttacggttttaccctaaactaaacgttaaccgtaaaccgaaccgtacccgtaggaacggaacgacccggtaaagtccggaaacccgtccggggtaccgttaggttaacttacggtcgttcggaggaacggaggtaccgggtaccggggaacccctaaccggtaaaccgttaccgtaccgtaacgttacgtacgggtaccgtacggtaccggggaacccgtaacgggaccccgg

SEQ ID NO: 382144 - DNA, 770 bp, Homo sapiens
  misc_feature: GZ8MTXP02H50MM.13.76.G10.1.454.CMB.2.raw
  modified_base (410)..(410): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctcgtgggttcaccgtcagtcaccacctacatgagcgtgggtccgccgaggctaccggaggggaggggcgtggagtgcgttctttctttttattatagtagtggtagtaccatacctcgacagaccttccggtgggacggggcgtacttccgaaccnctcctcccaagacgaactaaacttcccgaaaagaaacctaccgtcttttacgttttaccttaaacaaaacgttcggaaaaacctcggtaccccgtttagggaacggaaccggaccccgggttaaatacccgggaaaccggtccgggggttacccgtttacgggtttaactttttaaccggggtacgggttaacgggacgggtaaacggggtaacggggtaaccgggtacccgggggtaaaccccctaaaaccggggttaaaccgttttaacccggaaccggttaacgttaaacgggttacggggttaccccgggttccggggtaaacccggggggaacccgaaaaccgggggtacccccg

SEQ ID NO: 382145 - DNA, 570 bp, Homo sapiens
  misc_feature: GZ8MTXP02JYI8C.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgccaggctccgaggggaggggctggagtgcgtcttctttttatttatagtagtggtagtaccatactcgcagactcggtgaggggccattccacatctcagagacaattccaaagacagctgtttactacaaatcgaaacagcctagagagccgaatcgaaccgacggccgttagtaacttacgtgtacggcgagtacggacgtcgggggaccctaacggaaccgtttacaaccggtctagtacgggtacgtcgtacgggggacccaaggggacccg

SEQ ID NO: 382146 - DNA, 729 bp, Homo sapiens
  misc_feature: GZ8MTXP02JZ1WE.13.76.G10.1.454.CMB.2.raw
  modified_base (521)..(521): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtcggttcaccgtcagtcacacctacatgacgcgtcgggtcccgccgacggcctccggaaggggaacggggtcgtgggtaggtcggtccgtttctttactttttaatttagttagttaggttaggtaagtacctactaccgtccgacctacgtaccgttccgggtcgggacgggggtcccgtacttacccacctacttacctcccgaaaggaacaaacctaaacgttacccaaaagaaccctacgtcctttcgttttaaccttaanaaaacgttcgaaactacggcccttaggaacgtacggcccgtatacgaccgtaccggggtccttagttaactttcgtggtcgacggtaagacgggtacggggtcccggggaacccctaaacggaaaccggttttaccacggtaacgttaacgggtcggggacccggtttacggggccgggggaaacccggtaaacgggggtaacccccg

SEQ ID NO: 382147 - DNA, 534 bp, Homo sapiens
  misc_feature: GZ8MTXP02F79XK.13.76.G10.1.454.CMB.2.raw
  modified_base (298)..(298): a, c, t, g, unknown or other
  modified_base (363)..(363): a, c, t, g, unknown or other
  modified_base (370)..(370): a, c, t, g, unknown or other
  modified_base (413)..(413): a, c, t, g, unknown or other
  modified_base (445)..(445): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccaggccgtggggggtccctgagactctcctgtgcagcctctgggttcaccgtcagtcacacctacatgagctgggtccnccaggctccgagggaaggggctggagtgcgtcttcttttattatagtagtggtatacatactcgnagctcgngaggggccatcacatctcagagacaatccaaagacaacgcttnttactacaaatgaaacacgctagagacgcganagacgacgcgtagtattatgtgtagagagacgacggaccgaacgtaaacgtaacgtacgtacgtacgtaggacgtacggtacgggacgg

SEQ ID NO: 382148 - DNA, 540 bp, Homo sapiens
  misc_feature: GZ8MTXP02GCQ2W.13.76.G10.1.454.CMB.2.raw
  modified_base (266)..(266): a, c, t, g, unknown or other
  modified_base (403)..(403): a, c, t, g, unknown or other
  modified_base (412)..(412): a, c, t, g, unknown or other
  modified_base (423)..(423): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcgtggttttctgttagctattttaaaaggtgcccagtgtgaggtgcagctggtggagtctggaggaggcttgatccagcctggggggtccctgagactctcctgtgcagcctctgggttcaccgtnagtcacactacatgagctgggtccgccaggccacgaggggaggggctaggagtgtcgtcttctttatttatagtagtagtagtacatactcgcagacgtcgtggagggcgactcacactctcagagacaactacaanaacacgctnttctactaaanagaacacgactagagagacgagagacgacgcgtagtatagtgtgcgagagacgacggaccgacgtaacgtaacgtacgaacgtacgtacgtacgtacgtacggacggaacggaaccg

SEQ ID NO: 382149 - DNA, 595 bp, Homo sapiens
  misc_feature: GZ8MTXP02I66QM.13.76.G10.1.454.CMB.2.raw
  modified_base (469)..(469): a, c, t, g, unknown or other
  modified_base (512)..(512): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtcggggtcccgccgaggcctccggaagggggaacggggcgtagggagtgcgtcttcttttatttagtagtagtggtatacatctcgcagtaccgtcgtggacgggcctagttccacctatcctaccaaagacgtaacaattaccaaagaacctacgtccttagtttctaacaaatcgaaacnggcctagagtacgccgatcgactacgggcctagttacttacgngacgacgaggacgacggtaccggacccaacggtaaccgtcaacgcgttacggtcggaccggtcggacgggaccgaacggcccg

SEQ ID NO: 382150 - DNA, 618 bp, Homo sapiens
  misc_feature: GZ8MTXP02IDVFW.13.76.G10.1.454.CMB.2.raw
  modified_base (300)..(300): a, c, t, g, unknown or other
  modified_base (377)..(377): a, c, t, g, unknown or other
  modified_base (477)..(477): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtcgtgggaggaggcttgatccagccgtgggggtccctgagactctcctgtgcacgcctgtcggttcaccgtcagtcacacctacatgagcgtcgggtcccnccgaggcctaccggaggggaacggggcgtggagtgcgtcttatttttattatagtagtggtatactatacctccganagtacctcggtgggacgggcctacttccaccctattccaccgaagacgaactaaagttacccaaaagaaccacgtccttgtttactaacaaatgaaaccngcctagagacgaccgtatacgacgtacggtccgtattacttacgtgtacgacgaggagcgtaccgggggccaaaccgtacgtttaaccacggtaaccgtaggtcggtacccgtgggtccgggaccgtaaacggggaccccg

SEQ ID NO: 382151 - DNA, 604 bp, Homo sapiens
  misc_feature: GZ8MTXP02HKKKI.13.76.G10.1.454.CMB.2.raw
  modified_base (237)..(237): a, c, t, g, unknown or other
  modified_base (247)..(247): a, c, t, g, unknown or other
  modified_base (270)..(270): a, c, t, g, unknown or other
  modified_base (287)..(287): a, c, t, g, unknown or other
  modified_base (337)..(337): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtcgtccgtgtccccaggaccagacagccagcatcacctgctctaggaaataatggcagataaatntactctgtancagcagagtcagcagtccctgtnctgtcatctatcaaagntcgaccgaagccggccctcgagggtactcccccgtgacgtcgactttccncgttacgggcccttacccaaacgtccgttacggggaacctcgaacgcccacgtctacgaccatccgacgcccgggacccaggtacctaagtcgggaattgggacggtcgtacgtaacttaacttacgtgtaccgaggggtaccggtaggggactacggaccgaaggttccaaccgtcgggacccccgtacgttacgtcgtaccgtacggtaacgtaccggaaaccgtaacggtccgtaacccggtacgtacgtaccgaaccgacccg

SEQ ID NO: 382152 - DNA, 576 bp, Homo sapiens
  misc_feature: GZ8MTXP02GDHVX.13.76.G10.1.454.CMB.2.raw
  modified_base (271)..(271): a, c, t, g, unknown or other
  modified_base (392)..(392): a, c, t, g, unknown or other
  modified_base (397)..(397): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtnagtcacacctacatgagctgggtccgccaggcctccgaggggaaggggctggagtgcgtcttctttattatagtagtggtagtacatactcgcagctccgtggacgggccgattcacatcncaganacaatcaaagaccagtcttgttactacaaatcgaaacagcctagaacggacgaccgatcggaaccgtaccgggccgttagttaacttaacgtggtcggacggaaggagacggtccgggggaccccaaggtaaaccgttaacgtacgcttaaggtcggaaccgttcggacggggaacccg

SEQ ID NO: 382153 - DNA, 576 bp, Homo sapiens
  misc_feature: GZ8MTXP02J2DID.13.76.G10.1.454.CMB.2.raw
  modified_base (254)..(254): a, c, t, g, unknown or other
  modified_base (296)..(296): a, c, t, g, unknown or other
  modified_base (477)..(477): a, c, t, g, unknown or other
tcagtcacgtactacacgaccggtgctcgatttagtcactcatacagggggggagaggagcccagcactgggattcccaggtgtttccattcagtgatcagcactgaacacagaggactcaccatggagttgggactgagctggattttccttttggctattttaaaaggtgtccagtgtgaagtgcagctggtggagtcgtgggggagcttggtacagcctggcaggtccctgagactctcctgtgcagcctntggattcactttgatgattatgccatgcacgtggggtccganaagcctaccgaggggaacgggcctgggagtggtctcgaggtatagagtaggaatgtggtagctagtagctagtcggcggactcgtggtaggacgggccgtattccacctagtcctaccaggacaacgaacgaccaaagaacctcccgtagtactcctagacaagtagaacacgactagagngcgtagaacggacacggtcttaggtaattagtgtacgaactaaaagtaacctacccgtaaaccccgttagttacgttttacggagtttcggtttaacgg

SEQ ID NO: 382154 - DNA, 665 bp, Homo sapiens
  misc_feature: GZ8MTXP02HX3VU.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtcctgagactctcctgtgcagcctcgtggttccaccgtcacgtcacacctacatgagcgtcgggtcccgccgaggcctaccggaggggaacggggcgtgggagtcgtccgttctttactttttatttaagtagttaggtgtaagtaccatacctcgacacgtacctcggtgggacggggcctagttccaacctactctacccgaagtaacgaactaaacttaccaaaacgaactacgtcttcgttttacctacaaaagtcgaaaccagtaccgtaggaacgaacggtccgagtaccgacgaccgggtccgtagttacgttacgtggttagacggtaaaggagggtaacggtccgggggaaccctaacggggtaaaaccttaccgacgtcgtacgttacggggaccgttcggacggggacccgaaaggggaaccccg

SEQ ID NO: 382155 - DNA, 552 bp, Homo sapiens
  misc_feature: GZ8MTXP02J3HK3.13.76.G10.1.454.CMB.2.raw
  modified_base (401)..(401): a, c, t, g, unknown or other
  modified_base (448)..(448): a, c, t, g, unknown or other
  modified_base (479)..(479): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggttcaccgtcagtcacactacatgagctgggtcccgccgaggcctccgagggaaggggctggagtgcgtcttctttttatttatagttaagtggtagtaccatactccgcagactccgtgaggggcccattccaccatctccanagacaattccaaagaacacgtctgtttctacaaatgaacagcctganagccgatcgacctacggccgtgttattacgngtgcgagagacgtcgggggacccagaaccgttacaacgctaagtggacgttcgacggggaccaagggaccccg

SEQ ID NO: 382156 - DNA, 679 bp, Homo sapiens
  misc_feature: GZ8MTXP02HKIE9.13.76.G10.1.454.CMB.2.raw
  modified_base (257)..(257): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctntgggttcaccgtcagtcacacctacatgagcgtgggtccgccaggcctaccgaggggaagggctggagtgcgtcttcttttattatagtagtggtatactatacgtcgcagcctccggtaggacgggggcctattccgaacctatccgtacccgaaggaacgaaactaaacttacccgaaaaggaaccaaccggtctttcgtttacctacgtaaaaattcggaaaccacggtccctaggaacggaacgtccccggaaagtacggaaccggtaccgggtaccggtttacgttaacgttaccggtcggacggtacggaaacggtacggtaccgggtacccggggaacccctaaacgggttaaaccgttaaccgaccggtacgttacggtacgggtacccggtacggggtaccgggggaacccgg

SEQ ID NO: 382157 - DNA, 661 bp, Homo sapiens
  misc_feature: GZ8MTXP02FO8TG.13.76.G10.1.454.CMB.2.raw
  modified_base (248)..(248): a, c, t, g, unknown or other
  modified_base (296)..(296): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctctgtgcngcctcgtggtcaccgtcagtcaccacctacatgagcgtcggggtcccnccgacggcctaccggaggggaaggggcgtggagtgcgttcttcttttagtttatagtagtggtataccatacctcgacacgaccttccgggtggacggggccagttccacctatcctccgagacgtaacctaacttacccaaagaacccacgtctttagtttactacaaaagtcgaaacctcgaccctaggaagacgtacccggaatacgaaccggtacgggtccgttagttactacgtggtacgacggaggagacgggtacccgggggacccctaaacgggttaaaccgttacgtaccggaacgtttaacggacgggtaccggttacgggaccgggggaaccccggtaaacggggtaacccccg

SEQ ID NO: 382158 - DNA, 571 bp, Homo sapiens
  misc_feature: GZ8MTXP02I44E5.13.76.G10.1.454.CMB.2.raw
  modified_base (434)..(434): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtgggtccgccaggctccgaggggagggctggagtgcgtcttcttttatttatagtagtggtatacatactcgacagactcgtggacggggccattcaccatctccagagacaatccaaagacacgtctgtttctacaaatgaaacngacctgagacgcgtatcgacgacggcgttagtacttacgtgtcgacgaggagacgggtaccggggaccccaacgggtaaccttcgtaacgcgtacggtcggaacccgttcggtacgggggacccaacggggaccccg

SEQ ID NO: 382159 - DNA, 610 bp, Homo sapiens
  misc_feature: GZ8MTXP02GLXJH.13.76.G10.1.454.CMB.2.raw
  modified_base (378)..(378): a, c, t, g, unknown or other
  modified_base (415)..(415): a, c, t, g, unknown or other
  modified_base (432)..(432): a, c, t, g, unknown or other
  modified_base (445)..(445): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttaattttaaaaggtgcccagtgtgaggtgcagctggtggagtcgtggaggaggcttgatccagccgtggggggtccctgagactctctgtgcagcctcgtgggtcaccgtcagtcacacctacatgagcgtcgggtccgccaggctaccgaggggaaggggctggagtgcgttcttctttttattatagtagtggtagtaccatactcgcagactcgnggacgggcattccacatcctcagagacaataccaaanacacgcttagtttctanaaaatgaaaaccncgactagaagacgaccgaagtacgaccgaccgggtccgttagttacgttacgtggtacggacggaaggaggtacggtaccggggaacccctaaccgggtaaaccttaccgtaccgaacgttacggtacgggtacgtccggtaccggggaaccgtaacgggacccg

SEQ ID NO: 382160 - DNA, 589 bp, Homo sapiens
  misc_feature: GZ8MTXP02JD3WO.13.76.G10.1.454.CMB.2.raw
  modified_base (254)..(254): a, c, t, g, unknown or other
  modified_base (364)..(364): a, c, t, g, unknown or other
  modified_base (424)..(424): a, c, t, g, unknown or other
  modified_base (454)..(454): a, c, t, g, unknown or other
  modified_base (468)..(468): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctntgggtcaccgtcagtcacacctacatgagctcgggtccgccgaggctaccgaggggaaggggctggagtgcgttcttctttttattatagtagtggtagtacatactccncagactcgtggagggccgattccaccatcctccaagagaacctaattacccaagaaaccncgtccttagtttcctaacaaaatcgaaacncgccgtagaggacnccggatacggaactccgggttgtagttattacgtggtacgcggaggtagacggtcggggacccctaacggaacgtttacacgtcgtaagtcggacgtcggtcggggaccgaacgggacccg

SEQ ID NO: 382161 - DNA, 743 bp, Homo sapiens
  misc_feature: GZ8MTXP02IWI1D.13.76.G10.1.454.CMB.2.raw
  modified_base (252)..(252): a, c, t, g, unknown or other
tcagtcacgtactacacgaccggtgctcgatttagtcactcatacagggggggagagggagcccagcactgggattccgaggtgtttccattcggtgatcagcactgaacacagaggactcaccatggagttttggctgagtctgggttttccttgttgctattttaaaaggtgcccagtgtgaggtgcagctggtggagtcgtggagggaggcttgatccagccgtgggggtccctgagactctctgtgcngcctctgggtcaccgtcagtcacacctacatgagctcgggtcccgccgacggcctccggaggggaacggggccgtggaggtggtccggtttctttcgtttttatttagtaagttaggtaggttagtacctatacctccgacaacgtaccgtccggtgggacgggggtccctacgttaccacccgtagtcctaccaagacgtacctaaacttacccgaaaaggtaaccctacggtcctttacgttttaccttaacaaaacgttcgaaaccgacgtacccgtaggaacgacgtcccggaaattccgggaaccaccgggggtccttaagtttacgtttaccgtggtacggacggtaaggacggtacgggttaccgggggaaccccctaaacggggttaaaccccgtttaaccttaacccgggaacgtttacggttacgggggtaaacccggtttccgggtaacggggggtaccccaaaacggggggtaaccccg

SEQ ID NO: 382162 - DNA, 557 bp, Homo sapiens
  misc_feature: GZ8MTXP02FN6T0.13.76.G10.1.454.CMB.2.raw
  modified_base (236)..(236): a, c, t, g, unknown or other
  modified_base (352)..(352): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcacgtgggancagctccaacagttgggcacattatgatgtacacgtggtaccagctagtttccaggagcgacggtcccagacctcctcatacaatacgtaacaacatcggcccgcgacggggtccngaccgtattctctggcctccgagtctcggctaccgtcacgtccctcccgtggtcctagtccacgtcgggaccctccgaggccgtaggacggtatcggacggtctaggtactttacttcgtcgtacctacgtcctagtacgacacgtcacgccgtagtaacgtcgtaccgttacggttaggttccggggccgggggtaacctcggg

SEQ ID NO: 382163 - DNA, 664 bp, Homo sapiens
  misc_feature: GZ8MTXP02GGSPC.13.76.G10.1.454.CMB.2.raw
  modified_base (406)..(406): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccaggccgtgggggtccctgagactctctgtgcacgcctcgtgggttccaccgtcacgtcacacctacatgagtcgtcgggtccgccgaggccgtaccggaaggggaacggggcgtgggaggtgtcgttctttactttttagttagtaggttaggtggtagtactatacctccgactagccgtccggnggacggggtcctattcacctatccacgaagactaactaacttaccaaagaacctgtacctttcgtttactaactaaaagtcgaaacacggtacctaggaacggacgaccgagttacgaaccggtacggtccgttagttacttacgtggtacggtacggaaggtacggacggtaccggggacccctaaacgggttaaaccgttaaccgtaacgtacgttaacgggtcggtaaccggttcgggtaacgggggaaacccgg

SEQ ID NO: 382164 - DNA, 576 bp, Homo sapiens
  misc_feature: GZ8MTXP02I3JCZ.13.76.G10.1.454.CMB.2.raw
  modified_base (455)..(455): a, c, t, g, unknown or other
  modified_base (496)..(496): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagctgggtccgccgaggcctccgagggaggggcgtggagtgcgttcttcttttatttagtagtagtggtatactatactcgcagaccgtccggtggacggggccgagttccacctactcctccgaagacgaacaattaccaagaacacgtcttagtttctacaaatgaaacngcctagagacgccgatcgacgacggtcgtagttacttacgngtgacgagagacggtaccggaccctaacgtaaccgttacgacgtcgtacggtcggacgtcggacgggaccgaacggtccg

SEQ ID NO: 382165 - DNA, 605 bp, Homo sapiens
  misc_feature: GZ8MTXP02F4R5U.13.76.G10.1.454.CMB.2.raw
  modified_base (356)..(356): a, c, t, g, unknown or other
  modified_base (378)..(378): a, c, t, g, unknown or other
  modified_base (386)..(386): a, c, t, g, unknown or other
  modified_base (436)..(436): a, c, t, g, unknown or other
tcagtcacgtactacacgaccggtgctcgatttagtcactcatacagggggcccagcactgggattccgaggtgtttccattcggtgatcagcactgaacacagaggactcaccatggagttttggctgagctgggttttccttgttgctaattttaaaaggtgcccagtgtgaggtgcagctggtggagtctggaggaggcttgatccagccgtgggggtccctgagactctcctgtgcagcctctgggttcaccgtcagtcacacctacatgagcgtgggtccgccaggcctccgaggggaacggggctgggagtgcgtcttcttttatttagtagtagttggtagtacatacncccgcagactccgtgacgggcntcacatcncagagactaatccaaagacactcttgttacataaatcgaacagctagagngccgatcgacgtacggccgtagtacttacgtggtcgacgagacggacggtccgggggaccccaaacggttaaacgttaccaaccggtacgttaaggacgggtaaccgttaccgggtacgggggaaccccgtaaaacgggggaccctaaccggggttccctaaaccccgg

SEQ ID NO: 382166 - DNA, 724 bp, Homo sapiens
  misc_feature: GZ8MTXP02F9A04.13.76.G10.1.454.CMB.2.raw
  modified_base (249)..(249): a, c, t, g, unknown or other
  modified_base (300)..(300): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcngcctcgtgggtccaccgtcagtcacacctacatgagcgtcggtcccgccgnggcctccggaggggaggggctggagtgcgttcttctttttaatttataagtagtggttactaacacttaccgtccgacgtacgtaccttccggtggggacggggccgtacgttaccaccctactcctaccgaagaacgtaaaccctaaagtttaacccccgaaaagtaaacccgtaccgtacctttacggttttaaccttaacctaaaaagttcggaaaacctacggacccttagggaacgacggtacccggtaaatccggaaccggtaaccgggtccgttaggttaactttaccgtggtacggaacgtaggaggtacggtaccggggaccccgtaaacgtaaaaccggtttaccgaacgtccgttaaggtaccgggttacgggtaccggtacgggggaacccggtaaacggggtaacccccgg

SEQ ID NO: 382167 - DNA, 631 bp, Homo sapiens
  misc_feature: GZ8MTXP02IYCUI.13.76.G10.1.454.CMB.2.raw
  modified_base (472)..(472): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtgggttcaccgtcagtcacacctacatgagcgtgggtcccgccgaggcctccggaggggaggggctggagtgcgttcttctttttatttagtagtagtggtataccatactccgcagtaccgtcggtggacggggcctacgttccacctactcctccaagacaacctaattacccgaaagaactacgtctttagtttacctaacaaattcgaaaccngtcctagacgacggccgtatacggaccgtacgggtccgttagtacttacgtgtacgacggaggaggacggtaccgggggaccctaacggttaaaccgttacgtacgtaacgtacggtcgggtaccggtcggtaccgggggaccaacgggggtaaccccg

SEQ ID NO: 382168 - DNA, 549 bp, Homo sapiens
  misc_feature: GZ8MTXP02FKNGT.13.76.G10.1.454.CMB.2.raw
  modified_base (359)..(359): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgccaggctccgaggggaaggggctggagtgcgtctcttttatttatagtagtggtagtaccatacncgcagactcgtgacggggcatcaccatctccagagacaattccaaagaacacgcttgtttactacaaaatgaaacacgcctgacgacgccgatcgacacggcctgtattactgtgcgaggagacgtcggggacccaacggtaacgttacctacgctagtcgggacgtcgtcgggggaccaacgggacccg

SEQ ID NO: 382169 - DNA, 602 bp, Homo sapiens
  misc_feature: GZ8MTXP02G42D3.13.76.G10.1.454.CMB.2.raw
  modified_base (378)..(378): a, c, t, g, unknown or other
  modified_base (392)..(392): a, c, t, g, unknown or other
  modified_base (465)..(465): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctctgtgcagcctcgtgggtcaccgtcagtcacacctacatgacgcgtcggggtcccgccgaggcctccggaaggggacggggtcgtaggagtcgtcgttctttactttttatttagtagtagtaggtataccataccncgcagaccttcggnggacgggcgtattaccacagtctaccaagactacaaattaccgaaaagtaccacgtctttacgtttacctaanaaagtcgaaactcgctagagcgaccgatccgacgacggtcgtagttaatcgtgtgacgagacgtacggccggggacccaacgtaaccgtttcacggtaacgtagtcggtacgtcggcggggaacaacgggtaccccg

SEQ ID NO: 382170 - DNA, 666 bp, Homo sapiens
  misc_feature: GZ8MTXP02IVHQY.13.76.G10.1.454.CMB.2.raw
  modified_base (251)..(251): a, c, t, g, unknown or other
  modified_base (523)..(523): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgatctgggttttccttgttgctattttaaaggtgcccagtgtgaggtgcagcgtggtggagtcgtgggaggaggcttgatccagccgtcgggggtcctgagactctcctgtgcngcctcgtggtcacgtcagtcacacctacatgacgcgtcgggtcccgccgaggcctaccgggaaggggaacggggcgtgggaggtcggtccgttctttacttttaagtttagtaggttaggtaggttaagtaccctactaccgtccgacgtacgtaccgttccgggtggggacggggtacctacgttaccaccgtactcctaccaagaacgtaacctaaacgttaccaaagtaaccgacgttcctttacgtttactaacaaaagtcgaaaccncgtcctaggacgacgaccgatacgacgtacggtcgtagttacttacgtggtcgacgaggacgacggttccggggaccctaacggtaaaccgtttcacggtcgtagtacgggacgtcggacggggaaccgaacggggtaccccg

SEQ ID NO: 382171 - DNA, 729 bp, Homo sapiens
  misc_feature: GZ8MTXP02F7RH7.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtgggtcaccgtcagtcaccacctacatgacgtcgtcgggtcccgccgaggcctaccggaggggaacggggcgtgggacgtcggtccggttctttctttttagtttataggttagtgggtatacctactacctccgacagaccgttccggtgggacgggggcccgtagttccaccctatccctacccgaagacgtaaacctaaacgttaccgaaaagtaaaccacggtcctttaggttttaacccttaaccgtaaaaattcggaaaaaccgtcggtaccccgttagggaaccggtacggaccccgggtaattaccggaaccggtaaccgggtcccggttaggttacttacgtggttacggacggtaaggaggtacggtccgggggacccctaacggtaaacccggtttaccaacggtcgttaaacggcgggtaaccggtcgggtaccgggggaacccgtaacgggggaaccccg

SEQ ID NO: 382172 - DNA, 766 bp, Homo sapiens
  misc_feature: GZ8MTXP02IVICP.13.76.G10.1.454.CMB.2.raw
  modified_base (250)..(250): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtctggaggaggcttgatccagccgtgggggtccctgagactctcctgtgcngcctcgtggtcaccgtcagtcacacctacatgagcgtcgggtcccgccgacggccgtaccggaaggggaacggggcgtagggaggtcggtccgtttctttacgtttttatttaagtagttaggtagggttaacgttacctatacctccgacgtaacggtaccgttccggtcggggacgggggcccgtacgtttaccacccgtactcccgtaccgaaagtaacgaacctaaaacgttacccgaaaaagttaacccgaccggttcctttaggttttacccttaaacaaaacgtacggaaaacctacggtacccgttaagggaaaccgacggacccggtaaagtaccggaacccgtaaccgggttcccgttaggttaaactttccgtggtacgacggaaggtacggacgggtacccgggggtaccctaaacggttaaaacccgtttaccgaacgtcgttaacgggtacgggtacccggttaccggggaccggggaacccgtaaaccgggggtaaccccg

SEQ ID NO: 382173 - DNA, 639 bp, Homo sapiens
  misc_feature: GZ8MTXP02J13SP.13.76.G10.1.454.CMB.2.raw
  modified_base (333)..(333): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggtcaccgtcagtcaccacctacatgagcgtcgggtcccgccgaggctccggaggggaggggcgtggagtgcgtnttcttttattatagtagtggtagtaccatactcgcagacgtccgtggacggggccgtattccaccatcctcccaagacgaactaacttaccaaagaacacgtcttagtttctacaaatcgaaactagcctaggacgacgccgatcgacccgaacgggtcccgtaggttaacttacgtgggtacggacggaaggacggtacggtaccgggggaccccctaacgggtaaaacccgttttaccgaaccggtccgttaaaggtcggggaaccgttccgggtacgggggaccccggaaaaggggtcccccg

SEQ ID NO: 382174 - DNA, 618 bp, Homo sapiens
  misc_feature: GZ8MTXP02G6ID2.13.76.G10.1.454.CMB.2.raw
  modified_base (367)..(367): a, c, t, g, unknown or other
  modified_base (389)..(389): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtggtcaccgtcagtcacacctacatgagcgtcggtccgccaggcctccgaggggaaggggcgtggagtgcgtcttcttttattatagtagtggtataccatactcgcagcnccgtggagggcattccacatcnccagagacaataccaagaacacgtcgttatttacttaacaaattgaaactcgcctggaacgacgccggaatcggaaccgaccggggtacccgttagttaacgttaccgtgggtcgaccggaaggtaggacggttacgggggaacccccaacgggttaaaaccggttactaacccgtgttacgacgggtacggtccggtacgggggaacccgtaaacggggaacccccgg

SEQ ID NO: 382175 - DNA, 597 bp, Homo sapiens
  misc_feature: GZ8MTXP02GIYBJ.13.76.G10.1.454.CMB.2.raw
  modified_base (250)..(250): a, c, t, g, unknown or other
  modified_base (481)..(481): a, c, t, g, unknown or other
  modified_base (520)..(520): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcngcctcgtgggtcaccgtcagtcacacctacatgacgcgtcgggtcccgccgaggcctccggaaggggaacggggcgtagggagtcgacggttctttcttttagttttatagttagtggtataccgatacctccgcagaccgttccgtggacggggccctagttccaacctatcctacccaaagtacgaactaaactaccaaagaacacgcttagtttctacaaatgaaacngcctagagacgaccgatgaccgacggtcgtgtattacgngtagcgaggagaggtcggggacccaacgtaacgtaccacggaatcgtacggactcggtacgggacccgaaggacccg

SEQ ID NO: 382176 - DNA, 622 bp, Homo sapiens
  misc_feature: GZ8MTXP02IWD10.13.76.G10.1.454.CMB.2.raw
  modified_base (300)..(300): a, c, t, g, unknown or other
  modified_base (384)..(384): a, c, t, g, unknown or other
  modified_base (402)..(402): a, c, t, g, unknown or other
  modified_base (405)..(405): a, c, t, g, unknown or other
tcagtcacgtactacacgaccggtgctcgatttagtcactcatacagggggggagaggagcccagcactgggattccgaggtgtttccattcggtgatcagcactgaacacagaggactaaccatggagttttggctgagctgggttttccttgttgctattttaaaaggtgcccagtgtgaggtgcagctgggtggagtcgtggaggaggcttgatccagccgtgggggtccctgagactctcctgtgcagcctcgtggggttccaccgtcagtcacacctacatcgagcgtgggtccnccgaggcctaccgaggggaaggggctgggagtgcgtctttctttttattatagtagtggtagtacacgtactccgcagactcgngacgggggcctatcaccntcnccagacgacaaacttaccaaagaaccacgtcttacgtttacttaccaaaatgaaacacgtcctaggaacgtagacccgaagtcgaaccgaccgggtaccgtagtactttacgtgtgtagtaaggagtacggtccgggacccaacggtaaacgttaccgtacgaccttaaggtacggaccggttcggcggggacccgaacggggtacccgtaaccggg

SEQ ID NO: 382177 - DNA, 640 bp, Homo sapiens
  misc_feature: GZ8MTXP02GU1OO.13.76.G10.1.454.CMB.2.raw
  modified_base (457)..(457): a, c, t, g, unknown or other
  modified_base (469)..(469): a, c, t, g, unknown or other
tcagtcacgtactacacgaccggtgctcgatttagtcactcatacaggggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccacgccgtggggggtccctgagactctcctgtgcagcctctggggtcaccgtcagtcacacctacagtcgagcgtcgggtccgccaggcctccgaggggaacggggctggagtgtcgttcttctttttattatagtagtggtagtaccatactcgacagacctcggtggacgggccgtattcaccatctcccaagagaactaagtacccaaagaaccgactccttaggtttaccctaaanaaagtcgaaacncgtaccgaggacgacgaccgataccggaccgtacggtcgttagttacgttagtggtacgacgggagacggtacgggtacccgggaaccctaaaccggtaaccgtttacccgaccgtaacgtaacggtacgggtaccggtacgggtaccggggaacccgtaacggggacccg

SEQ ID NO: 382178 - DNA, 546 bp, Homo sapiens
  misc_feature: GZ8MTXP02F3GH5.13.76.G10.1.454.CMB.2.raw
  modified_base (257)..(257): a, c, t, g, unknown or other
  modified_base (269)..(269): a, c, t, g, unknown or other
  modified_base (294)..(294): a, c, t, g, unknown or other
  modified_base (313)..(313): a, c, t, g, unknown or other
  modified_base (354)..(354): a, c, t, g, unknown or other
tcagtcacgtactacacgaccggtgctcgatttagtcactcatacagggggggagaggagcccagcactgggattccgaggtgtttccattcggtgatcagcactgaacacagaggactcacccatggagttttggctgagctgggttttccttgttgctattttaaaaggtgcccagtgtgaggtgcagctggtggagtcgtggaggaggcttgatccagccgtggggggtccctgagactctcctgtgcagcctntgggtcaccgtnagtcacactacatgagctgggtccncaggctcgagggaggggcnggagtgcgtctcttttattatagtagtggtataccataccncgcagtactcgtggacgggccgtattccacctatcctccagagacaattccaaagaaccagctgtttactacaaatgaaacagcctagagacgccggaatcgaccgacggccgtgtatacgtgtgcgtagagtacgcgggaccacgtaacgtactacgcgtagtggacgtcgacggggacctaaggggaccc

SEQ ID NO: 382179 - DNA, 602 bp, Homo sapiens
  misc_feature: GZ8MTXP02I5OXG.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtccctgagactctcctgtgcagcctctgggttcaccgtcagtcacacctacatgagcgtgggtccgccaggctccggaggggaaggggcgtggagtgcgttcttactttattagtagtagtggtagtacatactcgacagaccgtcgtggacgggccgtattccaccagtcctacccgaagtacgaacaaacttaccgaaaagaacctacggtcttagtttacctaacaaagtcgaaacacgtccgtagacgacgccgatacgaccgacggccgtagtacttacgtgtgacgagagacgtccggggaccaacggtaacgttacgaccgtaagtaacgtcggtaccggtcgacggggaccaaaaggggtccccg

SEQ ID NO: 382180 - DNA, 654 bp, Homo sapiens
  misc_feature: GZ8MTXP02FSAW9.13.76.G10.1.454.CMB.2.raw
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataatggcagataatatacttctggtatcagcagagtcaggccagtcccctgtgctggtcatctatcaagtatcgaccaagccggccctcggacgggacctccccgtgacgcgtatttcctcgtcgggcctacccgtaacgtccgtagggaaccttcgacgtccctacttcctacgaaccagttccgacggacccgggacccaagggtcctaagtcggaattcgggaaggtctagtaaccgttatttaccgtacggttcgaacggggtcggttacgggggacaacgggccgaacggaccgtaaccgttccggcccggttaacttaacggtttcggttacccgtttaccgggtaaaccgggttaaccggggtaaacccgttaaacgggtaccccgtaacccggttaaccgttaaacggtaccgtaaaaccccgg

SEQ ID NO: 382181 - DNA, 642 bp, Homo sapiens
  misc_feature: GZ8MTXP02JCMIY.13.76.G10.1.454.CMB.2.raw
  modified_base (365)..(365): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctctgggttcaccgtcagtcacacctacatgagcgtgggtcccgccaggcctccgaggggaaggggcgtggagtgcgtcttcttttattatagtgtggtatacatactccgnagctccgtgggacggggccattccaccatcctaccaagtacgaaccaaacttacccaaagaacccacgtccttacggttttacctaccgaaaattcgaaaccgtagcccgtaggacgacgcccgtaatacggacccgtacgggtcccgttagttaacgttcgtacggtcgtacggaggaacggtacggtacccgggggacccctaaaaccggtaaccgttacctaacgtaacgtacgtcggtaacggttccggacggggaccgaaacgggaccccgg

SEQ ID NO: 382182 - DNA, 706 bp, Homo sapiens
  misc_feature: GZ8MTXP02GYSTG.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctggtttccttgtgctatttaaaaggtgccagtgtgagtgcagctggtggagtcgtggaggaggcttgatccagccgtgggggtccctgagactctcctgtgcagcctcgtcgggttcaccgtcagtcacacctacatgagcgtcgggtcccgccgaggcctccgaggggaacggggcgtggagtcgtcgttctttcttttatttagtagttagtaggtatacctactaccgtccgacacgtaccgtccggtggggacggggtcccgtacttaccaaccgtactcccgtaccaaagggtacaaacctaacttaacccgaaagtaacccgtagtccctttagtttttaccctaaacgaaaagttcggaaaacctcggtacccgtagggaaaccgaccggacccggttaagtaccggaaccgtaccgggtccgtttaagttaacgttacgtggacgacgaaggtaggccgggtacggggaacccctaaacgggtaacgtttaccacggtaacgttaacgtacgggggtaacgtccgggtaacgggggaacccgaacgggggtaccccc

SEQ ID NO: 382183 - DNA, 602 bp, Homo sapiens
  misc_feature: GZ8MTXP02H8UZN.13.76.G10.1.454.CMB.2.raw
  modified_base (180)..(180): a, c, t, g, unknown or other
  modified_base (251)..(251): a, c, t, g, unknown or other
  modified_base (297)..(297): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtntccccaggacagacagccagcatcacctgctctaggaaataattggacaagaataaatatacttctggtancagcagaagtcaggccacgtcccctgtgctggtcatctatcaaagntgaccaagccgaccctgacgggctcccccgagacgctattctcgtcgctaccgtaactcgtacggacctcgatcccacttcacgacccacgtacgaccgtccgggaacccagggtactaggtggtaactacgggacggtcgttagttaaacgtagtttacgtcgttacggacgggtacggtacgggggacaacggcgaacgaccgtacgccggtcccgaactttcggtacgttaccgttaccggaaacgttcgggaaaccgtaacggtaccgtaccgtaaccgtaacgtaccgaaccgaaccccg

SEQ ID NO: 382184 - DNA, 799 bp, Homo sapiens
  misc_feature: GZ8MTXP02F2ZTL.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtccctgagactctcctgtgcagcctcgtggtcaccgtcacgtcacacctacatgacgcgtcgggtcccgccgacggcctccggaggggaacggggcgtagggaggtcggtccgttcctttacgtttttaatttagttaaggttaggttaggttaacgttacctaacgttacccgtcccgaccgtaacggtaaccccgttcccgggttaggggaccgggggtacccgtaacgtttacccaacccgtactaccgtacccaaaggtaaccaaacctaaacttaccgaaaacgaaaccctaccggttcttttaacggttttacccttaacgtaaaaacgttacggaaaacccgtacgtacccggttacgggaaacgacggtaaccccgtaagtaacccggaccggtaccgggttaccgttaggttaactttacggtacggttacggacgggaaaggtaacggtacgggttacccgggggaaaccctaaaccggttaaaccggttaacctaaccggaacgttaacggtacgggaccggttacggaccgggggaacccgtaacggggtaacccccg

SEQ ID NO: 382185 - DNA, 611 bp, Homo sapiens
  misc_feature: GZ8MTXP02GLD4I.13.76.G10.1.454.CMB.2.raw
  modified_base (473)..(473): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtcgggtccgccgaggcctccggaaggggaacggggcgtggagtggtccgttctttctttttaatttagtagtaggtaggtagtaccatacctccgcagaccgtcggtgggacggggcctattccaccatcctaccagacgaactaacttaccaaagaacacgtcttgtttactacaaatcgaaacngacctagagacgccgagtcgacgacggtccgtagtattacgtgtcgacgagagacggtcgggggacccaacggtaaaccgttacgtacgtaacgttacgcggtaccggtcggtacggggacccgaacggggtaccccg

SEQ ID NO: 382186 - DNA, 809 bp, Homo sapiens
  misc_feature: GZ8MTXP02FSLMW.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcacgcctcgtgggttcaccgtcagtcacacctacatgagcgtcgggtcccgccacggcctaccgaggggaacggggctgggagtgccgtctttcttttattatagtagtggtagtacatactccgcgacgcctccgggtggaacgggggcctacgttaccacccgacttacctacccgaagaacgaaacctaaacttaacccgaaaacggaaaccctaaacgtccgtttacggtttttaccttaactaaaaacgttcgggaaaaccaacggtacccgttaagggaaacgggtaaccgaccccggtaaagttacggaaacccgggtaacccgggggttacccggttaaggttttaaaccggtttaaaaccgttcggggttaacgggtaaccggggtaaacggggaaaggggtaaaccggggtttacccgggggggaaccccccttaaacccgggggttaaaaaccgtttaaaacccggttaaccggtaacccggtttaaacgggttaaccgggggtaacccggttttaaccgggggtccgggggggtaaaaacccccgggg

SEQ ID NO: 382187 - DNA, 704 bp, Homo sapiens
  misc_feature: GZ8MTXP02GL1AP.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgccagtgtgaggtgcagcgtggtggagtcgtggaggaggcttgatccagccgtgggggtcctgagactctcctgtgcacgtcctcgtcggttcaccgtcagtcaaccgacctaacatggacgtcgtcgggtcccgccgaggcctaccggaggggaacggggcgtgggagtggtccgttctttactttttaagtttacgtaggttaggttaggtagtactattaccgccgacacgtaccgtcggtaggacgggggtacctagttaccactactcctaccgaagacgtaacaacttaccgaaaacgtaacctaacggtctttacggtttaccttaaacgtaaaaacttacgaaaaccgtacggtacctaggaacggacgtacccgaagtccggaaccgaacgggtccgtagttaacgttacgtggtaggacgtaaggacggtacggtaccggggaacccaaacggttaaaccgtaacgtaaccgggtacttacgggtacgggtaccgttccggggtaacggggaaccccgggg

SEQ ID NO: 382188 - DNA, 585 bp, Homo sapiens
  misc_feature: GZ8MTXP02FFJTY.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggtcaccgtcagtcacacctacatgagctgggtccgccaggctccgaggggaagggctggagtgcgtctcttttaatttatagtagtggtagtaccatactccgcagactccggtgaacgggggccattccaacctatcctaccagagaccaattacccaaagaacccacgcttcgtttactacaaaatcgaaacagccctgacgagtccgatcgacacgggccttgtacttacgtgtggcgtagaggacgtacgggggaccccaaacggtaacctacgtacgaacgtaagtcgggaacgttcgacgggggaccaacggggaacccg

SEQ ID NO: 382189 - DNA, 732 bp, Homo sapiens
  misc_feature: GZ8MTXP02ID4IB.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtggggggtccctgagactctcctgtgcagtcctcgtgggttcaccgtcagtcacacctacatgagcgtcgggtccgccgaggcctccggaggggagggcgtggagttggcgtttcttactttttagttatagttagtggtaacgtaccaattacccgtccgcaaggtacccttccgggtggggaaccgggggtaccctacgtttacccaacccgtactcctacccgaagtaacgaaacctaaactttacccaaagaaacccgtacgttaccgttcgttttacctaactaaaacgtacgaaacgtacgtcccgttagaacgacgacccggaagtacggaaccgaccgggtaccgttacggttaacttccgtagggttacgacgggagggtacggaacggttacccgggggaacccctaaacggttaaaccgtttaacccgtacggaaccgtttggtacgggtaccggttacggggttaccgggggaacccggtaaacgggggaaccccgg

SEQ ID NO: 382190 - DNA, 574 bp, Homo sapiens
  misc_feature: GZ8MTXP02GZZJY.13.76.G10.1.454.CMB.2.raw
  modified_base (235)..(235): a, c, t, g, unknown or other
  modified_base (262)..(262): a, c, t, g, unknown or other
  modified_base (388)..(388): a, c, t, g, unknown or other
  modified_base (445)..(445): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcaggaggtcacatctcctgcacgtgggancagctaccaacagttgggcacgattangatgtacactggtaccagcagttccaggagcacggtcccagacctctcatacaaatacgtaaacaacacgtccggccgacgacggggtccctagaccgtacgttctacgtcggcctccgagtccgnggccacctcacgtccctcccgtgtcactcgacgtcggctacgacggtcaggacgtancgagtactgtaattcgttcgtcgaccctaggtaccttatacggaacacggtacacgtccgtaacggtaaggtccgtaccgtttaccggggtaaccggtttccgggggacccgggggtaaccctaccggg

SEQ ID NO: 382191 - DNA, 660 bp, Homo sapiens
  misc_feature: GZ8MTXP02HESBX.13.76.G10.1.454.CMB.2.raw
  modified_base (297)..(297): a, c, t, g, unknown or other
  modified_base (414)..(414): a, c, t, g, unknown or other
  modified_base (443)..(443): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtcgggtcccnccgaggcctaccggaggggaaggggcgtgggagtcggcgttcttctttttaattagtaagttaggtaggttagtaccatacctccgcagaccgtcggtggacggggcctatccaccntcctccagacaacctaactccaaagaacncgtcttacgtttactaacgaaaattcgaaacgcgtccgtagaagacgacccgtaatccggaaaccgtcgggtaccgttagttacttacgtggtcggacgaaggtacggacggttaccgggggaccccctaaaggtaaacccgtttcgaaacccggtcgttaaaggtcgggaacccggttccgggtacgggggaaccccctaaagggggtaccccccg

SEQ ID NO: 382192 - DNA, 767 bp, Homo sapiens
  misc_feature: GZ8MTXP02HDO20.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagcgtggtggagtcgtgggagggaggtcttgactccaggccggtcggggggtccctggacgtactctcctgtgcagcctcgtcgggttcaccgtcacgtcacacctacatgagcgtcgggtccgccgaggccgtaccggaggggaggggcgtggagtcggtcgttctttctttttagtttagtagttaggtaggtaagtacctactaccgtccgactacgtaccgtcggtcgggacggggtcctacgttccacctactcctacccgaaagtacgaaacctaacttaaccgaaaacgtaaacccgtacggttacctttacgtttttacctaaaacgaaaagttacgaaaaacctccggtaaccgttaagggaacggtaacggtacccggtaagtaaccgggtaacccgaccgggggttccgtttaaggtttaacctttaacggtgggtaccgggaacggtaaagggaacggtccgggttaaccgggggaaccccctaaacggttaaaccgtttaccgtaacgtaacgttacggtccgggtaaccggtcgggtaaccgggggaccgaaaccggggtaaccccg

SEQ ID NO: 382193 - DNA, 584 bp, Homo sapiens
  misc_feature: GZ8MTXP02GJIXY.13.76.G10.1.454.CMB.2.raw
  modified_base (450)..(450): a, c, t, g, unknown or other
  modified_base (463)..(463): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagctctcctgtgcagcctcgtgggttcaccgtcagtcacacctacatgagctcgggtccgccgacggctccggaggggaaggggcgtgggacgtgcgttcttcgttttatttatagtagtggtagtacatacctccgcagcgtccgtggacggggccgattccaccactcctccagacgactaatcccaaagaccagtccttagtttacctanaaaactgaaaccngcctagacggagcccgatcgaaccgacggcctagtagttactggtacgcgagaggacgtccggggacccaacggtaacgtaacgtacgactacggtcggacggttcggacggggaacccgg

SEQ ID NO: 382194 - DNA, 595 bp, Homo sapiens
  misc_feature: GZ8MTXP02GV9ER.13.76.G10.1.454.CMB.2.raw
  modified_base (400)..(400): a, c, t, g, unknown or other
  modified_base (403)..(403): a, c, t, g, unknown or other
  modified_base (408)..(408): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaagtgcccagtgtgaggtgcagctggtggagtctggaggaggcttgatccagccgtgggggtccctgagactctcctgtgcagcctctcgggttcaccgtcagtcacacctacatgagcgtcgggtccgccgaggcctccggaggggaggggcgtggagtgtcgtctttctttttatttatagtagtaggtagtaccatactccgcagtacctcgtggacgggccgattcaccntcncaganacaattccaaagaccactcttgtttactacaaatcgaaacagtccctaggagacgccgatacggaacgccgggtcgttagtacttacgtggtggacggagaaaggcggtacgggggaccccctaagtaaccgttaccacgtccgtagtacggggaccgtcggtacgggggaccgtaaacggggcccg

SEQ ID NO: 382195 - DNA, 677 bp, Homo sapiens
  misc_feature: GZ8MTXP02GHQGG.13.76.G10.1.454.CMB.2.raw
  modified_base (494)..(494): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtcctgagactctcctgtgcagcctcgtggtcaccgtcagtcacacctacatgagcgtcgggtcccgccgaggcctaccggaaggggaacggggccgtgggaggtcgcgttctttctttttaatttagtagtaggtggtagtacctatacctccgactacgtaccgttccggtgggacgggggccgtacttaccaccatcctacccaagacgtaaaccaacttaccaaaagaaccaccgtctttcgtttactaacaaagtcgaaacncgtcctaggaacgacgcccgaatcgaaccgacgggtccgttagttacttacgtgtcggacgtaaggacggtacggtaccggggacccctaaacgggttaaaccgttaccgtaaccgtaacgttaacggtacggggtaacccggtccggggtacgggggaacccggaaacggggtaacccccgg

SEQ ID NO: 382196 - DNA, 550 bp, Homo sapiens
  misc_feature: GZ8MTXP02IYLB6.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgccaggctccgagggaggggctggagtgcgtcttcttttattatagtgtggtatacatactcgcagacgtccgtggacggggccgtattccgaccatcctccagagacaattccaaagaacacgtctgtttactacaaattgaaacagcctggagacgcgaatgacacggctgtatactgcgcgagagacgtcggggacccacgaacgttacgacgccgttagcggtacgtcggtacggggaccaacggggtacccg

SEQ ID NO: 382197 - DNA, 717 bp, Homo sapiens
  misc_feature: GZ8MTXP02IZ8IQ.13.76.G10.1.454.CMB.2.raw
  modified_base (300)..(300): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtctgggaggaggcttgatccagccgtgggggtccctgagactctcctgtgcagcctcgtgggttcaccgtcagtcacacctacatgacgcgtcgggtcccnccgaggcctccggaaggggaaggggctggtagtggtcgttctttcttttaatttataggttagtaggtagtaacctagtacctccgactagaccgttccgtgggacggggacctattccacctactcctacccaaagaacaaacctaaacttacccgaaaagaaaccctacggttccttagttttacctaaacgaaaaagttcgaaaacctcgtacccgtaaggacggaacgacccgggtaatacggaaccgtaccgggttaccgttagttacttacggtgtacggaacggtaaggaacggtaccgggtaccggggaaacccctaaacgggttaaaacccgtttaaccgacgtaaccgttaacggtaccgggtacggtaccgggtaaccgggggaaacccgtaaacggggtaccccg

SEQ ID NO: 382198 - DNA, 625 bp, Homo sapiens
  misc_feature: GZ8MTXP02HLIMZ.13.76.G10.1.454.CMB.2.raw
  modified_base (461)..(461): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtcgggtccgccgaggcctccggaggggaaggggcgtgggagtggcgttctttcttttatttatagtagtggtagtaccatactcgacagtacctcggtggacggggcctattccgacctagtcctaccaggaactaacctaattacccaaagaacctcgtacttgtttactanaaatacgaaacagtaccgtaggagacgtaccgagtcgaaccgacgggtacctgttaacttgtggtacggacggagacggtacggtaccggggaccccaaacggtaaaccgtttccaacggtcgtaagtcgggtacgtcggtaccggggaccgaaacggaccccg

SEQ ID NO: 382199 - DNA, 546 bp, Homo sapiens
  misc_feature: GZ8MTXP02JH5K2.13.76.G10.1.454.CMB.2.raw
  modified_base (433)..(433): a, c, t, g, unknown or other
  modified_base (472)..(472): a, c, t, g, unknown or other
tcagtcacgtactacacgaccggtgctcgatttagtcactcatacaggggtgggagaggagcccagcactgggattccgaggtgtttccattcggtgatcagaactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgagggaaggggctggagtgcgtctctttattatagtagtggtagtaccatactccgcagactccgtgaggggccagttcaccatctccagagacaatccaaagaacacgctgtttctacaaatgtaaacngacctgagacgccgatagacacggccgtgtattactgtncgagagagtcgggggaccaacgtaaccgttcacggtcctaagtcggaacgtcgtacggggccaacgggaccccg

SEQ ID NO: 382200 - DNA, 622 bp, Homo sapiens
  misc_feature: GZ8MTXP02JYE78.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagagaactcaccatggagttttggctgagcttgggttttccttgttgcttattttaaaaggtgcccagtgtcaggtgcagctggtggaatcgtgggggaggcgtggtccagccgtggggaactccctgacactgtcttgtgtagcctctggattcagcttacagaacctatggcatgcacgtcgggtcccgccgacggcccccgagggcgaaggggcgtggaggtggctgtacttctttatcatatgataggaatactaaaaattctatgcagactccggtagacgggcacttcgaccgtctaccgaggacaacaccaacgaacctacttatatctgacagatacggaacagtaccgtaggaacggtaagggtacggaaccggtacgtaccgggtacttacgttaacgttaccgtttacggtcgttacggaccgaaaactaaaacgtagttaggtagtttaagggtttagggacggttaggtacgttaggtttacgttaccgtttaacccg

SEQ ID NO: 382201 - DNA, 851 bp, Homo sapiens
  misc_feature: GZ8MTXP02JIHX7.13.76.G10.1.454.CMB.2.raw
  modified_base (663)..(663): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtggttcaccgtcagtcacacctacatgagcgtcgggtccgccgaggcctaccggagggggaaggggcgtggagtcgcgttctttacgtttttaatttagtagttaggtggttaagtacctactacctccgactacggaccgttccgggtggggacgggggtcccgaactttacccgacctacgttccctacccgaaaggacgaaacccttaaaacttccccgaaaaaggtaaacccctacggttaccttttacggtttttaaccctttaaccgaaaaaagtttacggaaaaacccttagggacccccggtttaaggaaaacgggaccggtacccccgggttaaaagtacccggggtaaacccggtaccccgggggttccgtttaaaggtttaaaccttttaaccgggngggttaacgggaaccggggtaaacgggtaaccgggggtaaacccgggttaccccggggggaaaaccccctaaaacggggtttaaaacccgtttaacccgtaaccggtaacgttaaacgggttaccgggggtaaacccggttccgggggtaaacccgggggaaacccggtaaaacccgggggaaccccg

SEQ ID NO: 382202 - DNA, 598 bp, Homo sapiens
  misc_feature: GZ8MTXP02GHTPA.13.76.G10.1.454.CMB.2.raw
  modified_base (251)..(251): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtctggaggaggcttgatccagccgtggggggtccctgagactctcctgtgcngcctctgggtcaccgtcagtcacacctacatgagcgtcgggtccgccgaggctccgaggggaaggggctggagtgcgtcttctttattatagtagtgtagtaccatacctccgacagacctcggtgggacggggccgtattccacctagtcctacagagacataccaaagaacacgtctgtttactacaaatcgaaacagcctagagacgaccgaatcggaaccgaccgggtccgttaggtaattaccgtggtacgacggaagacggacgtaccgggggaccccaacggtaaaccgttactacggaacgtagtacggacggtcgacgggggacctaacggggacccg

SEQ ID NO: 382203 - DNA, 552 bp, Homo sapiens
  misc_feature: GZ8MTXP02FWCS2.13.76.G10.1.454.CMB.2.raw
  modified_base (445)..(445): a, c, t, g, unknown or other
  modified_base (488)..(488): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtggttccaccgtcagtcacacctacatgagctggtcccgccaggcctccgaggggagggctggagtgcgtcttcttttattatagtagtgtagtacatctcgcagctccgtgacggggcctattcaccatcctccgagacgaacaattaccgaaacgaacacgtcttagtttactaacaaatgaaacncgcctagagagtcccgatacgacgacggccgtagtacttacgngtgcgagagacggtcgggacccaagtaccgtaacgaccgactacgcggacgtcggtcggaaccg

SEQ ID NO: 382204 - DNA, 600 bp, Homo sapiens
  misc_feature: GZ8MTXP02GBGXO.13.76.G10.1.454.CMB.2.raw
  modified_base (364)..(364): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtgggtcccgccgaggcctccggaggggaggggcgtggagtgcgttcttcttttattatagtagtggtatacatacncgcagctcgtggacgggcctatccaccatcctcagagactaatccaaagaaccacgtcttcgtttactacaaaatcgaaacacgcctaggagacgtccgatcgacgtcgggtccgttagttacttacgtggtcgacggaaggtagacggtaccgggggacccctaaacgggtaaccgttacgacggtcgtacggtcgggaccgtcgggtacgggggacccgtaaacggggaccccg

SEQ ID NO: 382205 - DNA, 614 bp, Homo sapiens
  misc_feature: GZ8MTXP02HEXQ0.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctctggggttcaccgtcagtcacacctacatgagcgtgggtccgcccgaggcctccggaggggaaggggctggagtgcgtcttctttattatagtagtggtagtacatactccgacacgactcgtggacggggcctattccacctatcctaccagacaactaattccaaagaacacgtcttagtttactacaaatcgaaactagcctgacgacgcgatagaccgacggctagtacttacgtggtcgacggagaacgggtcgtaccgggggaccctaaacgtaaacccggttactaaccgtccgttaaggtccgggtaacggttccggtaccggggggaacccaaaacgggggtacccccgg

SEQ ID NO: 382206 - DNA, 622 bp, Homo sapiens
  misc_feature: GZ8MTXP02GGV3P.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtggttcaccgtcagtcacacctacatgagcgtcgggtcccgccgaggcctccggaggggaggggcgtggagtgcgtcttcttttatttatagtagtggtataccatacctccgcagaccgttcggtgggacggggccgtattccacctatcctacccgagacaaccgtaattacccgaaagaaaccacggtcttacgtttactacgaaaatcgaaacctagcctaggaagacgacccgagtcgaacgacggtccgttagtaattcgtgtcgacgagacggaggtccggggacccaacggtaaccgttacaccggtaacgtacggacgggtacgtccggtacgggggacccgaacgggtaaccccgg

SEQ ID NO: 382207 - DNA, 701 bp, Homo sapiens
  misc_feature: GZ8MTXP02JZE02.13.76.G10.1.454.CMB.2.raw
tcagtcacgtactacacgaccggtgctcgatttagtcactcatacaggggggggagaggagcccagcactgggattccgaggtgtttccattcggtgatcagcactgaacacagaggactcaccatggagttttggctgagctgggttttccttgctgcttattttaaaaggtgcccagtgtgaggtgcagctggtggagtcgtggaggaggcttgatccaggccgtgggggtccctgacgactctcctgtgcagcctcgtggtcaccgtcagtcacacctacatgacgcgtcgggtcccgccgaggcctaccggaggggaacggggcgtgggagtcggtacgttctttactttttagtttaagttaaggttaggttaggtaacgtactacttacctccgctacgacgtccggtgggacggggaccgtattccaccactcctaccagaactaaccaaattcccgaaaagactaccgtctttagttttacccttaagaaaactacgaaacgacgtacccgtaggaacgaacggcccgaagttaccggaccggtaacgggtccgttaagttaccgtttacgtgttacggaccggaaggacggtacggtaccgggggacccctaaacgggttaacccgtttaacgaaccggttccgttagggtacgggtaccggttcggtacccgggggaccgaaacccggggg

SEQ ID NO: 382208 - DNA, 609 bp, Homo sapiens
  misc_feature: GZ8MTXP02ILJ1V.13.76.G10.1.454.CMB.2.raw
  modified_base (274)..(274): a, c, t, g, unknown or other
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagcccaccctcagtcgtcccgtgtccccaggacagacagccagcatcacctgctctaggaaataatggcagaataatatacttctgtatcagcagatcaggccagtccccngtgctggtcatctatcaagatcgaccaaggccgtccctacgagggtaccctcccgtgacgcgtattccgtctggtcctaccaacgttccgtaggggaactcgaacgccctactctacgaccactccgacggcccggacccaggacctagtcgggatgggaacggtcttcgtaacttagttaccgtggtaccgaggggtacggtacgggaacagggacaacggcccgtaacggtccgacccggttacttacgttccgttaccgtttaccgggaacgtaaccggggtaacccgtaacgggttcccaaaccggttaccctaacggtacccgaacccgg

SEQ ID NO: 382209 - DNA, 527 bp, Homo sapiens
  misc_feature: GZ8MTXP02IRQ4O.13.76.G10.1.454.CMB.2.raw
  modified_base (296)..(296): a, c, t, g, unknown or other
  modified_base (384)..(384): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccnccaggctccgagggaaggggctcgagtgcgtctcttttattatagtagtggtagtacatactcgcagctccgtgaggggccattcacntctcagagacaattccaaagaccacgcttgttctacaaatgaacagcctagagacgccgatgacacggccgtagtatactgtgcgagagagtcggggacccacgaacgttaacgtacgctacgtggacgtcgtacgggaaccg

SEQ ID NO: 382210 - DNA, 783 bp, Homo sapiens
  misc_feature: GZ8MTXP02JKVV0.13.76.G10.1.454.CMB.2.raw
  modified_base (500)..(500): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtctggaggaggcttgatccaggccgtggggggtccctgagtactctcctgtgcagcctcgtcggtcaccgtcagtcacacctacatgagcgtcgggtccgccgacggcctccggaaggggagggcgtggacgtgtcgttcttcttttattagtagtagtaggtataccactaccgtcgcacgacgtccggtggacggggtcctacgttccaccgtactacctcaagaacgtaactaaacttacccgaaagtaacccgtacgttaccgttagttttaccctaaacaaaagttacgaaaaccncgggtaaccccttaggaaacggtacccgtccgggtaaagttaccggaaacccgtacccgggggttaccctttaaggttaaaccgtttaccggtagggttacggaaccggggtaaaggtaaccgggtaccggggttaaccccggggggaacccccttaaaacccggggttaaaacccggttaacctacccgggtaaccgttaacgggtaccgggggttacccgggttaaccgggggtaccgggggaaaacccccggggtaaacccggggtttaaaccccccggg

SEQ ID NO: 382211 - DNA, 640 bp, Homo sapiens
  misc_feature: GZ8MTXP02HDTWO.13.76.G10.1.454.CMB.2.raw
  modified_base (297)..(297): a, c, t, g, unknown or other
  modified_base (314)..(314): a, c, t, g, unknown or other
  modified_base (365)..(365): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtcccncgagctacgagggaggntggagtgcgttcttactttaattatagtagtaggtacgtacatacgtccgnaacgtccgtccggtaggacggggtcctattcaccatcctaccgaaagagtaaactaaacttaaccgaaaagtaaccacgtactttacgttttacctaacaaaagtaacgaaacgaacgaccgtacgacgaacgaccgaacgtaacgaacgacggtaccggttacgtaacgttaacgtacgtacggacgacggaaggaacggtacggggtacccgtaaccggtaaaccgttaaccgtaacgtacgtacgtacggtacggtacggtacgggaaccgg

SEQ ID NO: 382212 - DNA, 584 bp, Homo sapiens
  misc_feature: GZ8MTXP02H9NXO.13.76.G10.1.454.CMB.2.raw
  modified_base (369)..(369): a, c, t, g, unknown or other
  modified_base (378)..(378): a, c, t, g, unknown or other
  modified_base (403)..(403): a, c, t, g, unknown or other
  modified_base (436)..(436): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctcgtgggttcaccgtcagtcacacctacatgagctcgggtccgccgaggcctccgaggggaaggggctggagtgcgttctctttttattatagtagtggtagtaccatactccgnagactccgngacggggcagttcacatctccaganacaattccaaagacacgcttgtttctacaaatnaaacagcctagagagccgatcgaacgacggcctgttattacgtgtgacgagaggacgtacgggggacccaacggtaaaccgttacgtaacgcgttaagtacgggtaacggttccggtacgggggaacccgaaacgggggaacccccgg

SEQ ID NO: 382213 - DNA, 664 bp, Homo sapiens
  misc_feature: GZ8MTXP02G77QA.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtggtccaccgtcagtcacacctacatgagcgtgggtccgccagggcctccggaggggaacggggctgggaggtcgcgttcttacttttatttatagttagtggtagtactactacgtccgacgagccgtccggtggggacgggggacccgtactttaccgacccgtacttcccgtaccgaacggtaacgtaaactaaacgtttacccgaaaagtaaccaccgtctttacggtttaccttaactaaaagtcggaaaccacggtcccgtagaggtaccgcccgaagtacgacgaccggtcgtacgtaattctggtgacggaggacgagggtccgggaccccgaaggtaaacccgttaacgtaaccggtacgtacggtacgggaccgtttcgggacgggggaaaccccgg

SEQ ID NO: 382214 - DNA, 638 bp, Homo sapiens
  misc_feature: GZ8MTXP02H93WJ.13.76.G10.1.454.CMB.2.raw
  modified_base (377)..(377): a, c, t, g, unknown or other
  modified_base (463)..(463): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtctgggaggaggcttgatccagccgtggggggtccctgagactctcctgtgcagcctcgtcgggttcaccgtcagtcacacctacatgagcgtcgggtccgccgaggcctccggaggggaacggggcgtaggagtcgcgttcttctttttattatagtagtggtataccatactccgnagacctcggtggacgggggccagttcaccagtctccagtagactaacttccaaagaacacgtcttacgtttctacaaatagaaacncgacctaggaagacgaccgaatcggaaaccgccgggtaccgttagttaacttacgtagtcggacgaaacgggtaggacggtaccgggggaacccctaacggtaaaacccgtttcgaaccgtcgttacggacggggtacgtcgggtaccgggggaaccgaaaacggggaaccccgg

SEQ ID NO: 382215 - DNA, 604 bp, Homo sapiens
  misc_feature: GZ8MTXP02F15PV.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagctgggtccgccaggcctccgaggggaaggggctggagtgcgtcttcttttattatagtagtgtagtacatactcgcagctcgtggaggggccattcaccatctccagacgacaattacccaaagaaccacgtcttgtttactacaaaatacgaaacacgtacctagaagacgacccgatacgaaccgaccgggtaccgtagtaactttacgtggtggacggtaaggacggtacgtaccgggggaccccctaacgggtaaaaccgttaaccgtacgtaccgttagtacgggtacggttacggtacgggggaacccgg

SEQ ID NO: 382216 - DNA, 671 bp, Homo sapiens
  misc_feature: GZ8MTXP02FPX5P.13.76.G10.1.454.CMB.2.raw
  modified_base (360)..(360): a, c, t, g, unknown or other
  modified_base (469)..(469): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtgggtccgccaggctccggaggggaggggctggagtgcgtcttcttttatttatagtagtggtataccatacncgcagactcgtggacggggccgattccacctatcctccaagacgtaactaaacttacccaaaagaaaccacgtctttaggtttttacctaacaaaaagttcgaaaaccnggaccccgttaggaacgacggacccggaattacggacccgaccggggtcccttaggttaactttaccgtgggttacggaccggtaaggacggtacgggttccgggggaccccctaaacgggtaaaccgtttaccgttacggaaccgttaaggtacggggtaaccggttcggtacgggggaaccccaaagggggtaacccccg

SEQ ID NO: 382217 - DNA, 559 bp, Homo sapiens
  misc_feature: GZ8MTXP02JY7Y7.13.76.G10.1.454.CMB.2.raw
  modified_base (398)..(398): a, c, t, g, unknown or other
  modified_base (435)..(435): a, c, t, g, unknown or other
  modified_base (439)..(439): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgtccagtgtgaggtgcaactgttggagtcgtgggggagcttggttcagccgtgggggtccctgagactctcgtgtgcagtcctctggtattttagtttagctagttatgccatgagcgtcgggtccgccgaggcctccgaggggaagggctgggaggtggggtttcggtattagtgcttctgatgatgcaccatactatgcagactcggtaaggcctcttcacatcncagacgaacacttacaaagaacacgctatctactganaganacgacgacgacgacggacgacgacgacgacgtacgttactactacgtagtacgacgaagtaagtagttagtagtacgtagtagtaagtacgtacgtactacttacttacgtttacgtacg

SEQ ID NO: 382218 - DNA, 589 bp, Homo sapiens
  misc_feature: GZ8MTXP02HVC4G.13.76.G10.1.454.CMB.2.raw
  modified_base (296)..(296): a, c, t, g, unknown or other
  modified_base (409)..(409): a, c, t, g, unknown or other
  modified_base (479)..(479): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctcgtgggttcaccgtcagtcacacctacatgagctgggtccnccaggctccgaggggaggggctggagtcgcgttcttcttttatttatagttagtggtagtacatacctcgacagacctcgtgggaggggccaattccaaccatctaccagaanacaattaccaaagaaccacgtcttacgttttactacaaaatcgaaacacgtccctaggagacgaccgtanagaccgacggtccgtaggttatacttggcgacggaagtgaacgtcgggggaacccacgtaaaccgtacacgctagtacggcggtacggtcggggaccgaacggaacccgg

SEQ ID NO: 382219 - DNA, 692 bp, Homo sapiens
  misc_feature: GZ8MTXP02JWY5H.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggtcaccgtcagtcacacctacatgagctcgggtccgccaggcctaccggaggggaaggggctggagtgcgttcttcttttattagtagtagtggtataccatacgtccgacagaccgtccggtggacggggtccgattccaccacttcctacccaagaacgaacctaaacgtttacccaaaacgaacccaccggtctttacggttttacctaaaccaaaattacggaaaccacggtacccgtaaggacgaccggacccggtaataccggaaccgtaccgggtacccgttagttaacgtttacggtggtacggacggaacggtacggtacgggtacccggggaacccctaaacggttaaaccgttaaccgacgtaacgttaacggtacgggtacccggtacgggtaccgggggaaccgtaaccgggggtacccg

SEQ ID NO: 382220 - DNA, 663 bp, Homo sapiens
  misc_feature: GZ8MTXP02JMZIS.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtctggaggaggcttgatccagccgtgggggtccctgagactctcctgtgcagtcctcgtcgggttcaccgtcagtcacacctacatgagcgtcgggtccgccgaggctccgaggggaggggcgtggagtgcgttcttcttttatttagtagtagtggtagtaccatactccgcagacctccggtgggacggggtccgtattccgaacctactcctacccgaagacgaaacctaaacttaccgaaaagaacccacgtcttgttttacctaacaaacttacggaaacacggtccgtaggacgacgtaccgaagtcgaccgtaccgggtcgttagttactacgttgacggacggaaggacgtacgggtaccggggacccctaaacggtaaacccgtttaccgaacggtccgtaagtaccgggggtacgtaccggggtacggggaacccggaacggggtaacccccgg

SEQ ID NO: 382221 - DNA, 770 bp, Homo sapiens
  misc_feature: GZ8MTXP02HVLV5.13.76.G10.1.454.CMB.2.raw
  modified_base (298)..(298): a, c, t, g, unknown or other
tcagtcacgtactacacgaccggtgctcgatttagtcactcatacagggggggagaggagcccagcactgggattccgaggtatttccattcggtgatcagcactgaacacagaggactcaccatggagttttggctgagctgggttttccttattactattttaaaggtgtccagtgtgaagtgcagctgggtggagtcgtgggggaggcttggtacagcctggcaggtccctgagactctcctgtgcagcctgtggacttcacttgatgattatgccatgctacgtcgggtccganaacgccgtacggaggggacggccgtgggtaggtcggtctacgtagggtttagttaggttaggaaagttaggtagggtacgtcgtaaggtacgggtcttacggtcgggtaccgggtacgtttacggttaggggtaacggggtaaaccgggggtccctaaacgttttacccgaacccttacgttacccgtacccgaaagggaacccggaaacccgaaaacccgaccccgtaaaacggtaacccccttaccccgttaggttaaccttacgtacggaaactaaaacgtacgaaaccgtacggacccgtaggaacgtacggacgtacggacggaaccgtacggttaccgtttagttaacgtttagttagtaacgtaaacgtaaaaccgtaccttaaccccgttaacccgtttaacgttttaggttttaacgggtaggtttaacggtttaccgtaacggggttacgggtacccggggg

SEQ ID NO: 382222 - DNA, 667 bp, Homo sapiens
  misc_feature: GZ8MTXP02FQLDR.13.76.G10.1.454.CMB.2.raw
  modified_base (385)..(385): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctatttaaaggtgcccagtgtgaggtgcagctggtggagtctggaggaggcttgatccagccgtgggggtccctgagactcctcgtgtcgcgcgtctcgttcggtcaccgtcagtcactacctacatgagtcgtcggccgcgcggctaccggaaggggacgggcgtgggagtcgtcgttctttacttttattagtagtgtagtagtacatcgtcgcacgtcgtcgnggacgggtctatcactctctaccgagacgaactactacgaaagaacacgtcgtttcgtttaccaataaaagttacgaaacgtccgtaccgtaggaacggaccgtaccgaagtaccgaaccgggtaccggtcccgttaaagtttaacgttacggttcggtaccgaagggaaaggaacgggttaacggggtacccggggaaaccccgtaaaaccgttaaaccggtttaacgaccgtaacgtacgggtaccgggtacgttccggggaccggggaaaaccccgggg

SEQ ID NO: 382223 - DNA, 626 bp, Homo sapiens
  misc_feature: GZ8MTXP02HRL59.13.76.G10.1.454.CMB.2.raw
  modified_base (520)..(520): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtttggaggaggcttgatccagccgtggggggtccctgagactctcctgtgcagcctcgtgggttccaccgtcagtcaccacctacatgagcgtcgggtcccgccgaggcctcccggaagggggaacggggcgtgggagtgcgttctttctttttatttatagtagtggtagtacactactccgcagactccggtggcggggcctattccacctatcctaccaagacgaactaaacttaccaaagaacacgtcttgtttactacaaatcgaactagcctagacgtagccgagtcgaacgacgggtccgttagtaactttacgnggtacgacggaggaacggtggtaccgggggacccctaaacggtaaaccgttcaacgctaaagcgggtaacgtcggacggggacccgaaacggggtacccgtaccgg

SEQ ID NO: 382224 - DNA, 687 bp, Homo sapiens
  misc_feature: GZ8MTXP02H2FW5.13.76.G10.1.454.CMB.2.raw
  modified_base (248)..(248): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtgggagtcgtgggaggaggcttgatccagccgtggggggtcctgagactctccngtgcacgcctcgtgggttcaccgtcagtcacacctacatgagcgtcgggtccgccgaggccgtaccggagggggaacggggcgtggggagtcggtcgttctttacgtttttaattagtaaggttaggtaggtataccgtactacctcgactacgaccgttccgggtgggaacgggggcctacgttccaacctactcctaccgaagaacgaactaaacttaccaaaaggaaccctaacgtccgttacgtttacttactaaattacgaaacacgtacctaggaacgaacggacccgtagtcgaaaccgacggttacccgtagttaacttacgtgacgacggaaaggacggacgtaccgggggaccctaaccggtaaccgttactacggtaacgtacggtacggaccggtaccggtacggggacccgtaaacgggaacccgg

SEQ ID NO: 382225 - DNA, 700 bp, Homo sapiens
  misc_feature: GZ8MTXP02IUGMR.13.76.G10.1.454.CMB.2.raw
  modified_base (655)..(655): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtcctgagactctcctgtgcagcctcgtgggttcaccgtcacgtccacacctacatgagcgtcgggtccgccgaggcctccggaaggggaacggggcgtggagtcggtccggtttctttacgtttttaatttagtagttaggtaggttagtaccattacctcccgacacgtaccgttccgggtcggggacgggggtacccgtaacttcccgaacctacgtccctacccgaaagaacgaaacctaaacttacccgaaaggtaaacccacgttctttacgtttaccttaacgaaaatacgaaacaacgtccgtaggaacgacggacccgaagtaccgaaccgtccgggtaccgttaggtttaacttacgtggtacggacgaagggagtacgggtaccggggaccctaaacggtaaaccgttctaaccgngttacgtacgggtacgttacggcggggaaccaacggggtaccccg

SEQ ID NO: 382226 - DNA, 667 bp, Homo sapiens
  misc_feature: GZ8MTXP02HJZAV.13.76.G10.1.454.CMB.2.raw
  modified_base (375)..(375): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtcgggttcaccgtcagtcacacctacatgagcgtcgggtcccgccgaggcctccggaggggaacggggctgggagtgcgttcttcttttattatagtagtggtagtaccatactccganacgacgtccggtggacggggctacttccgaccatcctacccgaagacgaacctaaacttacccgaaagaaccgtacgtctttagttttacctaacaaagttcgaaactcgcctaggacgtacgacccgtaagtccgaaccgtaccgggtccgttagttaacttacgtggtacgacggaaggtacggacggtccggggaacccctaacggttaaaccgttaaccgtacggtaaccgttaggtacgggtacccggttacggaccgggggaacccgtaaacgggggtaacccccg

SEQ ID NO: 382227 - DNA, 612 bp, Homo sapiens
  misc_feature: GZ8MTXP02G5THC.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccaccaggctccgagggaggggctggagtgcgtctcttttattatagtagtggtagtacatactcgcagacctcgtggacggggccagttccaccgatcctacccaagagaacctaaattcccaaaaggtaacccacgtccttagtttacttacaaaattcgaaaactgaccctaggaagacgacccggaatcggaaccgacgggtccgtagttaacgttaccgtgtcgacggagacggacgtacgggggacccctaacggtaaaccgttctaacggccgtaagtcgggaacgttcggacggggaccgaaacggggacccg

SEQ ID NO: 382228 - DNA, 786 bp, Homo sapiens
  misc_feature: GZ8MTXP02H2V2T.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaggtgccagtgtgaggtgcagcgtggtggagtcgtgggaggaggcttgactccagtccggtgggggtccctgacgactctccgtgtcgcacgtccgtcgtcgggttccaccgtctagtcaccgtacctacatgacgtcgtcgggtccccgccgaacggcctaccgggaagggggaacggggtccgtaggggtacggttcggtccgtttctttacgttttttaagtttagttaaagggttaggttaggggttaacgttaaccctacgtttaacccgtccggaaccgtaggtacccggtcggttagggaccgggggtacctacgttccaaccgtactctacccgagaacgaacctaacgttccaaaagaccctaggtctttacgtttactaacgtaagtacgacgacgtcgtaaggtacgaccggcgaacgttggaaacccggtccggtttaccggtagtttaccctaaggttcggacgtaccggtaagggtacggtaaacggttcccgggggaccccttaaacgggtaaacccttttacggaaccggttaaccgttacggtaaccgggtacgggttacccgggtttacgggggaaacccgttaaaccgggggaaccccgg

SEQ ID NO: 382229 - DNA, 591 bp, Homo sapiens
  misc_feature: GZ8MTXP02JZP66.13.76.G10.1.454.CMB.2.raw
  modified_base (439)..(439): a, c, t, g, unknown or other
tcagtcacgtactacacgaccggtgctcgatttagtcactcatacagggggcccagcactgggattccgaagtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctggttcaccgtcagtcacacctacatgagctggtcccgccgaggctccgaggggaacggggctggagtgcgtcttctttatttatagttagtggtagtacatactcccgcagactccgtggacggggccagttccaaccatcctaccagacgacaacttaccaaagacacgtcttgtttactacaaatgaaacngcctagacgagccgatcgacgacggctgtatactgtacgcgagagtcgtcgggggaccctaacggtaaacgttacgtaaaccgctaacgttcgggaacggttccggacgggggaccccgaaggggaccccgtaaccggtccgtaacccccgg

SEQ ID NO: 382230 - DNA, 696 bp, Homo sapiens
  misc_feature: GZ8MTXP02IVK9E.13.76.G10.1.454.CMB.2.raw
  modified_base (520)..(520): a, c, t, g, unknown or other
  modified_base (533)..(533): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtgggaggaggtcttgactccgaggtccggtggggggtccctggagacttctccgtgtcgctacgcctcgttcgggttcaccgtcacgtcaccacctacatgacgcgtcgggtcccgccgaggcctaccggaagggggaacggggtccgtgggtacgtcggtccgtttcttttacgtttttaatttaagttacggttaggttaggttacgtaacctactaccgtccgacacgtaccgtcgtggggaccgggcctacgttcaccctatccctacaagtacgaactacgttacaaagaaccacgtccttagtttacctaanaaaatcgaaaacncgtaccgagtacgacgaccggatacgaccgtacggtcgttagttattaccgtggacgaaggacggaggcggtaccgggggaccctaaacggtaaaccgttacgtaccgtaacgtaacggtccgggaccggttcgaccgggggaaccgaaaccggggtaacccg

SEQ ID NO: 382231 - DNA, 602 bp, Homo sapiens
  misc_feature: GZ8MTXP02GIW82.13.76.G10.1.454.CMB.2.raw
  modified_base (378)..(378): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtgggtcccgccgaggctccgaggggaagggactggagtgcgtcttcttttattatagtagtggtagtaccatactcgacagaccgtccgngggacggggcccgtattccaccatcctaccagacgaactaaattacccaaagaaaccgacgctttcgttttacctaacgaaaattcgaaaactacgccctaggaagacgaccgatacgacgaccggtccgtagttattacgtgtagtagagacgagtacggggaccctaacgtaaccgtactacgcgtagtacggacgttcgacggggacccgaacggacccgg

SEQ ID NO: 382232 - DNA, 630 bp, Homo sapiens
  misc_feature: GZ8MTXP02I5J57.13.76.G10.1.454.CMB.2.raw
  modified_base (422)..(422): a, c, t, g, unknown or other
  modified_base (512)..(512): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtgggtcccgccgaggctccgaggggaggggctggagtgcgttcttcttttatttatagtagtggtataccatactccgcagacctcgtggacgggccgattccaccatcctaccagagactaattacccgaaanaaccacgtcttacgttttcctaacaaaattgaaaacctgtcccgtgaaggaccgccgtaatacgacgtaccggtccgttagtatttacgngtgacggtagaggtacggtaccggggacccctaacggttaaaccgtttaccgtaaccggaacgttaaacggtcgggtacccggttccggtacgggggacccgaaaacggggtaccccg

SEQ ID NO: 382233 - DNA, 568 bp, Homo sapiens
  misc_feature: GZ8MTXP02J0EUQ.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgccaggctccgaggggaggggctggagtgcgtctcttttattatagtagtggtagtaccatactccgcagctcgtggacggggccattcaccatctccagagacaacttaccaaagaacacgtcttgtttacttacaaatcgaaacagcctgagacgccgatcgacgacgggccgtagtattcgtgtgcgtaggagacggtcggggaccccaacggtaaccgttacgtacgcgtacgtcgggaccgtcggtacgggggaccgaacggggaccccg

SEQ ID NO: 382234 - DNA, 682 bp, Homo sapiens
  misc_feature: GZ8MTXP02HMFY4.13.76.G10.1.454.CMB.2.raw
  modified_base (295)..(295): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggtcaccgtcagtcacacctacatgagcgtgggtcccnccgaggctccggaggggaacggggcgtggagtgcgttctttcttttatttatagtagtggtataccatacctcgcagacctcggtgggacggggtccgtacttccaacctagtcctaccgaagtacgaacctaaacttacccgaaagtaaaccgtaccgtcttacgttttaccttaacaaaacgttcgaaaaccacgtcccgtaggaacggacgacccggtatacggaacccgtacggggtcccgttagttaaactttaccggtggtacggaccggaaggaggggtacggtaccgggggacccctaaacgggtaaaccgtttaaccgtacggtaacgtacgtacgggtaccggtcggtaccgggggaccgtaaaacggggaccccgg

SEQ ID NO: 382235 - DNA, 576 bp, Homo sapiens
  misc_feature: GZ8MTXP02HHGF5.13.76.G10.1.454.CMB.2.raw
  modified_base (365)..(365): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggttcaccgtcacgtcacacctacactgagcgtcgggtccgccaggctccgagggaaggggctggagtgcgtcttcttttattatagtagtggtagtacatactcgnagactcgtgagggctatcaccatctccagagacaattccaaagaacacgcttgtttactacaaatgaaactagcctagagagcccggatcgacgaccggaccgtagttaacttactggtacgcggaggtagacggtacggggaccccaaagtaaccgttaacctacgcgtacgtcgggtacgttcgacgggggacccaaagggggaccccg

SEQ ID NO: 382236 - DNA, 632 bp, Homo sapiens
  misc_feature: GZ8MTXP02G8YGM.13.76.G10.1.454.CMB.2.raw
  modified_base (486)..(486): a, c, t, g, unknown or other
  modified_base (545)..(545): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttaattttaaaaggtgcccagtgtgaggtgcagcgtggtggagtcgtgggaggaggcttgatccgagccggtgggggtccctgagactctcctgtgcagcctcgtcgggttcaccgtcagtcacacctacatgacgcgtcgggtccgaccgaggccgtaccggaaggggaaggggcgtagggaggtcggtcgttctttcttttagttagtagttagtaggtataccctatacctccgacacgacgtccggtgggacgggcacttccaacctactcctaccagaacaactaactacccaaagaacccacgttccttgttttacctaaanaaacgtcgaaactccgtcaggacgacgacgtaagcgaacgtacggtcttagtactacgngtcgacgtaggacgtacgggtacccggaacctaacgtaacgttacgacgtcgtaggtcggacggtacgggacgggaccgaacggccg

SEQ ID NO: 382237 - DNA, 738 bp, Homo sapiens
  misc_feature: GZ8MTXP02HSNU6.13.76.G10.1.454.CMB.2.raw
tcagtcacgtactaacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagtcctcgtgggttcaccgtcagtcacacctacatgagcgtcgggtccgcgacggcctccggaggggaacgggcgtggagtcgtcgttctttacttttatttagtaggttagtggtaacgtaccatacctccgatacgaccgttcggtggggacgggggtcctagtttcccaacctacgtacctaccgaagggtaaacaaacctaaaccttaccgaaaaggtaaccctaaccggtcttttacggttttaccctaaataaaaacgttcgaaaacctcggtacccgttaagggaacgaccggacccgtaagtaccgggaacccgtaacggggtcccgttaggtttaaactttacgggtacggtacgaccggtaaaggtacggtaccgggtacccgggggaacccctaaacggttaccgtttaaccgacggtaacgttaacggtacggggtaccggtaccgggtaccgggggaacccgtaacggggtacccg

SEQ ID NO: 382238 - DNA, 648 bp, Homo sapiens
  misc_feature: GZ8MTXP02GVF2N.13.76.G10.1.454.CMB.2.raw
  modified_base (210)..(210): a, c, t, g, unknown or other
  modified_base (213)..(213): a, c, t, g, unknown or other
  modified_base (227)..(227): a, c, t, g, unknown or other
  modified_base (464)..(464): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtcgtccgtcgtccccaggacagacagccagcatcactnctnagaaataatgacanataaatatactctgtatcagcagagtcaggccacgtcccctgcgtctcgtcattctatacgaagtactcggacccaaaggccccggtaccctacggaacggggtaccttacccccccggtggaccgtacgttactttcccgtacgtcgggtcccttacccgaaacgttccgtaggggtaacctcgaaccgtacccctactcccgtacgacccacgtccggacgggacccgggacccnggtactaggtggtagtcgaggtacctagtacgttaacgttacgtcgtacgacgggtacgggtacggaacgacgtacgacgtaccgtaccgtccgtacccgtacttacggttcgttaccggtaccggaacggtaccggtaaccgtacggtacccgtacccgtacgtaccgtaccgaaccgacccg

SEQ ID NO: 382239 - DNA, 614 bp, Homo sapiens
  misc_feature: GZ8MTXP02F0CUJ.13.76.G10.1.454.CMB.2.raw
  modified_base (365)..(365): a, c, t, g, unknown or other
  modified_base (462)..(462): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttgggactgagctggattttccttttggctattttaaaaggtgcccagtgtgaggtgcagctggtggagtcgtggaggaggcttgatccagccgtggggggtccctgagactctcctgtgcagcctcgtgggttccaccgtcagtcacacctacatgagcgtcgggtccgccaggcctccgaggggaggggctggagtggcgttcttcttttattagtagtagtggtatacatacncgcagacgtccgtggacggggccattccacctagtcctacagacgaacctaacttaccaaagaaccacgtccttagtttcctagaaaatcgaaaccncgtacctggagacgaccgatcgacgacgggtccgtagttacttacgtggtacacggaagacggtacggtcggggaacccctaacgggtaaaccgttaccgtaacgtgtaacggtcgggaccgttcggacggggaacccgtaaggggaccccg

SEQ ID NO: 382240 - DNA, 776 bp, Homo sapiens
  misc_feature: GZ8MTXP02GVTOX.13.76.G10.1.454.CMB.2.raw
  modified_base (385)..(385): a, c, t, g, unknown or other
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccccgagactctcctgtgcagcctcgtgggttcaccgtcagtcacacctacatgacgcgtcgggtcccgccgaggcctccggaggggaacggggcgtggagtgcgttcttcttttattatagtagtgtagtaccatactcgacacgtaccgtcgnggacgggcctacttaccaccgactcctaccgaaagacgtaaacctaaacttacccgaaaaagaccgtaaccgttctttacggttttaacctacgtaaaacttacggaaaaccgtcggtacccttaaggaacggtaacggtacccggaagttaccgggaaccgtaaccgggggttccccgtttaaggtttaaaccgtttaccgttagggtacccgggtacggtaaaaggggaaccggttaccgggttaccccggggggaaacccccttaaaaccgggtttaaaacccggttaaccccgtttaacgggaacccgtttaaaaggggtccggggttaaacccggtttaccggggccgggggaaaaccccgtaaaaccgggggttaaaccccccgg

SEQ ID NO: 382241 - DNA, 589 bp, Homo sapiens
  misc_feature: GZ8MTXP02JXQJ7.13.76.G10.1.454.CMB.2.raw
  modified_base (293)..(293): a, c, t, g, unknown or other
  modified_base (399)..(399): a, c, t, g, unknown or other
  modified_base (432)..(432): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccnccaggctccgaggggaggggctggacgtgtcgtcttctttttattatagtagtggtataccatactcgcagaccgtcgtgggaggggccattcacattcaccaganacaaattaccaagaaccacgtctgtttcctaanaagtacgaacgacgcgtacgagacgacgacgtacgacgacggtacgtacgtacgttacgtcgtagacggacggagtacggtacgggacccgtaacgtaaccgttacgtacgtaacgtacgtacggtacggtacggtacgggaccggaacggaaccgg

SEQ ID NO: 382242 - DNA, 590 bp, Homo sapiens
  misc_feature: GZ8MTXP02HGRR7.13.76.G10.1.454.CMB.2.raw
  modified_base (457)..(457): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtgggtcccgccgaggcctccgaggggaaggggctagggagtgcgttcttcttttattatagtagtaggtagtaccatactccgcagacctcgtggacggggccgtattccacctatctccaagacgaaccaattccaaagaacacgtccttagtttctacaaatgaaacngcctaggacagccgatacgacgaccggtcgtagtaacttacgtgtgacgaagaggtacggtcggggacccaacgtaaacgttaccacggtcctagtcggtacggtcgtcgggggaccgaaacgggtaccccgg

SEQ ID NO: 382243 - DNA, 623 bp, Homo sapiens
  misc_feature: GZ8MTXP02IB4DA.13.76.G10.1.454.CMB.2.raw
  modified_base (376)..(376): a, c, t, g, unknown or other
  modified_base (460)..(460): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtgggaggaggcttgatccagccgtggggggtccctgagactctcctgtgcagcctcgtggggttcaccgtcagtcaccacctacatgagcgtcgggtcccgccgaggcctccggaggggaacggggctgggagtgcgttcttctttttattatagtagtggtatacatactcgnagtactccgtggacggggcattccacatctcatagactaagtacccaaagacctacgtctttagtttactaacaaatgaaaacncgacctaggacgacgcccgaatcggaactaccgggtctagttaagttacgtggacgacgaggtacggaacttccgggggaacccctaacggtaaaccggttttcaaaccggccttaaaggcgggtacggtaccggtcgggggaacctaaaccggggaccccgg

SEQ ID NO: 382244 - DNA, 644 bp, Homo sapiens
  misc_feature: GZ8MTXP02FS5B2.13.76.G10.1.454.CMB.2.raw
  modified_base (493)..(493): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatccagccgtgggggtccctgagactctcctgtgcagcctcgtgggtcaccgtcagtcacacctacatgagcgtcgggtcccgccgaggcctccggaaggggaaggggcgtggagtcgcgttcttctttttatttagtagtagtggtagtacctatacctccgcacgacctcgtgggacggggccgtattccgacctactcctacccaaagacgtaacctaaacgttaccaaaagaacctaccgtctttacgttttaccttaacaaaagtcgaaaacncgtacctagacgacgaccgatcgaaccgacggccgttatacttagtggtgacgaggacgtacggtaccggggacccaacgggtaaccgttacctacgcgttaacggtacggtaccggtcggtacgggggaccccaaacgggggtaaccccg

SEQ ID NO: 382245 - DNA, 583 bp, Homo sapiens
  misc_feature: GZ8MTXP02I4HM0.13.76.G10.1.454.CMB.2.raw
  modified_base (341)..(341): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgccaagtgtgaggtgcagctggtggagtctggaggaggcttgatccagccgtggggggtccctgagactctcctgtgcagcctctgggttcaccgtcagtcacacctacatgagcgtggtccgccgaggctccgaggggaagggctgggagtgcgtcttcttttattntagtagtgtagtacatactcgcagctccgtggaggggccattcgacctagtcctccagagaactaacttaccaaagaccacgcttgttactacaaatgaaacacggtcctagagacgccgatcgacgacggtccgtagttacttactggtcgacggagacggtacgtaccgggggtacccacggtaaaccgtttccgaaccgtacgtaacggtcgggtaaccgtcggttacgggggaacccg

SEQ ID NO: 382246 - DNA, 626 bp, Homo sapiens
  misc_feature: GZ8MTXP02IWUZP.13.76.G10.1.454.CMB.2.raw
  modified_base (462)..(462): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtgggttcaccgtcagtcacacctacatgagcgtcgggtcccgccgaggctccgaggggaggggcgtggagtggcgttctttcttttatttatagttagtaggtatacatactcgcacgccgtcgtgggacgggcctacttccaccactctaccagacactaactaccgaaagaaccacgtctttgtttacctaacaaagtgaaacngcctaaggagaccgtccgatcggaccgacggtccgttagttacttacgtgtacgtacggagacggtacgggtacccgggggaaccctaaacggtaaaccgttacctaacggtctaggtacgggtaccggttcgggtaccgggggaccgaaacgggggtaccccg

SEQ ID NO: 382247 - DNA, 657 bp, Homo sapiens
  misc_feature: GZ8MTXP02HKU4Y.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtggggttcaccgtcagtcacacctacatgagcgtgggtcccgccgaggctccgaggggaggggctggagtgcgtcttcttttattatagtagtggtagtaccatactccgcagactccgtggacggggccgattcaccatctccaagacgaactaaacttcccaaaagaaacccacgtccttagttttaccttaacaaaattcgaaaacacgtccctaggaagaccgcccgtaagtcgaaaccgacgggtcccgttagtaactttaccgtggtcggacgaaggaggtacggtacgggggaccccctaaacggtaaaccggtttacctaacgggtaaccttaaggtacggggtaacccggtttcggtaccggggggacccctaaaaacggggggtacccccg

SEQ ID NO: 382248 - DNA, 701 bp, Homo sapiens
  misc_feature: GZ8MTXP02F62AA.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagtcgtcgggtccccgccgagggcctaccggaggggaacggggcgtagggaggttcgccggtttactttacgtttttaatttagttaagttaggtaggttataacccacttaccgtccgacacgtacccgttccggtggggacgggggtccgtattccgacctatccctaccgaagacgtaacctaaacttacccgaaagaaccgacgtcctttagttttaccttaacaaaagtacgaaaccgtacgaccgtaaggacgaaccggtacccgaagtacgaaccgaccggggttcgttacgttacttacgtggtacgacggtaaggacggtacggtaccgggggaccccaaacggtaaccgttactaacggtcctaggtaccggtacggtcggtacggggacccgaacggggtaaccccg

SEQ ID NO: 382249 - DNA, 671 bp, Homo sapiens
  misc_feature: GZ8MTXP02HZU1G.13.76.G10.1.454.CMB.2.raw
  modified_base (333)..(333): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtctggaggaggcttgatccagccgtggggggtccctgagactctcctgtgcagcctctgggttcaccgtcagtcacacctacatgagcgtcgggtccgccaggcctccgaggggaggggctggagtcgcgtcttntttttattagtagtagtggtatacatacctcgcagactcgtggacggggccacttccacctatcctcccgaaagacgaactaacttcccaaaagaacctacgtcctttgttttacctaacaaaatcgtaaaactacggtacctaggaacgaacgcccggaaattcggaaacccgacgggtacccgttagttaacctttaaccgtggttacggaccggtaaaggacggacggttacccgggggaacccctaaacgggttaaaaccgtttacctaccggtaaccgttaaggttcggggacccgtttcgggaccgggggaccgtaaaccgggggaaccccg

SEQ ID NO: 382250 - DNA, 732 bp, Homo sapiens
  misc_feature: GZ8MTXP02IMH34.13.76.G10.1.454.CMB.2.raw
  modified_base (254)..(254): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctatttaaaggtgcccagtgtgaggtgcagctggtggagtcgtgggaggaggcttggatccgagccgtcggggggtcctgagactctcctgtgcngcctcgtgggtcaccgtcagtcacacctacatcggagcgtggggtacccgccagggcctcccggaagggggtaacggggctaggggagtcggtcggttcctttctttttaattagtagttaggtcggtaagtacctatacgtaccgacgtacgtaccgttccggtagggaccgggggtaccctacttccgaaccctataccctcgaaacggaacaactaaaactttacccgaaaggaaaccctaacggtctttaacgtttaccctaataaaacttacggaaaaccacggtcccgttaggaacggaaccggtcccgtaagtacggaaccggtaaccgggtccgtttaggtaaactttaaccggtggttaccggaaggtacggaaacggtacggtacgggggaaccccctaaggtaaaacccgtttaaccgaaccgtacgtacggtacggaacccggtttcgggaacgggggaaacccgg

SEQ ID NO: 382251 - DNA, 720 bp, Homo sapiens
  misc_feature: GZ8MTXP02FNC2I.13.76.G10.1.454.CMB.2.raw
  modified_base (273)..(273): a, c, t, g, unknown or other
  modified_base (276)..(276): a, c, t, g, unknown or other
tcagtcacgtactacacgaccggtgctcgatttagtcactcatacagggggcccagcactgggattccgaggtgtttccattcggtgatcagcactgaacacagaggactcaccatggagttttggctgagctgggttttccttgttgcttattttaaaaggtgcccagtgtgaggtgcagctggtggagtctggaggaggcttgatccagccgtgggggtccctgagactctcctgtgcagcctcgtggttcaccgtcacgtcacacctacntgngctgggtccgccaggcctccgagggaaggggctgggagtgcgttcttcttttattagtagttaggttggtaacgtactatactccccgacgacgacgtccggtggacggggccgtattccacctatcctaccgagaacgacctaaacttaccgaaacgaacctacggactttcgttttacctaactaaagtacggaaacacggtacctagggaacgacggcccgtaagttaccgggaaccgaacccgggtacccgttaggttactttaccggtaggtcggacgacggtaaggacggttaccgggggaccccctaaacgggttaaacccggtttacctaaaccggtaccgttaacggttacgggggaacccggttaccggggttacgggggaaccccgtaaaacgggggtaacccccgaccggggttacccgttaaacccccggg

SEQ ID NO: 382252 - DNA, 690 bp, Homo sapiens
  misc_feature: GZ8MTXP02F1LD7.13.76.G10.1.454.CMB.2.raw
  modified_base (299)..(299): a, c, t, g, unknown or other
  modified_base (494)..(494): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttattttaaaaggtgcccagtgtgaggtgcagcgtggtggagtcgtgggaggaggtcttgatccagccgtgggggtccctgagactctctgtgcagcctgtggtcaccgtcagtcacacctacatgacgcgtcgggtccnccgaggcctaccggaaggggacggggctggagtcggtcgttctttacttttatttagtagtaggtgtagtactatacctcgacagaccgttcggtgggacggggccctagttcccaacctacttccacccgaagacgtaaacctaacgttaccgaaaaggtaaccctacgttcgtttaacgttttacccttaaanaaaacgttacgaaaaccgtaccgtacgtaaggacggtacggaccgtagtaaccggaccggtaccggttaccggtttaagttaacgtttacggtggtacggacggtaaggacgggacgggtacccggaaccgtaacgttaaccgtacgtacgtaacgtacgtacggtacggtacggtaccgggaaccgaacggtccg

SEQ ID NO: 382253 - DNA, 596 bp, Homo sapiens
  misc_feature: GZ8MTXP02GYKL6.13.76.G10.1.454.CMB.2.raw
  modified_base (492)..(492): a, c, t, g, unknown or other
  modified_base (537)..(537): a, c, t, g, unknown or other
  modified_base (571)..(571): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtcgtggaggaggcttgatccagccgtggggggtcctgagactctcctgtgcagcctcgtgggtcaccgtcagtcacacctacatgagcgtcgggtccgccagggcctccggaaggggaaggggcgtgggagtcggtcgttcttctttttaatttatagtaggtggtaagtaccatacctcgcaggacctcgggtggacggggccagttccaacctatcctaccgaagacgaacctaaatcccgaaaagaaaccctacgtcctttagtttaacttaccaaaaagttcggaaaaccncgtacgtaggaacgacgacgaatacgacgacggtcgtagtatcgngagacgagagcggaccggaccacgtaactcacgntagacggacgcgacggacgacgccg

SEQ ID NO: 382254 - DNA, 627 bp, Homo sapiens
  misc_feature: GZ8MTXP02F0N5U.13.76.G10.1.454.CMB.2.raw
  modified_base (369)..(369): a, c, t, g, unknown or other
tcagtcacgtactacacgaccggtgctcgatttagtcactcatacagggggggagaggagcccagcactgggattccgaggtgtttccattcggtgatcagcactgaacacagaggactaaccatggagttttggctgagctgggttttccttgttgctattttaaaaggtgcccagtgtgaggtgcagctggtggagtctgggaggaggcttgatccagcctgggggtccctgagactctcctgtgcagcctctgggttcaccgtcagtcacacctacatgagcgtgggtcccgccgaggctccgaggggaagggctggagtgcgtcttacttttattagtagtagtggtacgtacactacctccganacgtacctccggtggcgggggccgacttcaccctagtctaccgagaacgaacaacttaccaaagaaccacgtcttagttttctaacaattacgaacacgtcctagacggacgacccgatacgaacccgacgggtacccgttagttaacttaccgtagtcgcggtaacggagacggtcggggaccctaacggtaaccgtttacgaacgtacgtaagtcggaaccgtcggtacggggaccgaacgggaccctaacccggg

SEQ ID NO: 382255 - DNA, 571 bp, Homo sapiens
  misc_feature: GZ8MTXP02H4ZKX.13.76.G10.1.454.CMB.2.raw
  modified_base (372)..(372): a, c, t, g, unknown or other
  modified_base (414)..(414): a, c, t, g, unknown or other
  modified_base (430)..(430): a, c, t, g, unknown or other
  modified_base (446)..(446): a, c, t, g, unknown or other
  modified_base (455)..(455): a, c, t, g, unknown or other
  modified_base (472)..(472): a, c, t, g, unknown or other
  modified_base (501)..(501): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttccaccggtcacgtcaccacctacatgagcgtcgggtccgcccgagggcctcccgaggggaaggggcgtagggagtgcgttcttcttttattatggtagtggtagtacntactcgcacgctccggtgcgggtccagtcaccatcctcaganacaactccaagtaacncgtctgtttcctaaanaatcgaacncgtacagagacgacganacgacgcggtacgtagtacttagtgacgnggagaggacggtaccggacctaacggtaacgtaacgacgtacgtagtacggtaccgtacgggacggaccg

SEQ ID NO: 382256 - DNA, 715 bp, Homo sapiens
  misc_feature: GZ8MTXP02H9528.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggaggaggcttgatccagccgtggggggtccctgagactctctgtgcagcctcgtggttcaccgtcagtcacacctacatgagcgtcgggtccgccgaggcctaccggaggggaacggggcgtagggaggtcgtcgttctttacttttttaattaagtagttagggggggtgttaagtacccgtattacctccgacacggtaccgttccgggtaggacgggggtaccctacgtttccaaccctacgttacctcccgaaagaacgaaacctaaactttaccccgaaaagaaaccctacggttactttagttttaaccttaccaaaagttacgaaacgtacgcccgttaggaacgacgacccgtagtacgaccgtaccgggtccgttagtaaatttccgtgtaccgacggaaggtacggtacgtccgggggaacccctaaacggtaaaccgtttcaaacggtcgttaacgtcgggacccgtcggtaccgggggaacccgaaacggggtacccccg

SEQ ID NO: 382257 - DNA, 637 bp, Homo sapiens
  misc_feature: GZ8MTXP02HBX0Q.13.76.G10.1.454.CMB.2.raw
  modified_base (300)..(300): a, c, t, g, unknown or other
  modified_base (383)..(383): a, c, t, g, unknown or other
  modified_base (474)..(474): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtgggaggaggcttgatccagccgtggggggtccctgagactctcctgtgcagcctcgtgggttcaccgtcagtcacacctacatgagcgtcgggtccnccgaggctccgaggggaggggcgtggagtgcgttcttcttttattatagttaggtggtagtacatactccgcagacctccggngggacggggccgtacttccacctactcctaccgaggactaactaacttaccaaagaacccacgttcttgtttactacaaaattcgaaaacncggtcctaggaagcgaccgtatacggaaccgcgggtaccgttgttaacttcgtagggtcacggtaagacggtacggtccgggggaaccccctacgggtaaaaccttcgaacgctaacggtcggggtacccgtggtaccgggggacccaaaacgggggtacccc

SEQ ID NO: 382258 - DNA, 611 bp, Homo sapiens
  misc_feature: GZ8MTXP02IL2O1.13.76.G10.1.454.CMB.2.raw
  modified_base (269)..(269): a, c, t, g, unknown or other
  modified_base (348)..(348): a, c, t, g, unknown or other
  modified_base (526)..(526): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtgggaggaggcttgatccagccgtcgggggtccctgagactctcctgtgcagcctcgtggtcaccgtnagtcacacctacatgacgcgtcgggtccgccgaggcctaccggaggggaggggcgtggagtgcgttcttcttttaattntagtgtgtagtaccatacctccgacacgtacgtccggtgggacggggcctacgttccaccctatcctaccaaggtacaacctaaataccaaagaaccacgtcttgtttactaacaaatgaaaccacgacctaggaacgacgaccgtaagtcggaaccgaccgggtctagttattacgngtagacgagacgaggtaccggggacctaacggtaacttacaccgaagtagacggtacgtcggtacggggaccgaacgggtacccg

SEQ ID NO: 382259 - DNA, 556 bp, Homo sapiens
  misc_feature: GZ8MTXP02GBLOM.13.76.G10.1.454.CMB.2.raw
  modified_base (487)..(487): a, c, t, g, unknown or other
  modified_base (524)..(524): a, c, t, g, unknown or other
tcagtcacgtactacacgaccggtgctcgatttagtcactcatacagggggggagaggagccaagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctctgggttcaccgtcagtcacacctacatgagcgtgggtcccgccgaggcctccgaggggaacggggcgtggagtgcgtcttcttttatttatagtagtggtagtacatactcgcagactcgtggacgggcgattcaccatctccagacgacaactaccaaagaccacgcttgtttactacaaaatcgaaactagcctagagacaccgatacgacacggccttagtacttagngtgacgagagacgtcggggacccacgaacttcgacgngtagtcggacgtcgacgggaccgtaggacccg

SEQ ID NO: 382260 - DNA, 620 bp, Homo sapiens
  misc_feature: GZ8MTXP02HJR66.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggttcaccgtcagtcacacctacatgagctcgggtccgccaggcctccggaggggaggggcgtggagtgcgtcttcttttatttatagtagtggtagtaccatactccgcagaccgtcgtgggacggggcctagttccacctatcctacccaggacaactaacttaccaaagaaccacgtccttgtttactacaaatcgaaacacgcctaggagacgccggaatcgacgacgggtccttaggtacttacgtgcggtacggaagaggtacggtcggggaaccctaacgggtaaccgtttaacgacccggtaagtaacggtcggggaaccgttcggacgggggaccgtaacggggaaaccccgg

SEQ ID NO: 382261 - DNA, 957 bp, Homo sapiens
  misc_feature: GZ8MTXP02G98S0.13.76.G10.1.454.CMB.2.raw
  modified_base (285)..(285): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggtagttttggctgagcgttgggttttccttgttgctattttaaaaggtgcccagtgtgaggtgcagctggtggagtcgtggaggaggcttgatccagccggtgggggtcctgagactctcctgtgcagcctcgtggttccaccgtcagtccacacctanatgagcgtcggtccgccgaggcctaccggaggggaacggggtcgtgggagttcggtccggtttccttttacgttttttaagttttagttaaggtttaggttacggggtttaagttaaccccgtaacttaccgttacccggacgtaacggtaacccggtttccgggtacgggggtaaccgggggtcccggtaactttaccccgaaccccgttaacttacccgtaaccccgaaagggtaaaccgtaaaacccgttaaacctttaacccccggaaaaaagtaaaaccccgttaaacccgggttcccgtttttacggtttttaaaccctttaaacccgaaaaaaggttaaccggtaaaacccgaccggtaaccccgttaggggaaacggaacccgggtaccccggtaaagttacccgggaaaacccggttcccgggggttacccgtttaagggtttaaacttttaacccgggtgggtttacccgggaaccggtaaaagggaacggttaccggggttaaccccggggggaacccccgtttaaaaccgggtttaaaaaccccggtttaaccggttaacccgggtaacccgtttaaaaggggttccggggtaacccccggggtttacggggtaaaccgggggggtaaacccccgtaaaaacggggggtaacccccccgg

SEQ ID NO: 382262 - DNA, 586 bp, Homo sapiens
  misc_feature: GZ8MTXP02FTKQE.13.76.G10.1.454.CMB.2.raw
  modified_base (374)..(374): a, c, t, g, unknown or other
  modified_base (421)..(421): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggtcaccgtcagtcacacctacatgagtcgtcgggtccgccaggcctccgaggggaaggggctggagtgcgtctcttttatttatagtagtggtagtacatactcgcagactccgnggagggcctagttccacatctcccagacgaacaattaccaaagaacncgcttagtttctacaaaagttcaaacagacctaggaagacggaccgaatcggaacgaccggtccgttagtaacttacgtgtcgacggagagacgtcgggggacccaacgtaaccgtactacgcgtacgttggaccggtcggtacggggacccgaagggaccccgg

SEQ ID NO: 382263 - DNA, 558 bp, Homo sapiens
  misc_feature: GZ8MTXP02GKHJZ.13.76.G10.1.454.CMB.2.raw
  modified_base (293)..(293): a, c, t, g, unknown or other
  modified_base (473)..(473): a, c, t, g, unknown or other
  modified_base (478)..(478): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggggttcaccgtcagtcacacctacatgagctgggtccnccgaggctccgagggaggggctggagtgcgtcttcttttattatagtagtggtagtacatactcgcagactccgtggacggggcgattcaccatctccagagacaattccgaaagaaccacgcttgtttacttacaaaatgaaacagcctgagacgccgaatcgacgacggccgtagttnttacngtgcgagagtagtacgggggcccacgaacgttactacgcgttaacgtcggtacgtcgtacggggaccgaaacggggcccg

SEQ ID NO: 382264 - DNA, 550 bp, Homo sapiens
  misc_feature: GZ8MTXP02FLFBU.13.76.G10.1.454.CMB.2.raw
  modified_base (233)..(233): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccacctcagtgtccgtgtccccaggacagacagccagcatcacctgctctggaaataatggcagataaatntacttctggtatcagcagaagtcaggccagtcccctgtgctggtcatctatcaagatgaccaaggccggacccctgaacggggtactcccccccgtagacgcgtaactttcctccgtgggtccttcccgaaacttccgttacggggaaaccttcgaacgcccaactctacgaccactcgacgccgggacccaggcctagtcggatggacgctgactattacgtgtaccgaggcgtaggacaggcagcactcgccctctatcgtccgtacggaacgtcggggaacctaggtccaccggtctaaacgccacgaaccccg

SEQ ID NO: 382265 - DNA, 607 bp, Homo sapiens
  misc_feature: GZ8MTXP02HUWO4.13.76.G10.1.454.CMB.2.raw
  modified_base (351)..(351): a, c, t, g, unknown or other
  modified_base (464)..(464): a, c, t, g, unknown or other
  modified_base (531)..(531): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtccctgagctctcctgtgcagcctgtggtcacgtcagtcacacctacatgacgcgtcgggtcccgccagggcctcccggaaggggaacggggcgtaggggacgtggtccggttcctttntttttaatttataaggttaggttggtaagtactatacctcgcacgccgtccgtggcgggggcctattcacctatctccagacgacaacttccaaagaacacgtctgttcctanaaatgaaaccagcctagagacgaccgagtacgaaccgaccgggtaccgttagtattaacgtgtacgnggtaagagacggtcggggacccaaggtaaccgtaacgtacgtacgttacgtacggacggtacgtacgggggaaccg

SEQ ID NO: 382266 - DNA, 718 bp, Homo sapiens
  misc_feature: GZ8MTXP02IDVN3.13.76.G10.1.454.CMB.2.raw
  modified_base (281)..(281): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtgggaggaggcttgactccaggccggtcggggggtccctgagactctcctgtcgcacgcctcgttcggttccaccgtcngtccacacctacatgacgcgtcgggtcccgccgaggcccgtccgggaggggaacggggcgtgggagtcggcgtttactttctttttatatagttagtggtagtaccatacctccgcagtacgtccggtggacggggcctattccacctactcctaccaggacaaactaaacttaccaaaagaacctacgtcgtttacttttacctaactaaaagttcgaaaccgtacgtacccgtagggaaacgaccgggaccgaacgtacggaaccgtaaccggggttcccggttacgtttaagttacccgttgggtaccggacggtaaggacggggtaaacgtccgggggaaacccccttaacgggtaaaacccgttttacgaaccggtaaccgtaggttacgggaccggtacgggtaccgggggaccgaaaacggggtcccccg

SEQ ID NO: 382267 - DNA, 821 bp, Homo sapiens
  misc_feature: GZ8MTXP02GGVJT.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctgtggtcaccgtcagtcacacctacatgacgtcgtcgggtcccgccgaggcctccggaagggggaacggggtccgtagggaggttcggtccgtttcgtttacgttttttaagttttaaagttaggtttaaggttagggttaacggttaaccctacgttaacccgttcccggaccgtaacggtaccccgttacccgggttcgggggaaccggggggtcccgtaacgtttacccgaaccctaacgtttccctacccgaaaggaacgtaaaccctaaactttaaccccgaaaacggtaaaccctaaccggttccttttaacggtttttacccttaacctaaaaagttacggaaaaccttaacggccccgttagggaaacggaaccgggtacccgaacgtaacggaacccggtacccgggtacccgttaagtttaacgttaccgttggggtacggtaccggaaagggtacgggtaacggttccgggggaaccctaaccgggttaaaccgttaccgtacgtaaccgttaagtacgggtacgtacgggtacggggaaccgtaaaccggggacccg

SEQ ID NO: 382268 - DNA, 721 bp, Homo sapiens
  misc_feature: GZ8MTXP02FOUWO.13.76.G10.1.454.CMB.2.raw
  modified_base (188)..(188): a, c, t, g, unknown or other
  modified_base (240)..(240): a, c, t, g, unknown or other
  modified_base (251)..(251): a, c, t, g, unknown or other
  modified_base (265)..(265): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagcccgccctnagtgtcgtggggccccagggcaggacgggtcaccatctcctgcacgtgggancagctccaacnttggggcacattangatgtacatcggtaccagctagtttccaggagcaggtcccagactcctacatacaaatacgtaaaccaacaaactccggacccgacgacggggtccctagacccgtattcctactcggactacccgaggttcctacggacctacccttaccgaccgtccccgtccccgttacgggttaccctagttacccgaaccggttcggggtccccgtacccgtaacggggtacccgtttaggggaaccggggtaagttaccggggtaaacgggtccttagggttaacttttaacgtttccgtacgggttacccctaacggtttaccccgttaacgtaggttaaaccgacggtaccctaaacgggttcccggttaaggtaaccggtttcggttacccgggttttacggggttaaacggttttccccgggggggaaccgggggtacccccgtttaaaccggggg

SEQ ID NO: 382269 - DNA, 651 bp, Homo sapiens
  misc_feature: GZ8MTXP02IHFDQ.13.76.G10.1.454.CMB.2.raw
  modified_base (487)..(487): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtgggaggaggcttgatccagccgtgggggtccctgagactctcctgtgcagcctcgtgggttcaccgtcacgtcacacctacatgagcgtcggtccgccgaggcctccggaggggaggggcgtggagtgcgttcttctttttattagtagtagtggtatacatactcgcacgactcgtggacgggcgtacttaccaccactcaccaagacaactaacttaccaaagaacctacgtctttacgtttactaacaaagtcgaaacacgtacctggaagacggaccgtancgaaccgaccgggtaccgttagttacgttacgtggtacggacgaaggacggacggttccgggggaaccccctaaacgggttaaaacccgtttaccgtaacggtaaccgttaggtaccgggtacggttaccgggtaccgggggaacccgaaacggggtacccccg

SEQ ID NO: 382270 - DNA, 629 bp, Homo sapiens
  misc_feature: GZ8MTXP02GXXG7.13.76.G10.1.454.CMB.2.raw
  modified_base (250)..(250): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtccctgagactctcctgtgcngcctcgtgggttcaccgtcagtcacacctacatgagcgtcgggtcccgccgaggcctccggaggggaaggggcgtggagtgtcgtctttacttttatttagtagtagtggtataccatctcgcagcgtcgtggacgggcctagtccactactctcgaagagactaactacgaaacgaactacgtcttcgtttactaacaaatcgaaactcgacctaggacgacgtaccggaattacgaaccgacggtaccttaggttaacttaccgtggacggtacggaaggaggtacggtcggggaaacccctaagggtaacccgttacgtaccggaacgtaggtaccggtaccggtcgggtaccggggaccgaacgggggtaccccg

SEQ ID NO: 382271 - DNA, 652 bp, Homo sapiens
  misc_feature: GZ8MTXP02GADJ9.13.76.G10.1.454.CMB.2.raw
  modified_base (250)..(250): a, c, t, g, unknown or other
  modified_base (462)..(462): a, c, t, g, unknown or other
  modified_base (470)..(470): a, c, t, g, unknown or other
  modified_base (476)..(476): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcngcctcgtgggttcaccgtcagtcacacctacatgagcgtcgggtcccgccaggcctccggaaggggaaggggctggagtcgcgttcttcttttatttatagtagtaggtataccatacctcgacagacttccggtggacggggccattccaccactcctaccagaacaactaaacttacccgaaaagaaccacgtcctttagtttacctaanaaaagttnaaaccngacctaggagtacgacccgtaatacgaaccgtacgggtccgttagttacgttacgtggtacgacggaggacggtaacggtccgggggaccccaaacgggttaaaccgttacgtaccggtaaccgttagtaccggggtacctacggggtacgggggaacccgtaacgggaaccccgg

SEQ ID NO: 382272 - DNA, 746 bp, Homo sapiens
  misc_feature: GZ8MTXP02GL5Y3.13.76.G10.1.454.CMB.2.raw
  modified_base (272)..(272): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttattttaaaaggtgcccagtgtgaggtgcagctggtggagtctggaggaggcttgactccagccgtggggggtccctgagactctcctgtgcagcctcgtgggttcaccgtnagtcacacctacagtgagtccgtcgggtccccgccgaacgggccgtacccggaagggggaacggggtccgtaggggaggttcggccggtttacctttctttttaagtttagttagggttaaggttgggttaacgtaaaccctacgtaccgttcccgactacggtacccgttcccgggtggggaccgggggtaccctaacgttcccgaacctaacttcccgtacccgaagtaacgaaacttaaacgttaaccgaaagaaaccctacggtccctttacgtttacccttaaacaaaagttacgaaacctacggtacccttaggaacgtacgccggtaaatacggaaccgtaccgggtcttaggttacttacgtcggtaggacggaaggtacggacggtacgggggaccctaacggtaaccgttacgtacgtcgtaacgtacggtaccggtacgtacgggggaccaacgggtacccgg

SEQ ID NO: 382273 - DNA, 681 bp, Homo sapiens
  misc_feature: GZ8MTXP02IYVKV.13.76.G10.1.454.CMB.2.raw
  modified_base (562)..(562): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtcgggtcccgccgacggcctccggaaggggaacggggcgtaggagtgcgttctttactttttatttagtagttagtaggtataccatacctccgacagtaccgttccggtggggacggggccgtacttacccacctaacttcctaccgaagacgtaacctaaacttacccgaaaagaaccctacggtcctttacgttttactaacaaatacgaaacacgtccgtaggagaccggtaccgatacggaccgaccgggtcgttaagttactttacgngtacgacggaggaggtacggtacccgggggaccctaaaccgggtaaaaccgtttacgaccgtaacgttacggtacgggtacggttccgggtaccgggggaaccgaacggggaaccccgg

SEQ ID NO: 382274 - DNA, 654 bp, Homo sapiens
  misc_feature: GZ8MTXP02FNJDQ.13.76.G10.1.454.CMB.2.raw
  modified_base (294)..(294): a, c, t, g, unknown or other
  modified_base (571)..(571): a, c, t, g, unknown or other
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagctctctgtgcagcctgtggtccaccgtcagtcacacctacatgacgcgtcgggcccnccgaggccgtaccggaggggaacggggcctgggagtcggtcgtctttacgttttttaatttagtaggttaggtaggttaacgtactaactacctccgacaacggtaccttcccgggtagggacgggggaccgtactttccacctaactcctacccgaagaacgtaaacctaaattacccgaaaagaaaccgtccgtactttagttttacctaaacgaaattacggaaactacgccgtagacgacggaccgataggacctacgggtcttgtaatccgngtacgacgaggacgaggtccggggaccaacggttaacttagaacccgtatacggtacgggcttacggccgggaccgaaacggg

SEQ ID NO: 382275 - DNA, 642 bp, Homo sapiens
  misc_feature: GZ8MTXP02G55QG.13.76.G10.1.454.CMB.2.raw
  modified_base (296)..(296): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagctgggtcccnccgaggcctccgagggaggggctggagtgcgtcttcttttattatagtgtggtataccatactcgcagacctcggtggacggggcctagttccacctatcctacccgagacgaacctaaacttaccgaaacgaactaaccgcgtttacgtttaccttaacaaaagttcgaaaaccacggtaccctaggaacgacgacccgtaagtcggaaccgacggggtcccgtagtttacgttacgtggtacggacggaaggagtacgggttcgggggaccccaacgggtaaaccgttacctacggaaccttagtacggggtacgtacggtacgggggaccgaaacgggacccg

SEQ ID NO: 382276 - DNA, 789 bp, Homo sapiens
  misc_feature: GZ8MTXP02JDD2P.13.76.G10.1.454.CMB.2.raw
  modified_base (125)..(125): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccanggagttttggctgagcttgggttttccttgttgcttattttaaaaggtgcccagtgtgaggtgcagctggtggagtctggaggaggtcttgatccaggccgtgggggtccctgagactctcctgtgcagcctcgtcggttccaccgtcacgtcaccacctacatgacgcgtcgggtcccgccgaggcctaccgggaggggtaacggggcgtgggagtgtccgtttctttacgtttttaatttagtagttaggtggtagtaccctataccgtccgacgacgtaccgtccggtggggacgggggtccctaatttcccgaacctacgttacccgtaccgaaacgaacgtaaaccctaaaacttcccgggaaaaggtaaaccctaaccggacccttaggtttaaccctttacgaaaaaactttcggaaaaccctaggacccccttagggaacccgtaaggaccccgggaaattccgggaaacccgtaacccggggtaccccggtttaggttaacgtttaaaccgttcgggttaggaccgggtaaaggtacgggaacgttacggggggaccccctaaacggggtaaacccgtttaaccgtaaaaccggtcccgtaaagttcgggtacggtacccgtcggggggaacccctaaaacgggggtaacccccg

SEQ ID NO: 382277 - DNA, 625 bp, Homo sapiens
  misc_feature: GZ8MTXP02HSZ71.13.76.G10.1.454.CMB.2.raw
  modified_base (563)..(563): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctgtggttcaccgtcagtcacacctacatggacgtcgtcggggtccccgccgacgggtcctaccggaagggggaacggggtccgtggggtaggtttggggtttttcgggtagtttaggtggtcttcgttagattggaatagactactaatactacgtgacaggtaccttaccgggttaacggggcctacttccacctatcctaccgagtacgaacaactttaccgaaataccaacgactaattacgtcctggacaggactacgaacacggcggtagggacaccggaggaccacggggttcctttaaancacgtcgagtaacgaaagtattagttaagtaataccgtaaaggtgtaacgtcctaagttacc

SEQ ID NO: 382278 - DNA, 730 bp, Homo sapiens
  misc_feature: GZ8MTXP02HO8CV.13.76.G10.1.454.CMB.2.raw
  modified_base (235)..(235): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtcccngagctctcctgtgcagcctcgtggtcaccgtcagtcacacctacatgagcgtcgggtcccgccgaggccgtccggaagggggaacggggcgtaggggagtcggtcgtttctttactttttaaagttttagtaggttaggttaggtacgttaacattaccgtccgacgtacgaccgttccgggtagggaacgggggtcccgtaattccaaccgtactaccgtacccaaaggaacgtaaactaacgtttacccaaaaggtaacccaccggttcttacggttttacctacgaaaacgttacgaaacccaacggtcccttaggacggacgaccgagtaccggaaccgaccgggtccgttagtactttaacgtcggggtagacggtaaagtacgggtacggtacccgggggaaccccttaacggtaaaacccgtttaaccgtaacgcctttaaaggggcccgggttaaccggttcgggggttaccgggggaaaaccccgg

SEQ ID NO: 382279 - DNA, 655 bp, Homo sapiens
  misc_feature: GZ8MTXP02HTVVE.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtcgtgggagggaggtcttgatccgaggtccggtcggggggtccctggacgacctctcctgtgcgacgtcctcgtcgggttcctccgtcagtccacaacctacatgacgtcgtcgggtccgcgacggcctccggaggggaggggcgtggtagtcgtcgttctttcttttatttagtagttaggtggtactacatactcgacacgtccgtcgtgggacggggctacttccgactactctccgaagacgaaactacttaaccaaagaacctacgtctttagtttacctactaaatacgaaactcgtacctagggacgacgtaccgaatcggaacccgcggggtccttagtaacttcgtagtcggagagggtagtacggaccggggtaccctaacggtacgtttaaccgacggtaacgtaagtcggtacggtcggtaccggggaccgaaacgggtacccg

SEQ ID NO: 382280 - DNA, 611 bp, Homo sapiens
  misc_feature: GZ8MTXP02FO6YQ.13.76.G10.1.454.CMB.2.raw
  modified_base (302)..(302): a, c, t, g, unknown or other
  modified_base (429)..(429): a, c, t, g, unknown or other
  modified_base (434)..(434): a, c, t, g, unknown or other
tcagtcacgtactacacgaccggtgctcgatttagtcactcatacagggggctggggagaggagcccagcactgggattccgaggtgtttccattcggtgatcagcactgaacacagaggactcaccatggagttttggctgagctgggttttccttgttgctatttaaaggtgcccagtgtgaggtgcagctggtggagtcgtgggaggaggtcttgatccaggccgtggggggtccctggagactctccgtgtgcagcctcgtgggttccaccgtcagtcacactacatgagctgggccncaggctccgaggggaggggctgggagtgcgtctttcgttttattatagtagtgtagtacatactcacagcgtcgtggacggggcctagttcacattcaccaagagactaattaccaaagaccgtacnctttnttaccttagaaaatgaaactggcctagagacgacccgtagtagaccgaccgggtaccgtaggttactacgttggtggaccggaagacgtaaacgggtccggggtaacccccaggttaaaccgttaactaccgggtaccttaggacgggtacccgttcgggacgggggaaacccccgg

SEQ ID NO: 382281 - DNA, 630 bp, Homo sapiens
  misc_feature: GZ8MTXP02GS3PO.13.76.G10.1.454.CMB.2.raw
  modified_base (307)..(307): a, c, t, g, unknown or other
  modified_base (531)..(531): a, c, t, g, unknown or other
  modified_base (536)..(536): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtcgtccccaggacagacagccagcatcacctgctacgtaggtaaaataattggacaagtaattaaatatacttcctaggtatcagcagaagtcaggccagtcccctgtgctgtcatctatcgaagtntcgaccaagcccggtaccctcggacgggtactccccccgtagacgtacgtactttcgtccgttcgggcccttccgaaacttccgtacggggaaccttcgacggtacccacgttcaccgacctacgtaccggaacgggacccgggaacccacgggtctaaggtcggagttaggacgtacgtagtacgttagttaccgtagtaccggagggtccgggtggaaccgnggacncggactacggtcgccgtacttacgtcgttaccgtacggtacggtacgggaaccgtaacggtaccgtaccggtacctacggccgaacgaaccccg

SEQ ID NO: 382282 - DNA, 714 bp, Homo sapiens
  misc_feature: GZ8MTXP02GTFQV.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtgggaggaggcttgatccaggccgtgggggtccctgagactctcctgtgcagcctcgtgggtcaccgtcagtcacacctacatgagcgtcgggtccgccgaggcctaccggaggggaacggggcgtggagtcggccgttctttacgtttttaatttagtaggttagtaggttaacgtacctacttaccgtccgacgtaacggtaccgttccgggtaggggacgggggtacccgtaacgttcccgaaccctaacttcccgtacccgaagtaaacgaaacctaaacttaccgaaaacgtaaacccgtaacgtcctttacgttttacttaacaaaagttacgaaaccgacgaccgttaggaacgacgaccgaagtacggaaccgaccgggtaccgttagttattaccgtggtcgacggaggagtacggtacgggggaaccctacgggtaaaccgttacgtaccgaagttacggtacgggacggttcgggaccggggaccggtaacgggaacccgg

SEQ ID NO: 382283 - DNA, 788 bp, Homo sapiens
  misc_feature: GZ8MTXP02JC2O0.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatccagccgtgggggtcctgagactctcctgtgcacgcctgtcgggttacaccgtcagtcaccacctacagtcgagtcgtcgggtcccgccgtaggcctaccgggaaggggaacggggctggggagttcggtccgtttctttactttttaatttagttaggttaggtaagggtacttaacctacgtaccgtcccgacacgtaccgtccgtggggacgggggacctacttccgaacctacttccgtacccaaaggaacctaaactaaacgttaacccgaaaaggtaaacccaccggttcttacgttttacctaaacaaaacgttagaaaaccgtacgtaaccgtagggaaccgaacgacccgggttaaagtaaccggaaccgtaccgggtaccgtttaacgttaacggttacgtgggtaacggacggtaacgggtaacggtaaccggggtacccggggtaaacccgtaaaccggttaaaaccggtttaacgtaaccggtaacggttaacgggtaccggggtaaccggtttaccgggggaaccggggtaacccgggtaaaaccggggtaaccccg

SEQ ID NO: 382284 - DNA, 636 bp, Homo sapiens
  misc_feature: GZ8MTXP02FPRZH.13.76.G10.1.454.CMB.2.raw
  modified_base (238)..(238): a, c, t, g, unknown or other
  modified_base (262)..(262): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctcggggccccagggcagagggtcaccgatctcctgcacgtgggancagctcaacattgggcacgattangatgtacactggtaccagctagtttccaggagcacggtcccagacctcctacatacaatacgtaaaccaacaatccggacccgcgtacggggtcccctgaccgtacttccgtctcggaccttcccgagtccgtcggccaaccctcacgtccctccgtcggtactatccgacgttcgggccttcccgaagggtccttaggtaagggagttacgggagggtaccttacgggttagtttaactttcgtacgtacccgtaacgttacccgtaaagttacggaaacgtacggtaccgaacgtcccgtttaggaacggttcggttccgtttacggggttaacggtttcccgggggtaccggggggaaccccttaccgggg

SEQ ID NO: 382285 - DNA, 540 bp, Homo sapiens
  misc_feature: GZ8MTXP02FH1C5.13.76.G10.1.454.CMB.2.raw
  modified_base (370)..(370): a, c, t, g, unknown or other
  modified_base (393)..(393): a, c, t, g, unknown or other
  modified_base (466)..(466): a, c, t, g, unknown or other
tcagtcacgtactacacgaccggtgctcgatttagtcactcatacagggggggagaggagcccagcactgggattccgaggtgtttccattcggtgatcagcactgaacacagaggactaaccatggagttttggctgagctgggttttccttgttgctattttaaaaggtgcccagtgtgaggtgcagctggtggagtctggaggaggcttgatccagcctgggggtccctgagactctcctgtgcagcctctggggttcaccgtcagtcacacctacatgagctgggtccgccaggctccaggggaaggggctggagtgcgtctcttttattatagtagtggtagtacatactccgcagactccgtgnggggccattcaccatctccaganacaattccaaagaacacgtctgtttctacaaatgaacagcctgagagccgatgaccacggccgtgtattacgngtgcgagagagtcggggacccacgaacgttacacgctaagtggacgtcgtcggggaccaacggggacctaccgg

SEQ ID NO: 382286 - DNA, 569 bp, Homo sapiens
  misc_feature: GZ8MTXP02I8JNM.13.76.G10.1.454.CMB.2.raw
  modified_base (448)..(448): a, c, t, g, unknown or other
  modified_base (470)..(470): a, c, t, g, unknown or other
  modified_base (487)..(487): a, c, t, g, unknown or other
tcagtcacgtactacacgaccggtgctcgatttagtcactcatacaggggggggagaggagcccagcactgggattccgaggtgtttccattcggtgatcagcactgaacacagaggactcacccatggagttttggctgagctggggttttccttgttgctattttaaaaggtgcccagtgtgaggtgcagctggtggagtctggaggaggcttgatccagcctggggggtccctgagactctcctgtgcagcctctggggttcaccgtcagtcacacctacatgagctgggtccgccaggctccgaggggaggggctggagtgcgtctcttttatttatagtagtggtagtaccatactccgcagacctccgtggacggggccgattccaccatcctccagagacaattaccaaagaaccacgccttgtttctacaaaatgaaacncgcctagagacgccgatcgacncggccgtagtattacgngtgcgagagacgtcggggaccctacggaaccgttcacggtctaggtcggacgtcggtacgggggacccgaaaggggaccccg

SEQ ID NO: 382287 - DNA, 531 bp, Homo sapiens
  misc_feature: GZ8MTXP02H8KF0.13.76.G10.1.454.CMB.2.raw
  modified_base (237)..(237): a, c, t, g, unknown or other
  modified_base (349)..(349): a, c, t, g, unknown or other
  modified_base (376)..(376): a, c, t, g, unknown or other
  modified_base (386)..(386): a, c, t, g, unknown or other
  modified_base (456)..(456): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcaggagggtcaccatctcctgcacgtgggancagctccaacattggggcacattatgatgtacactggtaccagcagtttccaggagcgaggtcccagactcctcatcaatagtaacacaactcggcccgcgacggggtcccngaccgtacttctcgtggctccaggtcncggcaccgtnacgcctcccgtggtccatcacgtgggcctacgaggtctggacggtagtggaggtctggtaatttctttcncgacctagttcctatcgactcggacacgctagaagtcggctttcgggtagttcccgggggacggggtacctacgg

SEQ ID NO: 382288 - DNA, 757 bp, Homo sapiens
  misc_feature: GZ8MTXP02G2OMW.13.76.G10.1.454.CMB.2.raw
  modified_base (474)..(474): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttccaccgtcagtcacacctacatgagctcgggtccgccgaggccgtcgaaggggacggggcgtaggagtgcgttctttctttttaatttagtagttaggtaggttataccgacttaccgtaccgaaagtccgtaccggtgggacgggggtccgtaacgttaccaccctaacttcctaccgaacgacgaactaaacgttacccgaaacgaaaccnccggttactttcgttttaccttaaacctaaagtaccgtaaaacacgtacccgttaggaacggtacgaccccggtaataccggaaaccgacccggggtaccgttagttaaccgtttaacgtcgttagggtaccggaaacggagggtaacggttccccgggggaaccccctaaaacgggttaaaccgtttaccgtaaccggttaccgtttaaggtaccgggtaaaccgttccgggggttaccggggtaaccccggaaaacggggtaccccgttaaacccccgggg

SEQ ID NO: 382289 - DNA, 666 bp, Homo sapiens
  misc_feature: GZ8MTXP02H5F8S.13.76.G10.1.454.CMB.2.raw
  modified_base (269)..(269): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttcctgttgctattttaaaaggtgcccagtgtgaggtgcagctggtggagtctggaggaggcttgatccagccgtgggggtccctgagactctcctgtgcagcctcgtggggttcaccgtcngtcacacctacatgagcgtcgggtccgccgaggcctccggaggggaaggggccgtgggaggtcgccggttctttacgtttttaatttagtaggttacggttaggtagtacctataccgtccgacgtagaccgtcgtgggacgggggcctacttccgacctactcctacaagacgaactaactaaccgaacaacctacgtcttacgtttacctaactaaatcgaaacacgcctaggtaacgacggtacggaacgtcggaaccgaccggggttaccgttagttaacgttcgtagggtacgtacggaaggtaaggacggttcccgggggacccctaaacggtaccgtttaaccgcgtaacgtaggacggtacgtggacgggggtaccgaacgggtacccg

SEQ ID NO: 382290 - DNA, 620 bp, Homo sapiens
  misc_feature: GZ8MTXP02FW09Y.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactaaccatggagttttggctgagctgggttttcctgttgctattttaaaaggtgccagtgtgaggtgcagctgggtggagtcgtgggaggaggcttgatccagccgtgggggtccctgagactctcctgtgcagcctcgtggttcaccgtcagtcacacctacatgagcgtcgggccgccgaggcctaccggaggggaaggggctgggagtcgtcgttctttcttttattagttagtagtaggtagtacagtaccgtccgacacgacgtccggtaggcgggggtccacttcacctatcctaccaagaacgaactaaacttacaaacgaactacgtacttcgtttacttaacaaatacgaacacgtaccgtagacgacggaccgtacgacggaacccgtacgggtccgtagttactacgtagtggacgagtagacggtcgggaccacggtaacgttacgacgtcgtaagtcggacgttcggacgggacaacggggactacccgg

SEQ ID NO: 382291 - DNA, 635 bp, Homo sapiens
  misc_feature: GZ8MTXP02JZERF.13.76.G10.1.454.CMB.2.raw
  modified_base (468)..(468): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcaccacctacatgagcgtcgggtcccgcccaggcctccgaggggaaggggctgggagtgcgttcttctttttatttatagttagtggtagtacctatactccgcagacctcgtggaggggcctattccacctatcctccaagtagaacctaattaccaaagaaacacgtcttagtttacctacaaatcgaaaaccncgtctagagacgaccgatacgaccgtaccggtcgtagttacttacgtggtacgacggaggacggtacggtaccggggaacccctaaacggtaaaccgttaccgaaccggtaacgttacggtacggtaccggttaccggtaccgggggaacccgaaacggggaccccg

SEQ ID NO: 382292 - DNA, 611 bp, Homo sapiens
  misc_feature: GZ8MTXP02FN8XZ.13.76.G10.1.454.CMB.2.raw
  modified_base (172)..(172): a, c, t, g, unknown or other
  modified_base (215)..(215): a, c, t, g, unknown or other
  modified_base (415)..(415): a, c, t, g, unknown or other
  modified_base (432)..(432): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcacgcccaccctnagtcgtccgtcgtccccaggacagacagccagcatcactgctntaggaaataagtggacagtaataaatatacttctggtatcagacagagtcgaggccacgtcccctggtcgctggtctatctatcaagtactcgaccaacggcccggaccctacgacggggtctacccccgtgacgcgtacttctcgtcggcctaccaacgttcggtacggacctcgaccgccctaactcctacgacctancgacggacccggaccgnggtctagacggtagtaggaacggtctagtacttacgttacgtggtaccggagggtccggtaggaacacggacgacgaccgtacgtccggacccgtcttacggttcggttaccgtacgggacgttaccgggaaacgtaccggtaccgtaaccgtaccgtaacgcccgaacgaacccccgg

SEQ ID NO: 382293 - DNA, 558 bp, Homo sapiens
  misc_feature: GZ8MTXP02H2JRH.13.76.G10.1.454.CMB.2.raw
  modified_base (372)..(372): a, c, t, g, unknown or other
  modified_base (394)..(394): a, c, t, g, unknown or other
  modified_base (415)..(415): a, c, t, g, unknown or other
  modified_base (478)..(478): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtccctgagactctcctgtgcagcctcgtcggttccaccgtcacgtcacacctacatgagcgtgggtccgccagggcctcgaaggggagggctgggagtggcgtcttcttttaatttatagtagtggtagtacatactccgnagctcgtggacgggccatcacntcacagacacatccaaagacncgcttgttctaacaatagacagtccgtagagacgcgagtcgacgacggtccgtatacgttacngaggcgagaggcgtacggggacccaacggtaaacttaacgacggtacctaggtcggtaccggtacggtcggggaacccgg

SEQ ID NO: 382294 - DNA, 586 bp, Homo sapiens
  misc_feature: GZ8MTXP02HOBWF.13.76.G10.1.454.CMB.2.raw
  modified_base (502)..(502): a, c, t, g, unknown or other
  modified_base (507)..(507): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctcgtgggttcaccgtcagtcacacctacatgagcgtcgggtccgccgaggcctccgaggggaggggctggagtgcgttcttctttattatagtagtggtagtacatactcgcagactcgtggacgggccattccgacctatctacccgaagtacgaactaacttacccaaaggaaccacggtctttacgtttactaacaaaatcgaaactcgcctagagtacgccgatcgacgacggcgtgtattacgngtcgngtagagagtcggggaccccaaggtaacgttacgacgaacgtagtcggtacgtcgtacgggggaccctaaaggggacccg

SEQ ID NO: 382295 - DNA, 790 bp, Homo sapiens
  misc_feature: GZ8MTXP02FQ6Q7.13.76.G10.1.454.CMB.2.raw
  modified_base (257)..(257): a, c, t, g, unknown or other
  modified_base (481)..(481): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcgtggttttccttgttgctatttaaaaggtgccagtgtgaggtgcagctggtggagtgtggaggaggcttgactccgaggccggtcggggggtccctgacgtactcctcctgtcgcncgtcctcgtcgggtccaccgtcacgtcaccacctacatgacgcgtcgggtccgccgaggccgtccggaggggaacggggcgtggagtcgtcgtttctttactttttatttaagtagttaggttaggttactaccgtacttaccgtaccgcgacgtacccgtcgggtacgggacgggacccgtatcccactaactcctacgagaacaacctaaatacccgaaaanaacccgtaccgtcttttacggttttaaccctaaacgaaacgtacgtaaaccgcgtaccgaagacggaccgtaccgtaagtaccgggaccggtaccggtacgtttaacgttaacgttacggtcgggaacgggtaaacggaaacgggtaacgggtacccgggggtaaaccccggggtaaaaccccttaaaaccggggtttaaacccgttaccggtaaccggtaacgggttacggggttaccgggtaacccgggggtttaccgggggtaaacccgggggtaaaaccccgggaaaccggttaacccccccggg

SEQ ID NO: 382296 - DNA, 622 bp, Homo sapiens
  misc_feature: GZ8MTXP02FTWU8.13.76.G10.1.454.CMB.2.raw
  modified_base (255)..(255): a, c, t, g, unknown or other
  modified_base (296)..(296): a, c, t, g, unknown or other
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctntgggttcaccgtcagtcacacctacatgagcgtcgggtccnccaggctccgaggggaggggctggagtgcgtcttcttttattatagtagtggtactacatactccgcacgactccggtggacggggccgtacttccaacctatccctaccagaacacaaattccaaaagacacgtcttacgttttacctaactaaatacgtaaacacgtccctaggaacgtacgacccgtagtcgaaccgccggtaccgtagttaactttacgtgtacggacgaaggtaggaacggtcgggggacccctaaacggtaaccgtttacgaacgtacgtacgtcgggacccgtttacggacggggacccaaaccggggg

SEQ ID NO: 382297 - DNA, 639 bp, Homo sapiens
  misc_feature: GZ8MTXP02HZ0R4.13.76.G10.1.454.CMB.2.raw
  modified_base (238)..(238): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagcccgcctcagtgtcgtcggggccccagggcaggaggtcaccatctcctgcacgtgggancagctaccaacagttcggggcacattatgatgtacacgtaggtaccagctagtttccaggagtcgacggtcccagtacctccgtactatactaataaccgtaaacaaacgtaacgtaccggcccgacggtaccgggtcccgtacgacccgtaagttcctacgtcggtacctccgtacggtctacggacctacccgtccaacggtcccctcccgttggtaccaactccgacgtacgggtccctcgacgggtcgtaggacgggtacgtaggtacggtcgttagtagtttactttaccgcgtaccgtacgttcccgttaagtacgacgacgtacgacgtccgtaggaacgttcgtaccgtttcggggtaacggtttccgggggaccggggtaacccgtaccggg

SEQ ID NO: 382298 - DNA, 843 bp, Homo sapiens
  misc_feature: GZ8MTXP02JW5JE.13.76.G10.1.454.CMB.2.raw
  modified_base (253)..(253): a, c, t, g, unknown or other
  modified_base (266)..(266): a, c, t, g, unknown or other
  modified_base (660)..(660): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttattttaaaaggtgcccagtgtgaggtgcagcgtggtggagtcgtggaggaggcttgatccagccggtcgggggtcctgagctctcctgtgcngcctcgtcggtcnccgtcacgtcacacctacatgacgcgtcgggtcccgccgacggccgtaccgggaggggaacggggcgtagggtacggttcggtccgtttactttttacgtttttaagtttaagttaggttaggttacggttaacgtaaccctaacgttaccgtacccgacgtacggtaccgttccgggtgggggaccggggtacccgttacgtacccgaccctaacgttccctacccgaaagaacctaaaccttaaacgttaaccccgaaaagaccctaccgttcgtttacgtttttaccaaacaaagttaccggaaaccgcgtccgtaagggacggaacccgtaccgggtaagttacccggaccggtaccgggttaccgtttaaaggtttacctttacggggngggtacggaaacgggaacgggtaaacgggtacccgggggtaaccccgggtaaacccccgttaaacgggttaaaaccccgtttacccggtaacgggtttaacggtaaaccgggggttaccggggtaacccggggttaccgggggtaaccccgggggaaaaccccgggtaaccggggtacccccg

SEQ ID NO: 382299 - DNA, 568 bp, Homo sapiens
  misc_feature: GZ8MTXP02G4SIZ.13.76.G10.1.454.CMB.2.raw
  modified_base (340)..(340): a, c, t, g, unknown or other
  modified_base (374)..(374): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagccctcgtgggtcaccgtcagtcacacctacatgagctgggtccgccaggctccgaggggaaggggctggagtgcgtcttcttttatttanagttagtggtataccatactcgacagactcgtgnggggccattccacatcctccagagaacaatacaaagaaacacgcttgtttctacaaaatgaaacagcctagagacgtcccgaagtcgaacacggccgtagtattagtgtcgcgagagtacgtcgggggaccccaggaaaccgttaactacgaacgttagtcggaacgtcgtacggggccgaaaggggaaccccg

SEQ ID NO: 382300 - DNA, 673 bp, Homo sapiens
  misc_feature: GZ8MTXP02GRUMV.13.76.G10.1.454.CMB.2.raw
  modified_base (248)..(248): a, c, t, g, unknown or other
  modified_base (424)..(424): a, c, t, g, unknown or other
  modified_base (491)..(491): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtctggaggaggcttgatccagccgtgggggtccctgagactctcctgtncagcctcgtggtcaccgtcagtccacacctacatgagcgttcgggcccgccgaggcctaccggaggggaacggggcgtgggacgtggtcgttctttctttttaatttacgtaagttaggttgggtaactacctatacctcgacacgactcggtgggacgggccgtattccaccgtntcctacgaagagaacctaatacccgaaagacgacgtctttagtttactacgtaaaactggaaaaccncgtaccgagacgacgacgtagaccgacgtaccggttacgttagttaacgttcgcgggtacggaacggtacggaacgggtaccgggtacccggggaaacccctaaacggttaaccgttaccgaacgtccggttaggtaccgggtaccggttaccggacgggggaacccgaaccggggtacccg

SEQ ID NO: 382301 - DNA, 707 bp, Homo sapiens
  misc_feature: GZ8MTXP02G74QQ.13.76.G10.1.454.CMB.2.raw
  modified_base (239)..(239): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcacgccgccctcagtgtcgtcggggccccagggcaggaggtcaccatctcctgcacgtgggancagctccaacagttggggcacattatgatgtacacgtcggtaccagctagtttccaggtagccgacgggtccccacggtacctccctactactacctaaagtaacgttaaaccaaacctaacgtccggaccccgacggtacggggtcccctcgggtaacccggtatttcccgtcgtcgggtccttcccggtaacggttccgttaccggggaccctaaccccgttccgaaccgtccccgtcccgttcggtacctacgttcccgacgttcggggccctaccggacgggtccttagggaagggtacgtaggtacggtacctagggttaatttacgtttccgtacgtacccgttaaacgttccccgttaagttcgtaaccgtacgtacgaaccggtcccgttaacgtaaggtcggttccggtttacggggtaccggtttccgggggaaccccgggggtcccgttaaccgggg

SEQ ID NO: 382302 - DNA, 751 bp, Homo sapiens
  misc_feature: GZ8MTXP02F21NQ.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactaaccatggagttttggctgagctgggttttcctgttgctattttaaaaggtgcccagtgtgaggtgcagctggtggagtctggaggaggcttgatccagcctggggggtcccctgagactctctgtgcagcctgtggttcaccgtcagtcacacctacatgacgcgttcgggcccgaccgaggccgtaccgaagggggaacggggcgtgggagtgcgttctttacttttattagtagttacggtgtaacgtacataccctccgacacgacctccggtgggaccgggggtcctactttaccaaacctcttaccctacccgaaggtaacgaaaaccctaaacctttacccaaaaaaacggtaacccaaaccgttaccgttcggttttttaacctaaaccgtaaaattaacgaaacaccggttaccctaagggaacgacggtaccccgtaagtaccgtaacccgaccgggggtccctagggtttaaactaccgttaggtccggaagaaccggaaggttacgggtcccgggggaaacccctaacgggtaaaaccgtttaccgaacggtcctttaaggaccgggtaaccggtttcgggtaccggggaacccgaaaccggggtaccgtaaaccccggg

SEQ ID NO: 382303 - DNA, 593 bp, Homo sapiens
  misc_feature: GZ8MTXP02G30U5.13.76.G10.1.454.CMB.2.raw
  modified_base (301)..(301): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtctgggaggaggcttgatccagccgtgggggtccctgagactctcctgtgcagcctcgtcgggttcaccgtcagtccacacctacatgacgcgtcgggtccnccgaggcctccggaggggaaggggcgtggagtgcgttcttctttttattagtagtagtggtagtacatactcgcagactcggtggacgggcgtacttccaccatcctaccagacgaactaataccaaagaaccacgtcttagtttctaacaaatacggaaacacgtcctaggagacgccgtaagacgaaccgaccggcgtagttactacgtgtcgacgagtagacgtcggggacccaacggtaccgttacaccgtaagtagtcggacgtcggacgggaccgaacggaccccg

SEQ ID NO: 382304 - DNA, 597 bp, Homo sapiens
  misc_feature: GZ8MTXP02IV48Y.13.76.G10.1.454.CMB.2.raw
  modified_base (295)..(295): a, c, t, g, unknown or other
  modified_base (377)..(377): a, c, t, g, unknown or other
  modified_base (448)..(448): a, c, t, g, unknown or other
tcagtcacgtactacacgaccggtgctcgatttagtcactcatacaggggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggtcaccgtcagtcacacctacatgagctgggtcccnccgaggcctccgaggggagggctggagtgcgttcttctttttatttatagtagtggtagtacatactccgcagaccttcggnggacggggccattccaccactctccagagaacattaccaaagaaccacgtcttgtttctacaaatgaaacngcctagagtacgaccgagtcgaccgacggtccgttagtatttaccgtgacgtcgagacggacgtccgggggacccaacggttaaaccgttaacgaccgtaacgtagtacgggtaccggtcggtacgggggaacctaaacggggaccccg

SEQ ID NO: 382305 - DNA, 669 bp, Homo sapiens
  misc_feature: GZ8MTXP02HQF7Y.13.76.G10.1.454.CMB.2.raw
  modified_base (301)..(301): a, c, t, g, unknown or other
  modified_base (317)..(317): a, c, t, g, unknown or other
tcagtcacgtactacacgaccggtgctcgatttagtcactcatacagggggggaggaggagcccagcactgggattccgaggtgtttccattcggtgatcagcactgaacacagaggactcaccatggagttttggctgagcttgggttttccttgttgcttattttaaaaggtgcccagtgtgaggtgcagctgggtggagtcgtgggaggaggtcttgatccgaggtccggtcggggggtccccgagaccgttctccgtgtgcacgtccttcgtgggttccacgtcacgtcacacctanatgagcgtgggtcccncgaggccgtccggaaggggacgggcgtgggacgtggcggttctttactttttatgttagtaggtagttagtactactacgtcgacgagtacgtcccggtagcgggggcctactaccgacctatcctacgaagacgactaaactaccaaacggactacgtcttacgtttctaacaactagaaactcgtccgtagaacggtacgacccgtattacggaccgtaccggtaccgggttattacgtttaaccgggtcggtacgaacggtacggacgggtacggtaccggtaaccgtaacgttaacgtacgtacgtacgttaacggcggtacggtcggacggaccgtacggacgtccg

SEQ ID NO: 382306 - DNA, 574 bp, Homo sapiens
  misc_feature: GZ8MTXP02GNNPX.13.76.G10.1.454.CMB.2.raw
  modified_base (301)..(301): a, c, t, g, unknown or other
  modified_base (457)..(457): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccaggccgtggggggtccctgagactctcctgtgcagcctgtaggttcaccgtcagtcacacctacagtgagtcgtcgggtccncagtccgtcgaggggagggctggagtcgtcgttcttacttttattagtagtagtgtagtacatactcgcagccgtcgtggacggggtccattcgactactccgtccaaggacactaactccgaaagaacctgcttgtttactacgaaatcgaaacncgtaccgagacgagaccgatcgacgtaccgtcgtagtactcgtgcgaggacgtaggccggtaccgggaccctaagtacgtaacgcgtacgtacggcggtacggtccggacgggaccg

SEQ ID NO: 382307 - DNA, 685 bp, Homo sapiens
  misc_feature: GZ8MTXP02GTAMC.13.76.G10.1.454.CMB.2.raw
  modified_base (350)..(350): a, c, t, g, unknown or other
tcagtcacgtactacacgaccggtgctcgatttagtcactcatacagggggggagaggagcccagcactgggattccgaggtatttccattcggtgatcagcactgaacacagaggactcaccatggagttttggctgagctgggttttccttattactattttaaaaggtgtccagtgtgaggtgcagttggtggagtctgggaggaggcttggtccgaggccgggggggtcctgagactctcatgtgcggcctcgtggctcaccgtcaacaccaactacatgagctgggtcccgccaggctccgaggggaagacgggccgggagtggggtctactagtttagtttaangggtccgtaacgggttcgacccctaagtactttcctaacccgcgaacgtacctcccgggttgggaaccgggggtcccggttccaaccctaattccctacccgaagaacgaacctaaacttacccgaaagaaaccgacggttagtaacttactactaaaacgtacgaaacgtaaccgtgaacggtagtacgtaatacgaacgaccgggacccgttactaacttaacgtgtagaacgaaaagagtagacgaagacggaccggggtaccccgtaaaggtcgggaccgtgggtggtacgggttcgtttcgtcgtacgtgcggtcggggacgtaaccggg

SEQ ID NO: 382308 - DNA, 656 bp, Homo sapiens
  misc_feature: GZ8MTXP02FSRK3.13.76.G10.1.454.CMB.2.raw
  modified_base (297)..(297): a, c, t, g, unknown or other
  modified_base (448)..(448): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgacgactctcctgtgcagcctcgtggtcaccgtcagtcacacctacatgagcgtgggtcccncgaggcctcgaggggagggcgtggagtgcgttcttcttttattagtagtagtaggtagtaccattacctcgcagacctccggtggacgggccgtagttaccaccgtactcctaccaagacgaaactaacttaaccgaaaacgaccgtaacnctttacgtttaccttaacaaaagttcgaaacacgtcctaggaacgtacgacccgaataccggaaaccgtcgggccgttagtaacgtttccgtggacggtaccgagttaaggacggtaccgggggaccccctaaaggtaaacccgttcctaaaacgccgtaagtacggggtacgttcccgggacggggacccgaaacggggtacccccg

SEQ ID NO: 382309 - DNA, 706 bp, Homo sapiens
  misc_feature: GZ8MTXP02I6N90.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagcgtggtggagtctggaggaggcttgatccacgccgtgggggtccctgagactctcctgtgcagtcctgtcgggttccaccgtctacgtcaccacctacacgtgacgtccgtcgggtccccgaccgacggccgtaccggaacggggaacggggccgtgggacgtcggtccgttacttttactttttactttaagttagttacggtggttaacgtacctacgttaccgtcccgtactacgtaccgttccgtgggaaccggggtccgtacttccgacctactcctaccaagtacaacctaaacttaccgaaagaacctaccggttccttagttttaccctaacctaaaattacgggaaacctaccggtacctacggaacgacggtacccgtaagtaccgaccggtaaccggccgttggttacttacgtagtcgacggtaggacgtacgggtaccgggaccctaacgtaacgtccgtacgtcgtagtcggtacgtcggtacgggacgaaccgggtacccg

SEQ ID NO: 382310 - DNA, 751 bp, Homo sapiens
  misc_feature: GZ8MTXP02G87X0.13.76.G10.1.454.CMB.2.raw
  modified_base (250)..(250): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcngcctcgtggggttcaccgtcagtcacacctacatgagcgtgggtcccgccgaggcctcccgaggggaacggggctagggagtggccgttcttctttttatttagtaagtagtaggtagtacctataccgtccgcagacctcggtggacgggggtctacttccgacctactcctacccaagacgaaacctaacttacccaaaaggaaaccctaccggtacctttaggtttttaccccctttaaaaagaaaacgttacgaaaaccgtccggtaccgtaagggaacggaccggtaccggaagtaccggaacccggtaaccgggtccgttaaaggtttacgtttacggtacggtacggaacgggtaagggtaacgggtaccgggtacccgggggaaacccctaaaccgggttaaaaccggtttaccgtaccgggtaaccgttacggtaccggggtacccggttaccggggtacccgggggaacccggtaaaccggggtaccccgg

SEQ ID NO: 382311 - DNA, 717 bp, Homo sapiens
  misc_feature: GZ8MTXP02H9CDW.13.76.G10.1.454.CMB.2.raw
  modified_base (170)..(170): a, c, t, g, unknown or other
  modified_base (298)..(298): a, c, t, g, unknown or other
  modified_base (535)..(535): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtcgtccgtcgtccccaggacagacagccagcatcacctgctctaggaaataattggacaagattaaatcttacttctgtatcagacagagtcgagccacgtcccctgtgctgtcatctatacaagntcgaccgtaaggcccggaccctacgaggtactcccccgtagacgtcgtattccgtcgtcggtcctacctacgtccgtacggaactccgacgacccactctacgaaccacgtaccgacgggacccgggaacccgtagggtaccttaaaggtcggtaacgttagggaccgggttacgttaacggttaacctttaacgtttacggtacggttaccggaaggggtccggtacgggaaaccncggacgaacggtacccgtaccgtccggtaacccccggtttacgtttaccggttaccggtttaacccggtacccggggttaaaccggttaacccggggtaaaacccggtaacccgggttaaccccgttaaacccggttaacccggtaaacccggtacccggtaaaacccccggtaacccccgg

SEQ ID NO: 382312 - DNA, 672 bp, Homo sapiens
  misc_feature: GZ8MTXP02JPBT8.13.76.G10.1.454.CMB.2.raw
  modified_base (253)..(253): a, c, t, g, unknown or other
  modified_base (343)..(343): a, c, t, g, unknown or other
  modified_base (567)..(567): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtctggaggaggcttgatccgaggccggtgggggtccctgacgtactctcctgtgcncgcctcgtcggtcaccgtcagtcaccacctacagtgacgcggtacgggtcccgaccgaggccgtaccggaaggggaacggggtcgtaggngtcggtcgtttcttacttttaattacgtaggtagtggttaactaccctataccgtccgcacgtaccgtccgggtgggaccgggggtaccctacgttccaaccgtactccgtaccgaagtaccgtaaacctaaacgttacccgaaacgtaaccgtaccgtcttacgtttactaacaacgttacgaacgcgtacctaggacgacgtccgatcgaacgcggtacgtntacgtcgtgacgaggtacgaggacgtacccggggacctaacggttaaaccgttactaccgtgttacggcggtaacggttcgggaccgggtaaccgacggacccgg

SEQ ID NO: 382313 - DNA, 569 bp, Homo sapiens
  misc_feature: GZ8MTXP02F8N0C.13.76.G10.1.454.CMB.2.raw
  modified_base (295)..(295): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggttcaccgtcagtcacacctacatgagctgggtccncaggctcgagggagggctggagtgcgtcttcttttattatagtgtggtagtacatactcgcagctccgtggagggccattcacatctcagagactaatccaaagtaccacgtcttagtttctacaaatgaaacacggtcctagaagacgcccgaagttgaccgtacgggccttagtacttactggtcgacgtaagaaggacgttaccgggggacccaaggtaaaccgttaacgaaacgtccttaagcgggtaaccgtcgtacgggggaaccccg

SEQ ID NO: 382314 - DNA, 587 bp, Homo sapiens
  misc_feature: GZ8MTXP02JIQHS.13.76.G10.1.454.CMB.2.raw
  modified_base (442)..(442): a, c, t, g, unknown or other
  modified_base (459)..(459): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgccaggctccgaggggaggggctggagtgcgtcttcttttatttatagtagtggtagtaccatactccgacagactccgtggacggggcctattccacatcctaccagagacaattccaaagacacgcttgtttctacaaaatgaaacncgactgacgacgacganacgacgaccggtctagttactacgtgtcgacggaggagtacggggtaccgggaccctaacggtaaaccttaccgtacgaaccgttaggtacggtacgtcggggaccgggaaccggaacggaaccccgg

SEQ ID NO: 382315 - DNA, 637 bp, Homo sapiens
  misc_feature: GZ8MTXP02HIFWX.13.76.G10.1.454.CMB.2.raw
  modified_base (253)..(253): a, c, t, g, unknown or other
  modified_base (297)..(297): a, c, t, g, unknown or other
  modified_base (412)..(412): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctaattttaaaaggtgcccagtgtgaggtgcagctggtggagtcgtggaggaggtcttgatccagccgtgggggtccctgagactctcctgtgcngcctctggttcaccgtcagtcacacctacatgagcgtgggtccnccgaggctccgaggggagggctggagtgcgttcttcttttattatagtagtggtataccatactcgactacgactccgtgggacggggtcctattccaacctatcctccaaaganaacaaattcccaaaaggaaccacgtcctttagttttacccttaaaacaaatacgaaacacgtacgtaggacgacgacgaagtaccgaccgtacggtacgttagttacttacgtgtacggacgtaggacgtacgggtacccgggaaccctaaacggttaaaccgttacgacgtaacgttacggtacgggtaccggtcgggaccggggaacccgaaacgggtacccg

SEQ ID NO: 382316 - DNA, 686 bp, Homo sapiens
  misc_feature: GZ8MTXP02HFXA2.13.76.G10.1.454.CMB.2.raw
  modified_base (509)..(509): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggaggaggcttgatccagccgtgggggtccctgagactctctgtgcacgcctcgtcggtcaccgtcagtcacacctacatgagcgtcgggtcccgccgaggccgtaccggaggggacggggcgtgggagtcggtcgttctttacttttatttagtagttaggtaggtagtacctataccgtccgacagtaccgtcggtgggacggggtcctacgttccaacctactcctacccgaaagtacgaaacctaaacttacccgaaagaaccctacgttccttagttttacctaacaaaagtacgaaaccngtacccgtaggaacgaccggaccgtaatcgggaaccgtaccggggtacgttaggttaacctttacggtggtaggtacggaggtaggtacgggtacccggggacccctaacgggtaaccttacgtacggtcgttaggtccggtacggttcggacggggaacccgtaaggggtaccccg

SEQ ID NO: 382317 - DNA, 700 bp, Homo sapiens
  misc_feature: GZ8MTXP02JQZLZ.13.76.G10.1.454.CMB.2.raw
  modified_base (283)..(283): a, c, t, g, unknown or other
  modified_base (483)..(483): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagctgggtggagtctgggaggaggcttgatccagccgtggggggtccctgagactctcctgtgcagtcctctgggtcaccgtcagtcacacctanatgagcgtcgggtccgccgaggcctaccggaaggggaacggggcgtagggagtcgtcgtttctttactttttaagtttacgtaaggttaggtaggttaacgtaccctacttaccgtcccgacgacgtaccgtccgggtgggaccgggggaccgtacttaccacctatccctaccgaagaacgtaactaaactaccgaaanaaacccgacgtaccttagttttacttaacgaaaattacgaaaccgagtaccgtaggaacgacgaccggtaactacggaaccgaccggggtcgtacgttaagttaccgtagtacggacgaaggtaggacggtaccgggggaccctaaacggtaaccgttaaccgtacgtaacgtacgttacggacgttacggacggggaacccgaacggtaaccccgg

SEQ ID NO: 382318 - DNA, 610 bp, Homo sapiens
  misc_feature: GZ8MTXP02FLO45.13.76.G10.1.454.CMB.2.raw
  modified_base (379)..(379): a, c, t, g, unknown or other
  modified_base (419)..(419): a, c, t, g, unknown or other
tcagtcacgtactacacgaccggtgctcgatttagtcactcatacgggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtgggttcaccgtcagtcacacctacatgagcgtgggtccgccgaggctccgaggggagggcgtggagtgcgttcttcgtttttattatagtagtgtacgtacatactcgcacgactccgngagggcgtatcactatcacagacacaatccaaagacacgnttgttctacaaatgaaacagcctagacgacgaccgtaagtcgaaccgtcgggtcccgttagttaacgtttacgtggttacggacggtaaaggaacgggtacggtaccgggggaccccctaaaacgggtaaacgtttaaccctaacggtactaaggtcggggaccgttacggcgggggaccgaaaacggggg

SEQ ID NO: 382319 - DNA, 704 bp, Homo sapiens
  misc_feature: GZ8MTXP02FOBRF.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatccagccgtgggggtccctgagactctcctgtgcagcctcgtggtcaccgtcagtcaccacctacatgacgcgtcgggtcccgccgaggcctccgggaaggggaacggggcgtgggagtcgcgtttcttactttttagtttagtagtagtaggtagtacctatacctcgcacgtaccgtcggtgggacggggtacctacttaccgacctatccctaccgaagacgtaaacctaacgttaacccgaaaaggtaaaccctaccggtctttacggtttaaccttaacaaaaacttcggaaaaccacggtacccgtaggaaacggacgtacccggtaaagtaccggaaccggtacccggggttaccgttaagttacgttaaccgtggtacggacggtaggaggtacggtaccggggaaccctaaacggtaacgttacgtacgtaacgtggtacgggtaccgttcgggacggggaaccgacggggtaaccccg

SEQ ID NO: 382320 - DNA, 739 bp, Homo sapiens
  misc_feature: GZ8MTXP02JBQO6.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgatctgggttttccttgttgctattttaaaggtgcccagtgtgaggtgcagctggtggagtcgtggaggaggcttgatccagccgtgggggtccctgagactctcctgtgcagcctcgtgggttcaccgtcagtcacacctacatgagcgtcgggtcccgccgaggcctccgaaggggaacggggcgtgggagtgcgttctttcttttatttatagtagtggtagtacctatacctccgacagacctccggtggacggggtcctagttccacctactcctcccgaaaggctaaacctaacttaccccgaaaagtaaacccgtacgtcctttaggttttaccccttaagaaaaattcggaaaaccacggtccctaggggaaacgaccggacccggtaattacggggaacccgtaacccgggggtcccgtttaagtaaccgtttaacgtcggtaggaacccggtaagggaacggtaacgggttaccggggggaacccccctaaaaggggttaaaaacccgtttcccgaaaacggtccgtttaaaggttaccggggaaccggtttccggaccggggggaaccccgtaaaacgggggaccccccgg

SEQ ID NO: 382321 - DNA, 652 bp, Homo sapiens
  misc_feature: GZ8MTXP02JUEW6.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgaacgtggtccgccaggctccgagggaggggctggagtgcgtcttcttttattatagtgtggtacgtacatactccgcagactccgtggacggggtccgattccaccgtactcctaccgagaagacctaaacttacccaaaggtaaaccaacggtcttacggtttttacctacgtaaaacttacggaaacctagacccgttaggacggacgggacccgaagttacggaaccgaaccggggtcccggttagttaacgtttaccgtggttaaggccggaaggtaacggcgggttacggggaccccgaacggtaaaccgttacgtaacgccgttaagcgggtacgtccggtacgggggaccaaacccggggg

SEQ ID NO: 382322 - DNA, 627 bp, Homo sapiens
  misc_feature: GZ8MTXP02GEBJO.13.76.G10.1.454.CMB.2.raw
  modified_base (383)..(383): a, c, t, g, unknown or other
  modified_base (424)..(424): a, c, t, g, unknown or other
  modified_base (447)..(447): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtcgggtcccgccgaggcctccggaggggaaggggcgtggagtcggcgttcttcttttatttatagtagtggtagtacatacctcgcagacctcgnggacgggcattcaccatctccagacactactacaaagaacncgcttgttactacaaatgaaacncgcctagaacgacgccgatacgaccgacggtccgttagtactttacgtggtcgacggaggaacgcgggtacccgggggacccctaaacgggttaaacccgttacgtaaccggaacgtttaacgggtacggggtaccggttaccggggacgggggaaccccgtaaacgggggtaacccccg

SEQ ID NO: 382323 - DNA, 676 bp, Homo sapiens
  misc_feature: GZ8MTXP02HKILM.13.76.G10.1.454.CMB.2.raw
  modified_base (297)..(297): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccaggccgtgggggtccctgagactctcctgtgcagcctctcgggtcaccgtcagtcacacctacatgagcgtcgggtccnccgaggctccggaggggacggggcgtggagtgcgttcttctttttattagtagttagtggtagtaccatacctcgcgagtaccgttccgtggggacggggccgtattaccgacctactcctacccgaaagacgaactaaacttacccgaaaagaaccctacggtctttacgttttacctaacgaaaattacgaaacgcgtaccgtaggaagacggacccgtaagtcggaaccgtaaccgggtcgttaggtatttaaccgtggtacgacggagacgggtacggttaccgggggacccctaacgggtaaaccgtttccgaacccgtgttaacggtacgggtaccggtcggtaccgggggacccgaaaacgggggtcccccg

SEQ ID NO: 382324 - DNA, 554 bp, Homo sapiens
  misc_feature: GZ8MTXP02GNCGO.13.76.G10.1.454.CMB.2.raw
  modified_base (372)..(372): a, c, t, g, unknown or other
  modified_base (405)..(405): a, c, t, g, unknown or other
  modified_base (433)..(433): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggggttcaccgtcagtcacacctacatgagctgggtccgccaggctccgaggggaggggctggagtgcgtcttcttttatttatagtagtggtatacatactcgcagacctcgtggngggccagttcaccatcctcagagacaatccaanaacacgcttgttactacaaatgaaaccngcctagagacgaccgatacgacacggacccgttgtaacttacgtgtcgacgagacgtacgcggggacccacgtaacgttacacgcgtagtacggtacgtcgtacgggaccgaagggacccg

SEQ ID NO: 382325 - DNA, 580 bp, Homo sapiens
  misc_feature: GZ8MTXP02JAPY6.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctatttaaaaggtgcccagtgtgaggtgcagctggtggagtctggaggaggcttgatccagccgtgggggtccctgagactctcctgtgcagcctcgtggtcaccgtcagtcacacctacatgagctcgggtccgcaggctaccgagggaagggctggagtcgcgtcttctttattatagtagtgtagacatactcgcagctcgtgacgggccagttcacatctacagtacgaacattacccaagaccacgtctagttactactaaagtgaactacgactagacgacgaccgtaagtgaccaccgggtccgttaggtacttacgtaggtcgacgaggagtaacggtcggggaaccctacggtaaaccgttaacgtaacgaccgttaggtacgggaacccgtcgggttacggggaacccgg

SEQ ID NO: 382326 - DNA, 662 bp, Homo sapiens
  misc_feature: GZ8MTXP02HWRVS.13.76.G10.1.454.CMB.2.raw
  modified_base (232)..(232): a, c, t, g, unknown or other
  modified_base (248)..(248): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtctggaggaggcttgatccagccgtgggggtcccngagactctcctgtgcngcctcgtggttcaccgtcagtcacacctacatgagcgtcgggtcccgccgacgggcctaccggaggggaacggggcgtggaggtcgtcgttctttactttttatttagtagttagtggtaacgtactagttacctccgactagtaccgtccggtgggtacggggcctattccgacctactcctaccgagtacaactaacgttaccgaaagaacctcgtctttacgtttactaactaaatcgaaactacggtccctagaacgacgacccgaagtcggaaccgaccgggtccgttagttaacgtttacgtggtggtaacggaggtaggacggttcgggggaacccacggttaaaccgttaccagtccgttaaggtcggaccggttacggaccggggaaccgtaacggggaaccccg

SEQ ID NO: 382327 - DNA, 683 bp, Homo sapiens
  misc_feature: GZ8MTXP02HXYZ3.13.76.G10.1.454.CMB.2.raw
  modified_base (501)..(501): a, c, t, g, unknown or other
  modified_base (564)..(564): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggaggaggcttgatccagccgtgggggtccctgagactctcctgtgcagcctcgtgggttccaccgtcagtcacacctacatgagcgtcgggtccgccgaggcctaccggaaggggaaggggcgtaggaggtcgtcgttcttactttttatttagtagttaggtggtacgtaccagtacctccgcgacgtaccgtccggtggggacgggggcctacgttcccaaccctactcctacccgaagacgaaactaacttaccgaaagaactacgtcttagtttacctacaaagtacgaaacncgtactaggaacgacgaccgtagacgaccgtaccggtccggttagttaaagttaccttgggancggaaaagcgggaaacgtccgggggaaacccctacggtaaaccgttttaacgaccggtaaccgtttaaaggcgggtaccggtttaccggacgggggaaccgtaaaccgggggtaccccg

SEQ ID NO: 382328 - DNA, 661 bp, Homo sapiens
  misc_feature: GZ8MTXP02IDA8M.13.76.G10.1.454.CMB.2.raw
tcagtcacgtactacacgaccggtgctcgatttagtcactcatacagggggggagaggagcccagcactgggattcccaggtgtttccattcagtgatcagcactgaacacagaggactcaccatggagttgggactgagctggtattttccttttggcttattttaaaaggtgtccagtgtgaagtgcagctggtggagtcgtgggggagcgttggtacagcctggcacggtccctgagactctcctgtgcagcctctggtattcctacctttgatgattatgccatgcctacgtggggtccgacaacgccgtaccggaggggaacggtccgtagggacgggttgggtctcgtaaggttattaggagtaggtaataggtggtagacgtagtagggcttagtggaccggtacttcggtaggtacgggaacggggtcccgtaatttacccaacccgtaacgttccctacccgaagaaccgaaccgaaaccgacccaaaacgtacccttaccccgtagtacctcgtacgaactaaagtacgaacacgacgtaggacgagtcgtaggacgtaccgacggttaccttagttaattagtagtacgaacaaaacgtccttaaccccgttaaaccgttagtttacgtttacggaggtttacgttaacg

SEQ ID NO: 382329 - DNA, 698 bp, Homo sapiens
  misc_feature: GZ8MTXP02GVDZG.13.76.G10.1.454.CMB.2.raw
  modified_base (531)..(531): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtgggttcaccgtcagtcacacctacatgacgcgtcgggtcccgccgacggccgtaccggaaggggaacggggccgtagggacgtcggtccgtttctttactttttaagtttagttaaggttaggttaggttaagtaaccctaacttaccgtcccgcaacgtaccgttaccgggtggggaacgggggtcccgtaacttacccacctacgtcctaccgaagacgaaacctaattacccgaaagaacctacgtcttcgtttactaacaatacgaaacncgacctagaagacgacccgaagtcgaccgtaccgggtccttagttacttaccgtggtacgacggaaggtagacggtaccgggggacccctaaacggtaaaccgttaccgtaccgaacgttaacggacggtaccggtcggtacggggacccggtaaacgggtaccccg

SEQ ID NO: 382330 - DNA, 607 bp, Homo sapiens
  misc_feature: GZ8MTXP02HDQYI.13.76.G10.1.454.CMB.2.raw
  modified_base (293)..(293): a, c, t, g, unknown or other
  modified_base (308)..(308): a, c, t, g, unknown or other
  modified_base (332)..(332): a, c, t, g, unknown or other
  modified_base (386)..(386): a, c, t, g, unknown or other
  modified_base (426)..(426): a, c, t, g, unknown or other
  modified_base (453)..(453): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagaataaatatacttcctggtatcagcagaagtcaggccagtcccctgtgctggtcatctatcaagntgaccagccggcctnagggtatcccccgtgagcagttcncgtggctccaactcgtaggactcagcccactctagaccatcgacggcggacccnggacctatacggatggaaggtctacgtacgtactttacgngttacggaggtacgggtacggggaacncgggacgaaacgcccgtaacgtacccggcccggtaacgtttaccggtcggtttacccggtttaccggggaaaccgtttacgggggaacccgttaaacgggtaccccggtaacccgtttacccgaaaacggttacccgaaccggtaaacccccgg

SEQ ID NO: 382331 - DNA, 651 bp, Homo sapiens
  misc_feature: GZ8MTXP02FHX8L.13.76.G10.1.454.CMB.2.raw
  modified_base (387)..(387): a, c, t, g, unknown or other
  modified_base (472)..(472): a, c, t, g, unknown or other
  modified_base (528)..(528): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctattttaaaaggtgcccagtgtgaggtgcagctggtggagtctggaggaggcttgatccagccgtggggggtcctgagactctcctgtgcagcctcgtggtcaccatcagtcacacctacatgagcgtcgggtccgccaggctaccggagggggaaggggctggggacgtggccgtcttctttttaatttataggttagttggtacgtacactactccgcagctccgnggacgggcgtattccacatctccagtacgaacaacttaccgaaagaaccacgtctttacgttttacctaacaaagttacgaaacncgtccctagaagacggccgaatcggaaccgaccgggtccgtagttaacgtttacgnggtaggtaccgaggtaacggacggttaccgggggaccccctaaacgggtaaaacccgtttacgaaccggtaccgttaaagtcggggtaaccgttacggtacggggggaacccaaaaccggggg

SEQ ID NO: 382332 - DNA, 728 bp, Homo sapiens
  misc_feature: GZ8MTXP02GYI4Z.13.76.G10.1.454.CMB.2.raw
  modified_base (514)..(514): a, c, t, g, unknown or other
  modified_base (527)..(527): a, c, t, g, unknown or other
  modified_base (588)..(588): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtgggaggaggcttgatccgagccgtgggggtccctgacgactctcctgtgcagcctcgtcgggttcaccgtcagtccacacctacagtgagcgtcgggtccgccgaggccgtccggaaggggacggggcgtaggaggtcggtcgtttctttactttttatttagtaggttaggttcggttagtaaccctactaccgtccgacgacgtaccgttccggtggggaccggggccgtacttcccgaccctactcctacccgaagacgtaaacctaactacccgaaaagacccgtacgtcctttagtttaccctaanaaacttgaaaacncgtaccgtaggaacgacgccgtaagtccggaaccgaccgggttccttagttaccgttacgnggtacggacggtaaaggacggtcgggtacccgggggaacctaaaccgggttaaaacgtttcccgaaacggtcgttaacggggtccgggttaaccggggttaccgggtaccgggggaaacccgaaacgggggtaacccccg

SEQ ID NO: 382333 - DNA, 583 bp, Homo sapiens
  misc_feature: GZ8MTXP02JC239.13.76.G10.1.454.CMB.2.raw
  modified_base (171)..(171): a, c, t, g, unknown or other
  modified_base (317)..(317): a, c, t, g, unknown or other
  modified_base (458)..(458): a, c, t, g, unknown or other
  modified_base (464)..(464): a, c, t, g, unknown or other
  modified_base (466)..(466): a, c, t, g, unknown or other
  modified_base (486)..(486): a, c, t, g, unknown or other
tcagtcacgtactacacgaccggtgctcgatttagtcactcatacagggggggagaggagcccagcactgggattccgaggtatttcccattcggtgatcagcactgaacacagaggactcaccatggagttttggctgagctgggttttccttattactattttaaaggngtccagtgtgaggtgcagttggtggagtctggaggaggcttggtccaggcccggggggggtccctggagactcgtcatgtgcggcctcgtgggctcaccgtcaacaccaactacatgagctgggtccgccaggctccgaggggaanagggccggaagtggggtctacgaggtttatttaatcgttcgacggttggcccacattcgaccgcagactcccggtgacggggccgttcaccagtctccaggatacaattccaaagaacacgtgtatcttacaatgacacgngagagngncgacgacggctatatcgtgngagaagagtgacgacggacggaccggacccgtaggtcgggcgtgggtacggtacggttcgttcgttacggacgtcggtcggtacgggaccgtacggg

SEQ ID NO: 382334 - DNA, 701 bp, Homo sapiens
  misc_feature: GZ8MTXP02GG0XI.13.76.G10.1.454.CMB.2.raw
  modified_base (276)..(276): a, c, t, g, unknown or other
  modified_base (564)..(564): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggtttccttgttgctatttaaaaggtgccagtgtgaggtgcagcgtggtggagtcgtggaggaggcttgatccagccgtggggggtcctgagactctcctgtgcacgctcgtcggtcaccgtcagcacactanatgagcgtcggtcccgacgacggccgtacggaaggggaaggggtctacgggagtcggtacgttctttactttttaatttagtaagttagtagggtaagtacctaacgtaccgtccgacgtacgtaccgtccggtaggggacgggtaccgtaacgttacccaccgtactcgtaccgaagaaacgtaaaccttaaacttaacccgaaaagtaaacccgtacgttacttacggtttttaacaacgtaaaactcggaaaactcgtacccggttaagacgacggacccgttanaccggtaaaccgtcggtaccgttattactttacgcggtagacgaggtaacgcggtaaccggggaccctaaacgttaaccgtacgtacggaactaggtacggtaccgtacgggtacggaaccggtaacggtaaccccg

SEQ ID NO: 382335 - DNA, 588 bp, Homo sapiens
  misc_feature: GZ8MTXP02IJL3Z.13.76.G10.1.454.CMB.2.raw
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtggttcaccgtcagtcacacctacatgagcgtgggtcccgccaggcctccgaggggaaggggctggagtgcgttcttcttttattatagtagtggtagtacatactccgcagactccggtgacggggccgtattccacatcctaccagacgtacaattaccaaagaaccacgtcttcgtttctacaaatacgaaacagccctagagtacgaccgagtcgaaccgacgggtccgttagttacttacgtggtacgacgagaggacggtcgggggacccaacgtaacgttaccgaacgtctaaggtcggacgtcggtacgggggaccaaacgggg

SEQ ID NO: 382336 - DNA, 719 bp, Homo sapiens
  misc_feature: GZ8MTXP02JN9XA.13.76.G10.1.454.CMB.2.raw
  modified_base (187)..(187): a, c, t, g, unknown or other
  modified_base (241)..(241): a, c, t, g, unknown or other
  modified_base (268)..(268): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgccctnagtgtcgtcggggccccagggcaggacggtccaccatcctcctgcacgtgggancagctaccaacagttgggcactattangatgtacacgtgtaccagtctagttccgaggagcgacggtcccagacctcctacaactactaataacccgtaaacaaacctaacgtcccggacccgacggacgggtccccacggtaacccgtacttccgtaccgtcgtccgttccgtacggtccttcggaccctaacccgtcctaacccgtccccttcccgtacgggttaccctaacgtccgtaccggttcgggacccttaccggacgggtttaccgagggtagggtaagttcggggaacggttaccttaggttaaacctttcgtttcccgtaacgccctttaacggttacgttaccgtaccggtaaacccgtacgaaccgtaccgtacccgtttaggtaacgggtttacccgttccgggttttacggggtaaccgggggtttcccccggggggaacccgggggttaacccaccccggggg

SEQ ID NO: 382337 - DNA, 668 bp, Homo sapiens
  misc_feature: GZ8MTXP02JBAKL.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggtttccttgttgctattttaaaaggtgccagtgtgaggtgcagctggtggagtcgtggaggaggcttgatccagccgtggggggtccctgagactctcctgtgcagcctcgtgggttcaccgtcagtcacacctacatgacgcgtcgggtccgccagggcctaccgaaggggaaggggctagggagtggtccgttctttcttttatttagtagtagtaggtagtacctatacgtccgacacgactccggtggacggggtccattccgaacctacgtcctacccaagacgaaacctaaacttaccgaaaacgaaaccacgtcttacgttttacctaacaaaattcggaaaccaggcctaggaacgacgacccgtagacgaccggacggtccgttagtaactttacgtggtacgacggtaaggacggacggtacgggggaaccccctaaacgggtaaaccgtttaacgaccggtaagtacgtaccggggtacgtcggtacgggggacccgtaaacgggtaccccgg

SEQ ID NO: 382338 - DNA, 656 bp, Homo sapiens
  misc_feature: GZ8MTXP02JRRVZ.13.76.G10.1.454.CMB.2.raw
  modified_base (248)..(248): a, c, t, g, unknown or other
  modified_base (250)..(250): a, c, t, g, unknown or other
  modified_base (268)..(268): a, c, t, g, unknown or other
  modified_base (280)..(280): a, c, t, g, unknown or other
  modified_base (388)..(388): a, c, t, g, unknown or other
  modified_base (432)..(432): a, c, t, g, unknown or other
  modified_base (480)..(480): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtncngcctcgtggttcaccgtnagtcacacctanatggacgcgtcgggtccgccgaggcctaccggaggggaacggggctagggacgtcgcgttctttacgtttttaatttataggttagtagggttatactatacctccgnacgacgtccgtgggacggggctattcactactctccagtacganaacttaccgaaagaacactcttcggtttaactacaaaattgaaaaccngtaccgtgaagcgaccggatacggaccgacgggtcccgtagttacgttacgtagtcggaaccggaggaggaacggtcccgggggaccctaaacgggtaaaccgtttaccgaaccgtaacgtacggtacggggtaccgttacgggtaccgggggacccggaaaacggggaaccccgg

SEQ ID NO: 382339 - DNA, 665 bp, Homo sapiens
  misc_feature: GZ8MTXP02JAPJR.13.76.G10.1.454.CMB.2.raw
  modified_base (496)..(496): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggtcaccgtcagtcacacctacatgagcgtcgggtcccgccaggcctccggaggggaggggctaggagtgcgttcttcttttatttagtagtagtaggtagtactatacctccgacacgtaccgtcggtgggacggggccgtagttcccaccgtactaccctaccgaagacgtaaacctaaattacccgaaaaggaacctacgtcctttagttttaccttaacaaaagttcgaaaaccncgtcccttaaggacgaacggacccgtaagtccgaaccgtacgggtcccgttagtacttacgtgtacgacgtaaggagacggtaccgggggacccctaaacggtaaccgttacgacgtaacgtaacggtcgggtaccgtcggtacgggggaaccccaagggggacccccg

SEQ ID NO: 382340 - DNA, 712 bp, Homo sapiens
  misc_feature: GZ8MTXP02FWG20.13.76.G10.1.454.CMB.2.raw
  modified_base (522)..(522): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtggttccaccgtcagtcacacctacatgagcgtcgggtcccgccgaggcctccggaaggggaaggggcgtgggaggtcggtcgttctttactttttaatttagtaaggttaggtaggtaagttacaattaccgtccgacaacgtaccgtccggtagggacgggggcctacgttccgaacctattccctaccgaaaggaacgaaactaaacttacccgaaaagaaccctacggtacctttgtttactacgaaaattcgaaaacncgtcctaggaaggaccgacccgtagtacggaaccgtaccgggtaccgttagtttaaacgtttaccgtgggtacggaccggaagggacggtacgggttccgggggaacccctaacgggttaaaacccgtttaacgtaaccgacgtttaacggtacggggtaccggttacggggtacgggggaaaccccggg

SEQ ID NO: 382341 - DNA, 566 bp, Homo sapiens
  misc_feature: GZ8MTXP02F1Q84.13.76.G10.1.454.CMB.2.raw
  modified_base (343)..(343): a, c, t, g, unknown or other
  modified_base (391)..(391): a, c, t, g, unknown or other
  modified_base (398)..(398): a, c, t, g, unknown or other
  modified_base (437)..(437): a, c, t, g, unknown or other
  modified_base (494)..(494): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtcgtggaggaggcttgatccaggccgtgggggtccctgagactctcctgtgcagcctcgtgggtcacccggtcagtcacacctacatgagctgggtcccgccaggcctccggaggggaacggggctgggagtgcgtctttnttttattatagtagtgtatacatactccgcagctcgtggacggggccntcacctntctccagagaactattaccaaagacacgcttgttactanaaagtagaacagcctagagacgacccgtagacgaccgacgggccgttagtattacgngtggacgtagaggacgtccggggaccaacggtaaacgtccgacgctacggcggtacgtcggagggaacccgg

SEQ ID NO: 382342 - DNA, 661 bp, Homo sapiens
  misc_feature: GZ8MTXP02GKX5Q.13.76.G10.1.454.CMB.2.raw
  modified_base (335)..(335): a, c, t, g, unknown or other
  modified_base (490)..(490): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtggttccaccgtcagtcaccacctacatgagcgtcgggtcccgccgaggcctccggaggggaaggggcgtggagtgcgtnttcttttattatagtaggtggtagtaccatactccgacagaccgtcgtgggacggggcctacttccacctactcctacccgaagacgtaaacctaaacttacccgaaaagaaccctaccgtcctttacgttttacctaacaaaagtcgaaaaccncgtccctaggaacgcggacccgaatcgaccgaccgggtccgttagttaattccgtgtggacggaggagtacgggtaccggggacccctaaacggtaaccggtttaccgtacggtaacgttaacggtcgggtacccgtcggtaccgggggaacccgaaacggggtacccccg

SEQ ID NO: 382343 - DNA, 670 bp, Homo sapiens
  misc_feature: GZ8MTXP02ITYZ5.13.76.G10.1.454.CMB.2.raw
  modified_base (371)..(371): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtggggggtccctgagactctcctgtgcagcctcgtgggttcaccgtcagtcacacctacatgagcgtgggtcccgccgaggctccggaggggaaggggcgtggagtgcgttctttcttttattagtagtagtaggtatacatactccncacgaccgttccgtgggacggggcctacgttccaccctatcctaccagtacgaactaacttaccgaaaacgaaaccgacggtcctttacggtttttacctaactaaaacgtcgaaacgacgtcccgttaaggacggaccgccggtataccggaccgaccgggtcccgttaggttacttaacgtgtacggtacggaggtaaggacggttccggggaccctaacgggtaaaccgtttacgtaacggtcgttaacggtccgggtacggtcgggtacggggacccggaagggtaacccccggg

SEQ ID NO: 382344 - DNA, 591 bp, Homo sapiens
  misc_feature: GZ8MTXP02JA3IO.13.76.G10.1.454.CMB.2.raw
  modified_base (380)..(380): a, c, t, g, unknown or other
  modified_base (450)..(450): a, c, t, g, unknown or other
tcagtcacgtactacacgaccggtgctcgatttagtcactcatacagggggcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagctctcctgtgcagccctctgggtcaccgtcagtcacacctacatgagcgtcgggtccgccaggcctaccgaggggagggcgtggagtcgcgtcttcttttattatagtagttggtagtacatactcccgcacgacgtccggtggacggggccnttcacctatcctccgagacgactaaactccaaaagtaccacggtcttagtttactacgaaattcgaaacngacctgaacgagtacccgatacggaaccgtaccggccttaggtattaccggtgtacggacgagagtacggtcgggaacccaagtacgttaccacgactagcggaacgtcggtacggggacaacgggcccacggtctacccg

SEQ ID NO: 382345 - DNA, 576 bp, Homo sapiens
  misc_feature: GZ8MTXP02IKIDM.13.76.G10.1.454.CMB.2.raw
  modified_base (283)..(283): a, c, t, g, unknown or other
  modified_base (286)..(286): a, c, t, g, unknown or other
  modified_base (296)..(296): a, c, t, g, unknown or other
  modified_base (298)..(298): a, c, t, g, unknown or other
  modified_base (301)..(301): a, c, t, g, unknown or other
  modified_base (309)..(309): a, c, t, g, unknown or other
  modified_base (312)..(313): a, c, t, g, unknown or other
  modified_base (316)..(316): a, c, t, g, unknown or other
  modified_base (324)..(324): a, c, t, g, unknown or other
  modified_base (327)..(327): a, c, t, g, unknown or other
  modified_base (348)..(348): a, c, t, g, unknown or other
  modified_base (351)..(351): a, c, t, g, unknown or other
  modified_base (356)..(356): a, c, t, g, unknown or other
  modified_base (361)..(361): a, c, t, g, unknown or other
  modified_base (377)..(377): a, c, t, g, unknown or other
  modified_base (379)..(379): a, c, t, g, unknown or other
  modified_base (381)..(381): a, c, t, g, unknown or other
  modified_base (429)..(429): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcgtggttttcgttgtaggctattttaaaaggtgcccagtgtgaggtgcagcgtggtggagtcgtggaggaggcttgatccagccgtggggggtccctgagactctcctgtgcacgcctcgtgggtctacgcagtcacacctantgngcgtcggccncngcncggagggnggnnggngtgtcttnttnttttatagtagtgtgtatacntcncgcancgcgngggacggctactcacncncncacacaactaactacaacgaacgtacgtcttcgttacttaactaatanaacgacgcgacgagacgacgacgacgaccgtacggtccgtcgttagttagtgtgacgaggaggacggtacggtaccgtaaccgtaaccgtaacgtacgtaacgtacggtacggtacggtacggtacgggaccggaaccggtaaccgg

SEQ ID NO: 382346 - DNA, 573 bp, Homo sapiens
  misc_feature: GZ8MTXP02GOICS.13.76.G10.1.454.CMB.2.raw
  modified_base (268)..(268): a, c, t, g, unknown or other
  modified_base (295)..(295): a, c, t, g, unknown or other
  modified_base (359)..(359): a, c, t, g, unknown or other
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtnagtcacacctacatgagctgggtcccncaggctccgagggagggctggagtgcgtctcttttattatagtagtggtacgtacatactccgnacgactccgtgacggggccgattccactatctaccagagacaatccaaagtacacgtctgttactcaaattgaaacagcctagagcgaccgatcgacgacggccgtagtactacgtgtagcgagagtacgcgggggaccccaaacgggtaaccgtttacgaaccgtacgtacgttacggggaccgtttcggacgggggacccgaaaaccggggg

SEQ ID NO: 382347 - DNA, 616 bp, Homo sapiens
  misc_feature: GZ8MTXP02G7QP4.13.76.G10.1.454.CMB.2.raw
  modified_base (455)..(455): a, c, t, g, unknown or other
  modified_base (502)..(502): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtccctgagactctcctgtgcagcctctgggttcaccgtcagtcacacctacatgagcgtgggtccgccaggctccgaggggagggctggagtgcgtcttcttttattatagtagtggtagtaccatactccgcacgacctccgtggacgggggtctacgttcacctatcctacccagagacctaattaccgaaagactacgtcttcgtttactacaaatgaaaccngcctggagacgaccggatcgaaccgaccgggtccgtagtacttacgnggtcgacggtagaggacggttacgggggacccctaacggtaaaccgtttacgtaacggccttaaggtccgggtaaccggttcggtaccgggggaccgaaaaccggggtaccccg

SEQ ID NO: 382348 - DNA, 671 bp, Homo sapiens
  misc_feature: GZ8MTXP02JV08O.13.76.G10.1.454.CMB.2.raw
  modified_base (553)..(553): a, c, t, g, unknown or other
  modified_base (560)..(560): a, c, t, g, unknown or other
tcagtcacgtactacacgaccggtgctcgatttagtcactcatacagggggcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcacgctcgtggtccaccgtcacgtcacacctacatgacgcgtcgggtccgccgacggctaccggaggggacgggcgtagggacgtgccgttctttactttttaagtttagttaggttaggttggttaacgtacacttaccgtccccgacgacgtaccgtccgggtaggacggggtacctactccaacctactcctaccgaagacgtaaactaaacttacccgaaaagtaaccgacgtactttacgtttactaacaaaagttagaaacacgtcctaggacgaacgccgagtacgaccgtacgcgttattactacgngtacggngagtaggacggtaccggggacccaacggttaaactaccgtacgtcgtacgttagggccggttacccgggagggggaccccgaaacgggacccgtaccggtccgtaaccccg

SEQ ID NO: 382349 - DNA, 572 bp, Homo sapiens
  misc_feature: GZ8MTXP02I12S8.13.76.G10.1.454.CMB.2.raw
  modified_base (370)..(370): a, c, t, g, unknown or other
  modified_base (379)..(379): a, c, t, g, unknown or other
  modified_base (394)..(394): a, c, t, g, unknown or other
  modified_base (418)..(418): a, c, t, g, unknown or other
  modified_base (440)..(440): a, c, t, g, unknown or other
  modified_base (471)..(471): a, c, t, g, unknown or other
  modified_base (481)..(481): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggaggaggcttgatccagccgtggggggtccctgagactctcctgtgcagcctcgtgggtcaccgtcagtcacacctacatgagcgtcgggtccgccgaggcctccggaggggaaggggcgtggagtgcgtcttcttttattatagtagtggtatacatacctcganagactccgngcgggctactcaccntcctcagacgacactacaagaccncgcttgttctacaaatgaaacngcctagacagccgaatcgacgacggcgttanacgtttacgngtcgagaggagtacggtccgggacccctaaaggtaccgtaactacggcctaggtcggaacgtccggacgggggtaccaaacggggtacccg

SEQ ID NO: 382350 - DNA, 661 bp, Homo sapiens
  misc_feature: GZ8MTXP02JJ3N6.13.76.G10.1.454.CMB.2.raw
  modified_base (357)..(357): a, c, t, g, unknown or other
  modified_base (386)..(386): a, c, t, g, unknown or other
  modified_base (389)..(389): a, c, t, g, unknown or other
  modified_base (542)..(542): a, c, t, g, unknown or other
  modified_base (549)..(549): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcgtgggtctttccttgttgcttaattttaaaaggtgcccagtgtgaggtgcagctggtggagtcgtgggaggaggcttgatccgaggcccggtcgggggtccctgagacctcctcctgtgcagtcctcgtggttccaccgtcacgtcaccacctacatgagtcgtcgggtcccgccgagccgtccggaggggacgggcgtggagtcgtcgttctttntttatttagtagtagtgtacgtacatacnccncacgtacgtcggtgggacggccgtactccactactccgaccaagactaactacttaacaaagaacctcgtctttactttactaacaaatgaactacggcctaaggacgtaccggacctagtacggaaccgtacgggccttaagttacgttcgnggtacgnggaaacggtaggacggtcccggggaacccctaaacgggttaacccgtttagaacccggtcgttaacggtccggggtaccgtaccggggccgggggaaccccgtaaaccgggg

SEQ ID NO: 382351 - DNA, 613 bp, Homo sapiens
  misc_feature: GZ8MTXP02H24MK.13.76.G10.1.454.CMB.2.raw
  modified_base (405)..(405): a, c, t, g, unknown or other
  modified_base (458)..(458): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtcgggtccgcccaggcctccgaggggaaggggcgtggagtgcgtcttctttttattatagtagtggtagtaccatacctcgcagcctcggtggaggggccattcacctatcctccagnaacctaacttacgaaaagaacacgtcttgttttacctacaaaatcgaaaaccncgccgtagacgacgacgatcgaccgtacggtccttagtacttacgtgtacgacgaggaggtacggtaccggggaccctaaaccggttaaacgtttaccgaccgtaacgttacggtcgggtaccgttcgggaccggggaacccgaacggggtcccg

SEQ ID NO: 382352 - DNA, 647 bp, Homo sapiens
  misc_feature: GZ8MTXP02GSQO1.13.76.G10.1.454.CMB.2.raw
  modified_base (303)..(303): a, c, t, g, unknown or other
  modified_base (561)..(561): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtccctgagactctcctgtgcacgcctcgtcggtcaccgtcagtcacacctacatgacgcgtcgggtcccaccgnggcctaccggaggggaaggggcgtaggagtcgtcgttctttacttttatttagtagtagtggtacgtacctatacctcgcacgtaccgtcggtgggacgggccgtacttccgacctactcctaccgaaagacgtaaacctaacttacccgaaaagtacccgtacgttctttacgttttaccctaagaaattcgaaacgtccgtaccgtggaacgtacggacccgagtaccgaccggacggtccgttagtactttacgngtcggacgaggagtcgggtaccgggaccctaacggtaacgttcacggtgtagacggtccgttcggacggggaaccaacggggtccc

SEQ ID NO: 382353 - DNA, 547 bp, Homo sapiens
  misc_feature: GZ8MTXP02FYXH6.13.76.G10.1.454.CMB.2.raw
  modified_base (232)..(232): a, c, t, g, unknown or other
  modified_base (478)..(478): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctgaaataatgcagataaatntactctgtatcagcagaagtcaggccagtcccctgtgctggtcatctatcaagtatgccaaagccggcccctgaacggggactccccccgtagacgcgatttccactggcctccaaacttcgtaggggaaacctcgaacgcccaactctacgtacccagtcacggccggacccaggctaagtcggattggaggctagtactagttacgtcgtacaggcgtagggactagacagctaactcgcccgntagtcgtcgttaacggacgtcgggaacctaacgggtccaacccggtctaaacggtcaacggaacccccg

SEQ ID NO: 382354 - DNA, 630 bp, Homo sapiens
  misc_feature: GZ8MTXP02GFDX4.13.76.G10.1.454.CMB.2.raw
  modified_base (252)..(252): a, c, t, g, unknown or other
  modified_base (374)..(374): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatcccgccgtgggggtccctgagactctcctgtgcncgcctcgtgggttcaccgtcagtcacacctacatgagcgtgggtcccgccgacggcctccgaggggaaggggcgtggacgtgcgtcttcttttattatagtagtggtagtacatactccganacgctccggtgacggggtccgtattccgacctatcctaccgagtacgacaaacgttaccaaagaacccacggtcttacgttttctaacgaaattcgaaacacgtccgtagacgagaccctagacggaccaccgggtccgtgtaacgtttacgtggtcgacggaggtacgacgggttccggggacccctaaggtaacccgtttaacaacggtacctaaggtcgggtaccgtcggtacgggggaaccaaacccggggg

SEQ ID NO: 382355 - DNA, 654 bp, Homo sapiens
  misc_feature: GZ8MTXP02JZB2W.13.76.G10.1.454.CMB.2.raw
  modified_base (248)..(248): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggagaggcttgatccagccgtgggggtccctgagactctcctgtgcncgcctgtcggttcaccgtcagtcaccacctacatgagcgtcgggtccgccgacggccgtccggaggggaacggggcgtggagtggccgtttcttactttttatttagtagttaggttaggtaactaccgacttacgtcccgacacgaccgttccggtgggacggggccgtacttccacctactcctaccaagtaacaacctaaacgttaccaaaagaaccacggtcctttacgtttacttaactaaaactacgaaaccgacgtaccgaggcgacggacccgtagcgaacgaccggtccgtagtacttacgtgacgacgagagacggaccggggtccaaacgggtactaacccgttacgaacgttacggacgggtacgttacggaccggggaccgaacgggaacccg

SEQ ID NO: 382356 - DNA, 712 bp, Homo sapiens
  misc_feature: GZ8MTXP02GXGT4.13.76.G10.1.454.CMB.2.raw
  modified_base (529)..(529): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatccagccgtgggggtccctgagactctcctgtgcagcctcgtcgggttcaccgtcacgtcaccacctacatgacgcgtcgggtcccgccgaggccgtaccggaggggaaggggtcgtggggagtggtccggttctttctttttatttagtagttagtaggtacgttacctagtacctcccgctacgtaccgtccgggtgggacggggtccgtacgttaccaccgtacttcctacccgaagtaacgaaccttaaacgttcccaaaaggaaaccctcggtacctttggtttacctaactaaaacgtcgaaaaccncggtacctagggaacgacgtacccgatacggacccgtaaccgggtcgttagttacgttaacggtgccggaaggacggtaggaccggttaccgggggaaccccttaaaccggtaaccggtttaccaccggttaagtcgtttaacggggacccgttcgggacggggaccgttaaacggggacccg

SEQ ID NO: 382357 - DNA, 641 bp, Homo sapiens
  misc_feature: GZ8MTXP02G6652.13.76.G10.1.454.CMB.2.raw
  modified_base (297)..(297): a, c, t, g, unknown or other
  modified_base (469)..(469): a, c, t, g, unknown or other
  modified_base (538)..(538): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtctgggaggaggcttgatccagccgtggggggtcctgagactctcctgtgcagcctcgtgggtcaccgtcagtcacacctacatgagcgtgggtcccnccgaggccgtaccggaggggaacggggccgtaggacggtgcggttcttcttttagttatagtacgtggtatacctatacctcgctagacctcgtgggacgggccgtattccaaccgactctccaaagtacaactaacttccaaaagaccctagtccttagtttaccctaaanaaactgaaactcgtaccgtaggacgacgtaccgaatccggaaccgtacgggtccttagttaacgttcgnggacggacggaaggacggacggtaccggggtaccccaaggttaaccgttacacgtaacgttaacggtcgggaacgtcggaaccggggtacccgaacgggcccg

SEQ ID NO: 382358 - DNA, 712 bp, Homo sapiens
  misc_feature: GZ8MTXP02JBIRU.13.76.G10.1.454.CMB.2.raw
  modified_base (250)..(250): a, c, t, g, unknown or other
  modified_base (294)..(294): a, c, t, g, unknown or other
  modified_base (375)..(375): a, c, t, g, unknown or other
  modified_base (396)..(396): a, c, t, g, unknown or other
tcagtcacgtactacacgaccggtgctcgatttagtcactcatacaggggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcngcctctgggtcaccgtcagtcacacctacatgagctgggtcccncaggctccgaggggagggctggagtgcgtctttcttttatttatagtagtggtagtaccatacctcgacagaccttccggnggacggggccattccgacctntcctcccaagacaacctaacttaccgaaaagtaaccacgtctttagtttacccttaacgaaaattcggaaaaccacggtcctagggacgaaacggtcccgaagttaccgaaccggtaccggggtccgtttaagtttaacccgttaacgttgggtacggaaccggaaggtacggtaacggggttacccggggggaacccccttaaacggttaaaaccccggggttttactaaacccggtaaccgtttaacggtaccgggggtaaccggtttaccgggggtaccgggggaacccctaaaacgggggggttaacccccg

SEQ ID NO: 382359 - DNA, 569 bp, Homo sapiens
  misc_feature: GZ8MTXP02FXC7P.13.76.G10.1.454.CMB.2.raw
  modified_base (304)..(304): a, c, t, g, unknown or other
  modified_base (386)..(386): a, c, t, g, unknown or other
  modified_base (403)..(403): a, c, t, g, unknown or other
  modified_base (406)..(406): a, c, t, g, unknown or other
  modified_base (462)..(462): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtcgtggaggaggcttgatccgagccgtgggggtccctgagactctcctgtgcagcctcgtgggttcacccgtcagtccacacctacatgagcgtcgggtccnccaggcctccgaggggaacgggctgggagtgcgttctttcttttattagtagtagtggtatactatactcgacacgctccgngacgggggccattcacntcnccagacgaacactaccaagaccagtctgtttactacaaatagacagtcctgaacgngaccgatcgacgcgccgtagtatacgtacgtgacggagagtacggtcgggacccgaacgtaacgttaaccgtacgtacgtacgtcgggacgtcggtacgggaaccgg

SEQ ID NO: 382360 - DNA, 655 bp, Homo sapiens
  misc_feature: GZ8MTXP02I1L9F.13.76.G10.1.454.CMB.2.raw
  modified_base (545)..(545): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtgggtcccgccaggcctccgaggggaggggctggagtgcgtcttctttatttatagtgtggttatactactacctccgacacgtaccgtccggtgggacggggtcccgtacttccacccgtatcctccaagtacgaacctaaacgttacccgaaagtaacccacggtcctttagtttaccttaagaaaacgttcgaaaactacgtcctaggacgacgcccgaagtccgaaacgtccggtaccgttagtactttacgnggtacgacggaggactaggggtcccgggaccctaacggtaaaccgtttcgtaaccggtcgtaacggtcggggtaaccggttccggacgggggacccgaacggggtacccg

SEQ ID NO: 382361 - DNA, 711 bp, Homo sapiens
  misc_feature: GZ8MTXP02JFMWP.13.76.G10.1.454.CMB.2.raw
  modified_base (267)..(267): a, c, t, g, unknown or other
tcagtcacgtactacacgaccggtgctcgatttagtcactcatacagggggggagaggagcccagcactgggattccgaggtatttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtggtcaccgtnagtcacacctacatgacgcgtcgggtccgccgaggcctaccggaggggaacggggctggggagtcggtcgttcctttactttttagtttagtagttaggttggttaacgtaccctattaccgtacccgacacggtaccgttccggttggggacgggggtccctaagtttcccgaacctacgttaccctacccgaaagacgtaaaccctaaatttaccccgaaaagaaccgtaccgtctttacggttttacctacaaaacgttcgaaaccacggtccctaggaacgtacgccgtaatcggaaccgtacggtccgttaggttaacttcgtaggtcgacgtaggacggtaacggtccgggggaccccaacgggttaaaccgttaccgtaacggtctacggtacgggtacggttaccggtacgggggtacccaaacgggggtaccccg

SEQ ID NO: 382362 - DNA, 715 bp, Homo sapiens
  misc_feature: GZ8MTXP02HH2NH.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaggtgcccagtgtgaggtgcagcgtggtggagtcgtggaggaggcttgatccagccgtgggggtccctgagactctcctgtgcagcctcgtcgggtccaccgtcagtcacacctacatgacgcgtcggcccgccgaggccgtaccgggaggggaacggggcgtaggagtcgtcgtttcgtttactttttagttagtagtaggtggtaacgtacctactaccgtccgacacgtaccgtcgggtgggtacgggggtcctaacttacccaaccgtactccgtacccgaagaacgtaaacctaaacttaccgaaaacgtaaccgaccgttactttcgtttttaacaactaaaagttacggaaaacctcgtacccgtaggaacggacgacccgaagtaccggaaccgaaccggggtccgttaggttaacctacgtggtacgaccggtaggacgtaccggtaccgggggaacccctaaacggtaacccgtttacgaaccgtaacgttacggacgggaccgttacgggccggggtaaaccggaacggaaccccgg

SEQ ID NO: 382363 - DNA, 800 bp, Homo sapiens
  misc_feature: GZ8MTXP02IAW8K.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtccctgagactctcctgtgcagcctcgtcggttcaccgtcagtcaccacctacatgacgcgtcgggtcccgccgaggcctccggaggggaacggggcgtgggacgtggtcgtttctttctttttatttatagttaggtaggtagtaccatacctccgactacgtaccgttccggtggggacgggggtacctacgttaccaccctactcctacccgaaggtaaacaaaccctaaacgttaacccaaaacggaaacccgtaaccgttacgttttacggtttaacccttaacgtaaaaacgttccgaaaaacgtcgtaccccgttaaggaaggtacccggaacccgtagttaccggaaaccggccgggttacccggttagtttaaacgttaccggtggtacggtacggaacgggtaaaacgggtcgggttcccgggggaaacccccgtaaacgggtaaaacccggtttttcccgaaaccggggtaaccgttaaaacgggttccgggggtaaaacccggttccgggggttacccgggggggaaacccttaaaacccggggggtaaacccccccgg

SEQ ID NO: 382364 - DNA, 609 bp, Homo sapiens
  misc_feature: GZ8MTXP02JQN9P.13.76.G10.1.454.CMB.2.raw
  modified_base (463)..(463): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtgggtccgccaggctccgaggggaaggggctggagtgcgtcttcttttattatagtagtggtagtacatactccgcagacgtcgtggacggggcctattccacctatcctccaagacgaactaaacgttacccaaaaggtaaccacggtcttgttttacctacaaaatcgaaacngacctaggagtacggaccgaagtcgaaccgacgggccgttaggtacttacgtgacgtacgaggacgtaacggtccgggggaccctaacgggtaacgttaccacgctaggtcgggtacgtcgtacgggggaccaacgggtaaccccg

SEQ ID NO: 382365 - DNA, 601 bp, Homo sapiens
  misc_feature: GZ8MTXP02FI2OK.13.76.G10.1.454.CMB.2.raw
  modified_base (252)..(252): a, c, t, g, unknown or other
  modified_base (391)..(391): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctggggttttccttgttgctattttaaaaggtgcccagtgtgaggtgcagctggtggagtctggaggaggcttgatccagccgtgggggtccctgagactctcctgtgcngcctctgggttcaccgtcagtcacacctacatgagctgggtccgccaggctccgaggggagggcgtggagtgcgtcttcttttattatagtagtgtagtacatactcgcagctcgtgaggggccgattcgacctatccncagacgacaattaccaaagaccacgtcttagtttaccctataaaatcgaaacacgacccgtagaacgacggacccgaagtcggaaccgtacgggccgttagtaacgtttaacgtcgggtgcgggaaaggtacgacgtacgggggacccccaacggtaaacgtttaaccgacggtactacgtaggtaaccggtcggtacgggggaacccgg

SEQ ID NO: 382366 - DNA, 671 bp, Homo sapiens
  misc_feature: GZ8MTXP02HNZLM.13.76.G10.1.454.CMB.2.raw
  modified_base (234)..(234): a, c, t, g, unknown or other
  modified_base (462)..(462): a, c, t, g, unknown or other
tcagtcacgtactacacgaccggtgctcgatttagtcactcatacagggggggagaggagcccagcactgggattccgaggtgtttccattcggtgatcagcactgaacacagaggactaaccatggagttttggctgagctgggttttccttgttgctattttaaaaggtgcccagtgtgaggtgcagctggtggagtctggaggaggcttgatccgagccgtgggggtcccngagactctcctgtcgcacgcctcgtgggttccaccgtcagtcacacctacatgagcgtcgggtcccgccgaggccgtccggaagggggacggggcgtgggaggtcgtcggttctttacgtttttattagttaggtagttggtagtactactacctccgcacgtacctccggtgggcgggggcctattccgacctactccgtccagacgaactaactacccaaagaccncgtacttcgtttactaacgaaatacgaaacagccgtaggaacgtacggacccgtaagtacggaaccgtaccggtccgttagttaacgttacgtggtcggaacggtaggaacggacggtccggggaaccctaaacggtaacccgttaacgtacgcgttaagcggggtacgtccgggtacggggacccgaaacggggtacccgtaacccgg

SEQ ID NO: 382367 - DNA, 589 bp, Homo sapiens
  misc_feature: GZ8MTXP02I30MM.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaggtgccagtgtgaggtgcagctggtggagtcgtggaggaggcttgatccagccgtgggggtcctgagactctcctgtgcagcctcgtggttcaccgtcagtcacacctacatgagctgggtccgccgaggctccgaggggaacgggctggagtgtcgtcttcgttttatttagtagtagtcggtagtacatactccgcagtcgtccgtaggcggggcctattacgacatccgccaagacgaactaatcccaaagtaccacgtcttagttctacaaatcgaactacgcctagacgagtacccgatacgacgacgggccttagtactacgttgacgagtaagacggacgtcgggggaacccaacggtaaaccgtttaacgaccgtacgtacgtacggggtacgtttcggacgggggaacccg

SEQ ID NO: 382368 - DNA, 670 bp, Homo sapiens
  misc_feature: GZ8MTXP02GL51N.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccgagccggtgggggtccctgacgactctcctgtgcagcctcgtcggtcaccgtcacgtccacacctacatgacgcgtcgggtccgccgacggcctcggaaggggacgggcgtggagtcgtcgtctttacttttatttagtagtagtggtatactacgtactccgcacgtccgtcggtgggacgggcctacgttaccacgactcctacgaagtacgaactacttacccgaaagaaccgtacgtctttacggtttaaccttaacgaaagtacgaaacctggtcccgtaggaacgcgtacccgtagtacgaccgacggttcgtaacttagtttacgcgtaggacggaagacggttaccgggtccggggtaaccctaaacggtaccgtttaacgaccgtaagttacgggtacggaccggtttacgggacccggggacgtttaaaccgggggaccccg

SEQ ID NO: 382369 - DNA, 783 bp, Homo sapiens
  misc_feature: GZ8MTXP02IFZN7.13.76.G10.1.454.CMB.2.raw
  modified_base (459)..(459): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctattttaaaaggtgcccagtgtgaggtgcagcgtggtggagtcgtgggaggaggcttgatccgagccggtcgggggtcctgagtactctcgtgtgcacgcctcgtcgggttcaccgtcagtcaccacctacatgagtcgtcgggtcccgccgacggccgtaccgggaaggggaacggggcgtagggaggtcggtcgtttcctttacgttttttaagttaagttaggttaggttggtaactacctaactaccgtccgacgacgtaccgtccggtgggggaccgggtctacttccaaccctntcctacccgaagtaacaacctaaactccgaaaacgtaaccgtcgtctttacttttaacaaacaaaagttacgaaaaccgtacgtacccgttaaggaaacggaccggaccggtaacgaccgggtaaacccggtacccgggttaccggtttaaggtttaaacttaccggtcggtaagggaacgggtaagggacggtacgggttaaaccgggggaacccccttaaacgggttaaaacccggttttacaaccgggttaacgttaacgggtaccggggtacccggtttaccggggaccgggggtaaccgtaaaaccgggggtcccccgg

SEQ ID NO: 382370 - DNA, 725 bp, Homo sapiens
  misc_feature: GZ8MTXP02ISO1U.13.76.G10.1.454.CMB.2.raw
  modified_base (419)..(419): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgtctattttaaaaggtgcccagtgtgaggtgcagcgtggtggagtcgtgggaggaggtcttgatccgacgtccggtcggggggtccctgagactctcctgtgcacgtcctcgtggttccaccgtcagtccacacctacatgacgcgtcggtcccgcgacggctccggaggggaacggggcgtaggagtcgtcgttctttacgttttatttataggttagtaggttaacgtacctacgtacctccgacacgtaccgttccggnggggtaccggggcctacttacccacctactcctacgagaactaacctaaacttccgaaaagacctacgttcttacgtttactaacaaatacgaaactcgaccgtaggaacgtaccggacgtaagtccggaaccggtacccggttaccggttagttaaacttaccgggtggtaacggtacgggtaacgggaacggggttacggtaccccgggggaaccctaaaaccgggttaaaccgttaaccgtacgtcgtaacggtaccgggtacggtaccggggtaccggggaacccggaaacggggtaccccg

SEQ ID NO: 382371 - DNA, 725 bp, Homo sapiens
  misc_feature: GZ8MTXP02FJ4E1.13.76.G10.1.454.CMB.2.raw
  modified_base (298)..(298): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggtcttgatccagccgtggggggtccctgagactctcctgtgcacgcctcgtggtcaccgtcagtcacacctacatgagcgtcgggtccncgaggctccggaggggaaggggctggagtgtcgttcttcttttattagtagtagtggtaagtacctactaccgtccgacacgtacctcggtgggacggggcctagttccacctactcctacccgaaagacgtaaccaaacttaccgaaaacggtaaaacctccgtacttttacggttttaccttaacgtaaaaagttacgaaaacccgtagtcccgtaagggaacgtaacggaccggaactaccggaaaccggaccgggttacccgttaggttaaccgttacggtgggtaccgaccgggaaggtacggtacgggtacccgggggaacccctaaaaccgggttaaacccgttacgtaaccggtaacgttaacggtaccggggtaacccggttcggtaccgggggaacccgaaacgggggtaacccccg

SEQ ID NO: 382372 - DNA, 626 bp, Homo sapiens
  misc_feature: GZ8MTXP02GDWND.13.76.G10.1.454.CMB.2.raw
  modified_base (432)..(432): a, c, t, g, unknown or other
  modified_base (506)..(506): a, c, t, g, unknown or other
tcagtcacgtactacacgaccggtgctcgatttagtcactcatacagggggggagaggagcccagcactgggattccgaggtatttccattcggtgatcagcactgaacacagaggactcaccatggagttttggctgagctgggttttccttattactattttaaaggtgtccagtgtgaggtgcagttggtggagtctggaggaggcttggtccaggcccgggggggtccctggagactctcatgtgcggcctctgggctcaccgtcaacacccaactacatgagctggggtcccgcaggcctccgaagggagacggccgggagtggggtctcgtagtttattatggtcgacggtgccacgattctaccgcagactccggtggacggggccggttccacctatcctccagacgacaattaccaagaaacncggtagtatcttacaaatgaaccgactagagagtacgaggacgacggccgtactagttaccgtgtgacgaaagntagacgaggacggaccgggacccccggtaaaggtcgggggtaccgtggggtacggggtacgggtttcgtttcggtttcgtacgttcggtcggtcgggggacccgtacgggggtaaccccg

SEQ ID NO: 382373 - DNA, 680 bp, Homo sapiens
  misc_feature: GZ8MTXP02H0NAN.13.76.G10.1.454.CMB.2.raw
  modified_base (239)..(239): a, c, t, g, unknown or other
tcagtcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagcccgcctcagtggttcggggccccagggcaggagggtcaccatcctcctgcacgtgggancacgctaccaacgtagttcggggacacgtattagtgatcgtacacgtggtaccagcgtacgtttaccgaggtagcgtacggtccccagtacctcctacaagtacaaagtaacgtaaacccaaactaacgtccggacccgacggtaccggggttcccctcgggtacccgtaacgtttcccgtcgttcgggtaccctaccggtacgggttccgtcggaccctaccctccgtaaccgccccttacccgttcgtcgtactccgtacgtcggccttaccgacggtcgtaggagtagtcggaaggtcttaggttatttacgttccgtcgccgtaacgttccttaagttaccggactacggaccgtacgtaccgtaggtacggttcggtcccgtttacggggtacggggttcccgggggacccgggggtaacccgtacggttacccgg

SEQ ID NO: 382374 - DNA, 629 bp, Homo sapiens
  misc_feature: GZ8MTXP02HPB50.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctctgtgcagcctgtcggttcaccgtcagtcaccacctacatgagcgtcggtccgaccgagggtcctaccggaaggggaacggggcgtagggagtggtcgttctttctttttaatttataggtaggtcggtagtactatacctcgaccaggccgtccggtggacgggccgtaattccaccacttcctccgaagacgaactaacttacccaaaagaaccctacgtctttacgtttacttaacaaattcgaaacacgtccgtaagacggacaccgatcggaacgccgggtaccgtagttactcgttggagcgagagtacggtccggggaccctaagggtaacctaacgttaacgcttaacgtcgggaccgtcggtaaggggaaccccg

SEQ ID NO: 382375 - DNA, 591 bp, Homo sapiens
  misc_feature: GZ8MTXP02FH20D.13.76.G10.1.454.CMB.2.raw
  modified_base (456)..(456): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggtttccttgttgctatttaaaaggtgccagtgtgaggtgcagctggtggagtctggaggaggcttgatccagccgtggggggtccctgagactctcctgtgcagcctcgtgggtcaccgtcagtcacacctacatgagcgtgggtcccgccgacggcctccggaggggaacggggctgggagtcggcgtcttcttttatttatagtagtaggtagtaccatacctcgcagactcggtggacggggctattccacctatcctccagacaacctaataccgaaagaacacgctttagtttacctacaaaagttnaaaacgcggctaggagacgccgaatccgaacgaccgggtcctagtatacgtggagacggagagacggtcggggacccaacggtaaacgttctacgcgtaagtcggacgttcggacggggacccaagggtaccccg

SEQ ID NO: 382376 - DNA, 630 bp, Homo sapiens
  misc_feature: GZ8MTXP02IKDIE.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctggtcaccgtcagtcacactacatgagcgtcgggtaccgccgaggcctccgaaggggaacggggctgggagtggcgttcttactttatttagtagtagtagtagtacatacctcgcacgctccgtaggacggggcctagttcacctagtcctccgaaggacgaactaaacgttacccaaaggaaaccacgtcttacgtttacctaacaaaagttcgaaaccagtacccgtgaacgacgcccgaaagtcgaacgaccgggtaccttagtaacgttacgtgtaggtccgaagtaaggacgttccgggggaaacccttaacggtaaacgtttaacgaaccggcttaggtaccggtaccgtacggtacggggaacccg

SEQ ID NO: 382377 - DNA, 605 bp, Homo sapiens
  misc_feature: GZ8MTXP02GRR6W.13.76.G10.1.454.CMB.2.raw
  modified_base (295)..(295): a, c, t, g, unknown or other
  modified_base (303)..(303): a, c, t, g, unknown or other
  modified_base (516)..(516): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtgggtccnccaggccnccgaggggagggctaggagtgcgttcttctttttatttagtagtagtggttagtaccatacgtccgacacgtacctccggtggacggggcctacttccgacctatcctccaagacgaaactataccaagaaccagtcttgtttactacaatgaacagcctgagacgaccgatcgaacgtccgggacgttggtaacttcgtggtcggacgaggnggtacggcggggaccctacgggtaaacccgttaccgtacgaacgttacggtacggaccgtcggtacggggccgaaaacggggtacccgg

SEQ ID NO: 382378 - DNA, 587 bp, Homo sapiens
  misc_feature: GZ8MTXP02HETRX.13.76.G10.1.454.CMB.2.raw
  modified_base (287)..(287): a, c, t, g, unknown or other
  modified_base (334)..(334): a, c, t, g, unknown or other
  modified_base (346)..(346): a, c, t, g, unknown or other
  modified_base (368)..(368): a, c, t, g, unknown or other
  modified_base (375)..(375): a, c, t, g, unknown or other
  modified_base (383)..(383): a, c, t, g, unknown or other
  modified_base (410)..(410): a, c, t, g, unknown or other
  modified_base (422)..(422): a, c, t, g, unknown or other
  modified_base (431)..(431): a, c, t, g, unknown or other
  modified_base (437)..(437): a, c, t, g, unknown or other
  modified_base (487)..(487): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgccagtgtgaggtgcagcgtggtggagtcgtgggaggaggcttgatccgaggtccgtgggggtccctgagtctctcctgtcgcagtcctgtcggtcaccgtcacgtcacacctanagtgacgcgtcgggccaccgtggcctaccggaggggacggcgtaggngtcgtctctttntttattatagtgtgtagactanacgtcgntagctcgnggacgggctatcacgtactcacgaganactatacagacnctgtcttanacaatnaaactcaccgtgagcacgtagagaccgacggtacgtacgttatttacggngtaggtacgacggtacggtacggtaccgggaacctaacgtaaccgttacgtacgtaacgtacggtcggtacggtacgggaccgggaaccggaacggcccg

SEQ ID NO: 382379 - DNA, 564 bp, Homo sapiens
  misc_feature: GZ8MTXP02I7QLX.13.76.G10.1.454.CMB.2.raw
  modified_base (469)..(469): a, c, t, g, unknown or other
  modified_base (486)..(486): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtagggtccgccgacggctccgaaggggaaggggctggagtggcgttctcgtttttatttatagtagtggtagtaccatactccgcagacttccgtgacggggccgattcaccatctccagagacaatccaaagaaccagctgtttactacaaatgaaacagcctaggagagccgatgaacnccggcgttgtatttagngtgacgagagacgcgggacccaacgtaacgttacgacgtcgtaagtacggtacgtcggacgggaccgaaacggtaccg

SEQ ID NO: 382380 - DNA, 719 bp, Homo sapiens
  misc_feature: GZ8MTXP02FXF57.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtcggttcaccgtcagtcacacctacatgagcgtcggtccgccgaggcctccgaggggaaggggcgtggagtgcgtctttcttttattagtagtagtgtagtactatactccgcagcgtccgtggacggggccatcgaccactcctccgaagacgaacaacttacccaaagaaccacgtccttagtttacctacgtaaaaattcgaaaacctacggtacccctaggaaacggaccggtaccccgtaatacccgggtaaacccgtacccggggtacccgtttaaggtttaacgtttaacccggttggttccgggacccggtaaaggggtaaacgggtaaccgggttacccgggggaacccccgtaaacgggtttaaaacccccggtttaaccgttaacccgggtaccttaacgggttacggggtaccccgggtttaccgggaccgggggtaaaacccccgggg

SEQ ID NO: 382381 - DNA, 700 bp, Homo sapiens
  misc_feature: GZ8MTXP02JKHGX.13.76.G10.1.454.CMB.2.raw
  modified_base (264)..(264): a, c, t, g, unknown or other
  modified_base (371)..(371): a, c, t, g, unknown or other
  modified_base (459)..(459): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtcgtggagggaggcttgatccagccgtgggggtcctgagctctcctgtgcagcctgtggtcaccgtnagtcacacctacatgagcgtcgggccgccgaggcctccggaggggaggggcgtgggagtcggcgttcttctttttatttagtagtaggtggtagtacataccgtccncagaccgtcgggtgggacgggggtccgtattcccgacctattccctccgaaacgaagtaacctaaacgttacccaaaggtaaaacccnccggttcctttacgtttttaaccctaacgaaaagttcgaaaaccgacggtacccttagggaacggaccggaccccggtaaagttacgaaaccccggtaccggggtacccgttagggtttactttaccgtggtacggaacggtagggaaggtaccggtccgggggtacccctaaacggtaaccgttactacggaacgttacgcgggtacggttccgaacgggggaccgaaacggggtccccg

SEQ ID NO: 382382 - DNA, 608 bp, Homo sapiens
  misc_feature: GZ8MTXP02H7EKM.13.76.G10.1.454.CMB.2.raw
  modified_base (256)..(256): a, c, t, g, unknown or other
  modified_base (270)..(270): a, c, t, g, unknown or other
  modified_base (453)..(453): a, c, t, g, unknown or other
  modified_base (462)..(462): a, c, t, g, unknown or other
  modified_base (505)..(505): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtcgtgggaggaggcttgactccagccgtgggggtccctgagactctctgtgcagcctntcgggttcaccgtnagtcacactacatgacgcgtcggtccgccgaggcctccggagggaggcgtggagtgtcgttcttcttttatatagtagtaggtataccgataccgtcgacacgaccgttccggtgggacggggtcctacgttccacctacgtctaccagtacaactactaccaaagacacgtcttagttccanaatgaaacngtaccgtgacgacgcgaagtcgaacgcggtcgtagttaactgnggtacgacgtaggaacgtcggtaccggggaccctaacggaccgtttacgacgtaacgttaggacggtaaccggttggccggggtaaccgaacggggtaccccg

SEQ ID NO: 382383 - DNA, 661 bp, Homo sapiens
  misc_feature: GZ8MTXP02F1R00.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtggggggtccctgagactctcctgtgcagctcgtggtcaccgtcagtcacacctacatgagcgtcgggtccgccgaggcctccggaggggaacggggcgtagggaggtcgtccgtttcctttactttttagtttagtagtaggttaggtagtacctattaccgccgacacgtaccgtcccggtggggacggggccgtaacgttcccaacctacgtcctacccgtaaggaaacaaccctaaacttaacccgaaaagaaacccgtaacgtcctttacgttttacccttaacaaaagttcgaaaccacgtccgtagaggacgccgaatcgacgacggcgtagtacttagtgtgacgagagacgtaccggggaccaacgtaaccgttacgacgtaacgttacgcggtacggttcggtacggggaacccgtaagggtaccccg

SEQ ID NO: 382384 - DNA, 682 bp, Homo sapiens
  misc_feature: GZ8MTXP02HFS4B.13.76.G10.1.454.CMB.2.raw
  modified_base (481)..(481): a, c, t, g, unknown or other
  modified_base (491)..(491): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtctggaggaggcttgatccaggccgtggggggtcctgagactctcctgtgcagcctcgtggttcaccgtcagtcacacctacatgagctcgggtccgccgacggccgtaccggaaggggaacggggctggggaggtcgtccgtttctttacgtttttatttaagtaggttaggttaggtagtactacgtaaccgtccgacacggtaccgtccggtgggacgggggaccgtacttccgacctatcccgtaccaaggaacactaaacgttacccaaagaacccncgtccgtttntttacctaactaaaagttccgaaaacgcgtaccctagggagaccgaccgagtcggaaccgtacgggtccgttaagttacttaccggttaggcgacggaggtaaggacggtacccgggggaaccctacgggtaaaacccgttcgaacgtacgttaacgggtcgggaccgttcggggacggggaaaccccggg

SEQ ID NO: 382385 - DNA, 693 bp, Homo sapiens
  misc_feature: GZ8MTXP02I1BE4.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgactccgaggtcccggtggggggtccctggacgtactctccgtgtgcagcctcgtcggtcaccgtcagtccacacctacatgagtcgtcgggtcccgccgaggcctaccggaaggggacggggtcgtgggagtcgtccgttctttctttttaatttagtagttaggtggtatacctataccgtcgacagtccgtcggtgggaccgggggtctacgttccacgtactccgtaccgaagaacgtaacctaaacttacccgaaagtaaacctacggttcttacgttttctaacaaatcgaaaactcgtaccgtaggaagacgaccgaagtaccggaacgtacccggtaccggttagttaagttaccgtagtaccggtaaggacggaacggtcgggtaccgggggaaccctaacgggtaaaacttaccgtaacgtaacgttacgtacgggtaccgtcgggaccggggacgaaaccgggtacccg

SEQ ID NO: 382386 - DNA, 694 bp, Homo sapiens
  misc_feature: GZ8MTXP02HX8B6.13.76.G10.1.454.CMB.2.raw
  modified_base (298)..(298): a, c, t, g, unknown or other
  modified_base (366)..(366): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtcgggttcaccgtcacgtcaccactacatgagcgtcggtccncgaggacctaccggagggaagggcgtggagtcggtcgttcttatttttaattagtagttagtggttanacctactaccgtcgacacgtaccgtcggtggacggggactacttccacctacgtacctccgaagacgaaactaactaccgaaaggaaccctacggtctttacgtttacctaactaaagttacgaaacgtacgaccgttaggaacggaccggacccggtagtaccgaaccggtaacccgggtccggttaagggttaaacttccggttttaggaccggttacggagggttaaggtaccggtaccgggggaaccctaacggtaaccgttaacgtacgtaaccgttaggtacggtacggttacggacggggaaccggtaacgggaaccccgg

SEQ ID NO: 382387 - DNA, 678 bp, Homo sapiens
  misc_feature: GZ8MTXP02H46XF.13.76.G10.1.454.CMB.2.raw
  modified_base (540)..(540): a, c, t, g, unknown or other
  modified_base (570)..(570): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggtcttgatccacggccggtcggggggtccctgagacctctcctggtgcagtcccttcgtcgggttccaccgtcagtccacacctacatgagcgtcgggtccgccgaggccgtaccggaggggaaggggcgtgggagtcggtcgttcttactttttattagtagttagtaggtacgtaccactacctccgacgtacgtaccgtccggtggggacggggctacttaccacctacgtcctacccgaagaacgtaaactaactacccaaaagacccgtacgtcttacgtttacctaacaaagttacgaaacctagtccctaggaagaccgaccgntaacgaccgacgggtccttagttactttancggttgacggagtacggacgtcccggggtacccaaaacgtaaccgtttacaccgttaacgtaacgtcggggtaccggtgtaccgggggaccgtaaaacggggtccccg

SEQ ID NO: 382388 - DNA, 708 bp, Homo sapiens
  misc_feature: GZ8MTXP02GZTO0.13.76.G10.1.454.CMB.2.raw
  modified_base (255)..(255): a, c, t, g, unknown or other
  modified_base (509)..(509): a, c, t, g, unknown or other
  modified_base (523)..(523): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctattttaaaaggtgcccagtgtgaggtgcagcgtggtggagtcgtgggaggaggcttgatccagccggtcgggggtccctgagactctcctgtgcncgcctcgtcggtcaccgtcagtcacacctacatgacgcgtcgggtccgccgaggcctaccggaggggaggggcgtgggagtcggtccgttcgttttacttttatttagtaaggttaggtaggttacgtacctactaccgtccgacgacggtccgtaccgggtggggacggggtccgtaacttccgaacctactcctaccgaaagacaaacctaaacttcccgaaaagaaccctcgtctttagttttacccaaanaaaagtcgaaaacncggtacctaggaagcggaccaaagtccggaaccgcgggggtacttagttaacttcgtggacgacggaagggtacgaccgggtaccgggggacccctaaaacgggtaaacctttaccgtacgtaacgttaaggttaccggggaaccggtttcgggaccgggggaacccggtaaaacgggtcccccg

SEQ ID NO: 382389 - DNA, 656 bp, Homo sapiens
  misc_feature: GZ8MTXP02H0Q05.13.76.G10.1.454.CMB.2.raw
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagcccaccctcagtgtcccgtgtccccaggacagacagccagcatcacctgctctagaaataatggacagaataaatatacttctgtatcagcagaagtcaggccacgtcccctgtcgcgtgtcatctatacaagatgaccgaagccggtccctaggacggtacctcccgtgacgtcgtacttccgtcgtcggccttaacctaaccttccgtaacggggtacctacgaccgaccctactcctacgaaccctacgtaccgaaccgggcccgggaacccgacgggtaccgttaggtacgggtaaacgtgggtaacggtcgttaacggtaacctttacgtttaacgttcggttacggaacggggtccgggttaggggaacacggacgtacgaccgcgtccggtaccccgtgttaacgttccggtacgtttaccggacggttaacgggaacccgtaacggttcccaacccgtttaccgtaacgtaccgaaaccccgg

SEQ ID NO: 382390 - DNA, 662 bp, Homo sapiens
  misc_feature: GZ8MTXP02JTIL1.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtgggttcaccgtcagtcacacctacatgagcgtcgggtccgccgaggcctccggaggggaggggctggagtcgcggttcttcttttatttagtagtagtggtataccgatactccgcagacgtcgtgggacggggcgtacttccgaccactcctaccgaagacgtaaacctaacgttacccaaaggaaccaaccgtccttacggtttaccccctttaaaagaaacgtacgaaaccgtcgtaccgtaggaacgacggaccgagtaccggaaccggtaccgggtacgttagttaacgttacgtggtacggacggaaggacggacgggtacccgggaacccgtaacggttaaaccgttacgacgtcgtaggtaccggacggtcgggacggggacccggaacgggtcccg

SEQ ID NO: 382391 - DNA, 655 bp, Homo sapiens
  misc_feature: GZ8MTXP02JROVE.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccaggccgtggggggtccctggagactctcctgtgcagcctctgggttcaccgtcagtcacacctacatgagcgtggtccgccaggcctcgaggggaagggcgtggagtgcgttcttcttttatttatagttagtggtagtactatactcgacagccgtccggtggacgggggccgtaattcacctactcctaccgaagacgaacctaaattacccaaaggaacctacggtctttagttttacccttaacgaaaattcgaaaactacggtccctagggaacgacgacccgtagtacgggaacccgtacgggtcccgtttagttaaacgtttacgtgggtacggacggaaaggagggtacggtaccgggggacccctaaacggtaacccgttaacgtaccgtacgtaaggtccgggaccgtcgggtacggggaacccgg

SEQ ID NO: 382392 - DNA, 733 bp, Homo sapiens
  misc_feature: GZ8MTXP02IF77D.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttaattttaaaaggtgcccagtgtgaggtgcagcgtggtggagtcgtgggagggaggtcttgactccgaggccggtcggggggtccctgacgtactctccgtgtgcacgtcctcgttcggtccaccgtcacgtccacctacctacatcgagccgtcgggtccgaccgacggccgtaccgggaaggggaacggggcgtgggagtcgtcgtttctttactttttaattagtagttaggtaggtacgtaccactaccgtcgacgacgtacgtcggtgggacggggtcctactccaacctactcctaccgaagtacgaaacctaacttaaccgaaagaacctacgtactttacgtttacctaacgaaaacgttacgaaaacctcgtaccgtaggaaacgtacgtaccggaatccgggaaccggtaccgggtacgtttaagttaacttacgggtgtaacggtcgaaaggtacgggaacgtaccgggggaacccctaaacgttaaaccggttaactaccggaacgttacggtaccgggtaccggttcgggacccggggtaaccgaaacggggtaccccgg

SEQ ID NO: 382393 - DNA, 670 bp, Homo sapiens
  misc_feature: GZ8MTXP02HEBZ5.13.76.G10.1.454.CMB.2.raw
  modified_base (170)..(170): a, c, t, g, unknown or other
  modified_base (371)..(371): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctacgtaggtaaataaattggacagtaattaaatacttaccttccgtaggtactcaagtacaaggaagtcgacggccacgttcccctgtcgctggtctatctatacaagactcgaccaacggccggccctagacgggtactcccccgagacgtcgtacttcncgttcggcctaccgaacgttcgtacgggactcgacgtccctactcgtacaaccgtactacccggaaccgggacccggaccccgtaggtacccgttaaagggtcggggaacgttagggaccgggttacgttaacggttaaccgtttaagtaccggttacgtcggaacggggttcggtacgggacgtacggcgaacgtccgtacgccggtaccgtcgttaacgtcggttaccgttaccggacggtaccgggtaaccgtaacggtccctaaccggttacgtaaccgccgtaaccgaaccccg

SEQ ID NO: 382394 - DNA, 713 bp, Homo sapiens
  misc_feature: GZ8MTXP02JIXJB.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatcagccgtggggtcctgagactctcctgtgcagcctcgtggtcaccgtcacgtcacacctacatgagcgtcgggtccgccgaggcctaccggaaggggaacggggcgtagggaggtcggtccgttcttcgtttttaatttagtaaggttaggtaggttagttaaccgactaccgtccgactaacgtaccgttccggtcggggacggggtcccgtaacttaccgacctactcctaccaaaggtacaaactaaacttaccgaaaagtaaaccacgtccttacgttttacctaacaaaagttcgaaaaaccgtcggacccgtaggaacgaacggaccccgtaaagtaccggaaccgaacccgggtccggttaagttaacgtttacgtggtacggaccggaagaagggacggtaccgggggacccctaaacggtaaaaccgtttcgaacgtccgtaaggtacggtaccggttcggacggggaaccccgaaagggaaccccg

SEQ ID NO: 382395 - DNA, 586 bp, Homo sapiens
  misc_feature: GZ8MTXP02FMGVN.13.76.G10.1.454.CMB.2.raw
  modified_base (300)..(300): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggaggaggcttgatccaggccgtgggggtccctgagactctcctgtgcagcctcgtgggttcaccgtcagtcacactacatgacgctcgggtccnccgaggcctaccggaggggaagggctggagtgcgtctttcttttattatagttagtgtagtacatacctcgacagtccgtccgtaggacggggtcctaattcgacctatcctaccgaagtacaactaattaccaaagaccacgtcttagttactacaaaatgaaacagccgtagacggacaccgatcgacgaccggtcgtagttatacgtgcgagacgagacggtccggacccaacgtaaacgttcgacgtacgtagtacgggaccgtcgggtacgggaaacccgg

SEQ ID NO: 382396 - DNA, 636 bp, Homo sapiens
  misc_feature: GZ8MTXP02GXF45.13.76.G10.1.454.CMB.2.raw
  modified_base (255)..(255): a, c, t, g, unknown or other
  modified_base (407)..(407): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagcttgggttttccttgttgcttattttaaaaggtgcccagtgtgaggtgcagctggtggagtctgggaggaggcttgatccagccgtgggggtccctgagactctcctgtgcngcctcgtggtcaccgtcagtcacacctacatgagcgtcggtccgccgacggccgtaccggaggggaagggcgtagggagtgcgttcttcttttaattagtagttagtggtatactatactcgacagcgtcgtggacggggcctagtccaacntcctacgaagacgaacaagttaaccaaagaaccgacgtcttagttactaacaaatacgaaacacgaccgtagaacgacggacctaagacggaccgtaacggtccgttaaggtaacttaacgttcggaccgtacggaaacggtaagacgggttaccgggaaccccgtaacgttaaaccggtaaccgtacgtaacctaggtacggtaaccgtcggtacggggaaaccccgg

SEQ ID NO: 382397 - DNA, 651 bp, Homo sapiens
  misc_feature: GZ8MTXP02IK7HI.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtccctgagactctcctgtgcagcctcgtcgggttcaccgtcagtcacacctacatgagcgtgggtcccgccgaggcctccgaggggagggcgtggagtgcgttcttcttttatttagtagtgtggttagtaccatacctccgcagacctcgtgggacgggccctattccacctagtcctacgaacgacgactaaaccttaccgaaaagaaaccgacgtccgttacgtttttaccttaaaccgaaaattcgaaaaccgacgtacccgttaggacgacggccgtaagtccgaacgaccgggtccttaggttatacgtgcgacgaggacggacggtaccgggggaccctaaccggttaaacgtacgtaacggccgtaaggttacggtaccgtccgggtaggggaaccccgaacggggtaaccccg

SEQ ID NO: 382398 - DNA, 704 bp, Homo sapiens
  misc_feature: GZ8MTXP02F6CK0.13.76.G10.1.454.CMB.2.raw
  modified_base (251)..(251): a, c, t, g, unknown or other
  modified_base (478)..(478): a, c, t, g, unknown or other
  modified_base (660)..(660): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtcctgagactctcctgtgcngcctcgtggtcaccgtcagtcacacctacatgacgcgtcgggtccgccacggctccggaggggaacggggcgtggggagtcgggtcgttctttcgtttttattagtagttacggtaggtagtactatactccgacacgtcgtccggtggacgggggcctattaccgacctacttcccgtaccaaagaacgtaacctaaacgttaacccgaaaacgaaactaccggtntttacgtttaccttaacgaaaatcggtaaacctacgggtccctaagggaaacgtaccggacccgtaagtaccggaacccgaaccgggtcccggttaaggtttaacttacggtggtacgacggaaaggtacggtaacggttcccgggggaaccctaacggtaaaacgttaaccgttaaccggngttaaacggtcgggtaaccggtacgggtacgggggaaaacccgg

SEQ ID NO: 382399 - DNA, 569 bp, Homo sapiens
  misc_feature: GZ8MTXP02I1R9W.13.76.G10.1.454.CMB.2.raw
  modified_base (246)..(246): a, c, t, g, unknown or other
  modified_base (421)..(421): a, c, t, g, unknown or other
  modified_base (502)..(502): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaagctgcccagtgtgaggtgcagctggtggagtctggaggaggcttgatccagccgtgggggtccctgagctctcctgtncagcctctgggttcaccgtcagtcacacctacatgagctgggtcccgcaggctccgaggggaagggctggagtgcgttcttctttttattatagtagtgtagtacatactccgcacgcctcggtggacgggccgtattccgaccatctccagacgacaatacccgaaagaaaccncgctttgtttactacgaaatcgaaactacggctagagacgacccgatcgaaacgtccggacgttgttaactacgtgtacgngtagagagtcggggcccaaacgtacgtactaacgctacgtacggacgtacggacgggaccgaaacgg

SEQ ID NO: 382400 - DNA, 790 bp, Homo sapiens
  misc_feature: GZ8MTXP02IWBYZ.13.76.G10.1.454.CMB.2.raw
  modified_base (303)..(303): a, c, t, g, unknown or other
tcagtcacgtactaccacgaccggtgctcgatttagtcactcatacagggggggagaggagcccagcactgggattccgaggtgtttccattcggtgatcagcactgaacacagaggactcaccatggagttttggctgagctgggtttccttgttgctattttaaaggtgcccagtgtgaggtgcagcgtggtggagtcgtgggaggaggtcttgactccgagccggtcgggggtccctggacgacctccctcgtgtcgcgcgtccgtcgttcggttccaccgtctcgtaccacctacctangtagacgtccgtcggtcccgacgcggccgtaccgggaaggggacggtcggtaggtacggtcggtcgtttccgttttatttttaattacgttaaggttaggttaggtaactacctactaccgtccgtacgacgtaccggtcggtgggggtacgggtccgtacgtacctaccgtctacctccgaaaggtactaactaactaacccgaaagtaccgtacttcttttagtttaacctaaacgaaagttacgaacgtacgttccggaaggacggacgtaccgaccgttacgaaccggtaccgtcgtttaaatacgtttacgacgggtcgaaaaggtcggaaaacgggttccggggtaaccccggggtaacccttaaacggggtttaaaaaccccttccgggtaaacgtttaacgggtacggggttttacccggggacccgggtttaccgggggaacccggggtaaccggtaaaacccgggggttacccccgg

SEQ ID NO: 382401 - DNA, 773 bp, Homo sapiens
  misc_feature: GZ8MTXP02IHS03.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagcgtggtggagtcgtgggaggaggcttgatccgaggccgtgggggtccctgacgactctctgtgcacgcctcgtcggtcaccgtcagtccacacctacatacgagtcggtcgggtccgaccgacggcctaccgggaagggggaacggggtcgtagggaaggtcggtccgtttcgttttacttttttaaagtttaagttaaggtttagggtaacgggttaacggttaaccctacttaaccgtcccggacgtaacgtaacccggttccgggtacggggtaaccgggggtacccgtaacttacccgaaccccgttataccccttacccgaaaagaacggtaaaacccgtaaactttaacccccgaaaaaggtaaccctaaacgggttaccttttacggtttaacttaaaccgtaaaagttaccgaaacgtaccgtaccgtagaacgacgaccgaagtcgacgaccggtacgttagtacttagtcgtagacgaaggtacggacgtccggggaaccctaacggtaaacgttaccgtacgtcgttaacggacggggtacggtaccggacggggaaccgtaacgggaccccgg

SEQ ID NO: 382402 - DNA, 719 bp, Homo sapiens
  misc_feature: GZ8MTXP02H3MVG.13.76.G10.1.454.CMB.2.raw
  modified_base (256)..(256): a, c, t, g, unknown or other
  modified_base (261)..(261): a, c, t, g, unknown or other
  modified_base (271)..(271): a, c, t, g, unknown or other
  modified_base (281)..(281): a, c, t, g, unknown or other
  modified_base (327)..(327): a, c, t, g, unknown or other
  modified_base (621)..(621): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagcttgggttttccttgttgctattttaaaaggtgcccagtgtgaggtgcagcgtggtggagtcgtgggaggaggcttgatccgagccgtgggggtccctgagactctctgtgcngcctntgatcacgtnatcacaccanagtgacgtcgtgggtcccgcgaggccgtaccggaggggaacggggngtagggagtcggtcgttctttcgtttttaagttagttaaggttacggtaggttaacgttaactaacgtacctcccgtacgacggtaccgttccgggtgggaacggggtccctacgttaccaccctacttccacccgagtaacgaaacctaactttaaacccgaaacggtaactaccggttacctttacggtttaccttaaacctaaaagtaccgtaaaacgtaccggtacccaagggacgaacgacccgtaagtaccgaccggtaacccggtacgttagtaaacttcgttaggnggaccggagaacggtacgggtaccggtaacccctaacggtaaaaccgtttaccgtaacgtacgtaacggtccgggtaaccgtttcgggaacccggggg

SEQ ID NO: 382403 - DNA, 850 bp, Homo sapiens
  misc_feature: GZ8MTXP02JZ8TN.13.76.G10.1.454.CMB.2.raw
  modified_base (256)..(256): a, c, t, g, unknown or other
  modified_base (290)..(290): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgcttaattttaaaaggtgcccagtgtgaggtgcagctggtggagtcgtgggaggaggcttgatccgaggccgtgggggtccctggacgactctctgtncacgcctcgtcggttcaccgtcacgtcacacctnatgacgtcgtcggtccgcgcggctaccggaggggacgggtcgtggaggtcgtcgttcttactttttattagtaggttacggttaggtacgtactactaccgtccgacgtaacgtccgtaccgggtaggggtaccgggtaccgtaacttacccgtaaccctattcccgtaacccgaaaggtaaccgtaaactaaacccgttaacccgaaaacgtaaaccccgtacggtttacctttacggtttttaaccaaaccgttaaaaacgtaccggaaacccgtaacggtacccgttaagggaaaccgggtaacggacccgtaaacggtttaccggaaaaccgggttcccgggttacccggttttaagtaacccggttttaaccggttgggtaacgggtacccggggtaaagggtaaaccgggttaccggggttaccccgggggtaaaacccccgtaaaacccggggtttaaaacccggtttaaccggtaaccggttacggttaaaacggggtttcccgggggtaaaccggtttccccgggggtaaacggggtaaaacccccggggg

SEQ ID NO: 382404 - DNA, 626 bp, Homo sapiens
  misc_feature: GZ8MTXP02GHXG6.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctatttaaaaggtgcccagtgtgaggtgcagctggtggagtctggaggaggcttgatccagccgtgggggtccctgagactctcctgtgcagcctcgtgggttcaccgtcagtcacacctacatgagctgggtcccgcaggctccgaggggaagggctggatgcgtcttcttttattatagtagtgtagtacatactcgacagacctcgtggaggggccgtattaccaccatcctccgaagcaaacaattccccaaaaggaacccaccggttcttagtttacctaacaaatacgaaactcgtctaggacgacgaccgatcggaaccgtaccggtcgttagttacttcgtaggtcgaacggtaggaacgggtacggtaccggggaacccctaaacggttaaacccgttaaccgtaaccggtacgttaaacggttacgggaccggttaccgggtacgggggaaccccg

SEQ ID NO: 382405 - DNA, 682 bp, Homo sapiens
  misc_feature: GZ8MTXP02HT6PG.13.76.G10.1.454.CMB.2.raw
  modified_base (301)..(301): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtggtccaccgtcacgtcacacctacatgacgcgtcgggtcccnccgacggcctccggaagggggaaggggtccgtggggacgtcggtcgtttactttactttttaagtttaagtaggttaggttcgggtaagtaacgacttaaccgttccgacacgtaccgtccgggttagggacgggggtccacgttcccaaacctactcctaccgaagacgtaaacctaacttacccgaaaagacctacgtctttacgtttactacaaaattcgaaactacgtcctaggacgacgtaccgagtacgaccgtacggccgttagttaacttagttggacgacggaacgagacgggtaccgggaccccaaacggttaaaccgttaaccgtacgtacgtaacggtccggtaccggtcggtacggggaaaccccggg

SEQ ID NO: 382406 - DNA, 563 bp, Homo sapiens
  misc_feature: GZ8MTXP02GVPWO.13.76.G10.1.454.CMB.2.raw
  modified_base (248)..(248): a, c, t, g, unknown or other
  modified_base (269)..(269): a, c, t, g, unknown or other
  modified_base (298)..(298): a, c, t, g, unknown or other
  modified_base (352)..(352): a, c, t, g, unknown or other
  modified_base (356)..(356): a, c, t, g, unknown or other
  modified_base (402)..(402): a, c, t, g, unknown or other
  modified_base (414)..(414): a, c, t, g, unknown or other
  modified_base (468)..(468): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtccctgagactctcctgtncagcctcgtgggttcaccgtnacgtcaccacctcatgacgcgtgggtccnccaggcctcgaggggaggctggagtgcgttcttcttttattatagtggtggtanaacntactccgcagctcgtgggaggggccacttcacccatcctaccaganaactataccaanaacactcttcgttacttacaatacgaacaacggcctaggagacgtcatcgaacncggacgtgtaatcgtgtacgcgaagtggacgtacggggccctaacggaccgttacgagccgttggacgtcgacggtcggaccggaacggtacccg

SEQ ID NO: 382407 - DNA, 730 bp, Homo sapiens
  misc_feature: GZ8MTXP02HKW91.13.76.G10.1.454.CMB.2.raw
  modified_base (301)..(301): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggaggaggcttgatccgaggccgtgggggtccctgagactctcctgtgcagcctcgtggtccaccgtcacgtcacacctacatgacgcgtcggccnccgaggcctccggaggggaggggcgtgggagtcgtacgttctttacttttagtttagtaggttaggtcggttaactactactaccgttcccgacgtaacgtaccgtcccgggtaggggaccgggggtacccgtacgtttacccaaccctacgtcccctaccgaaaggtaaaccgtaacctaaacgtttacccgaaaaacgtaaccgaccgttccgtttacggtttacctaaactaaaagttaccgaaaccgacggttacccgaggaccgtaacggaccccgtagtacggaacccgtaccgggtcccgttaagttactttaaccggtggtacggacgaaggacggtacgggtaccggggtaccctaaccggttaaacgttaaccgtacggacgttacggtacggaccgttacgggaccggggaaacccgg

SEQ ID NO: 382408 - DNA, 562 bp, Homo sapiens
  misc_feature: GZ8MTXP02FUY8D.13.76.G10.1.454.CMB.2.raw
  modified_base (268)..(268): a, c, t, g, unknown or other
  modified_base (293)..(293): a, c, t, g, unknown or other
  modified_base (366)..(366): a, c, t, g, unknown or other
  modified_base (407)..(407): a, c, t, g, unknown or other
  modified_base (446)..(446): a, c, t, g, unknown or other
  modified_base (476)..(476): a, c, t, g, unknown or other
  modified_base (531)..(531): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctattttaaaaggtgcccagtgtgaggtgcagctggtggagtcgtggaggaggcttgatccagccgtgggggtcctgagactctcctgtgcagcctcgtgggtcaccgtnagtcacactacatgagctcgggccnccgaggcctccggaggggagggctggagtcgcgttcttcttttatttatagtagtggtatacctatacctcgnagcctcggtggacggggcctattccacctatcctacaaganaacctaaactaccaaagaaccacgtcttagtttacctanaaaatgaaaactgccgtagagacgccgtancgacgcggtcgtagtatcgtgcgagagagcgtacggacccaacgtacgtctaagntagtcggacgtcgacggacgtaacgggaccc

SEQ ID NO: 382409 - DNA, 727 bp, Homo sapiens
  misc_feature: GZ8MTXP02J2II7.13.76.G10.1.454.CMB.2.raw
  modified_base (301)..(301): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctggggttttccttgttgctattttaaaaggtgcccagtgtgaggtgcagctggtggagtctggaggaggcttgatccagccgtggggggtcccctgagactctcctgtgcagcctcgtgggttcaccgtcagtcaccacctacatgagctggggtaccccnccgaggcctaccggaaggggaacggggctgggagtcgtccgttactttacgtttttaattagtaggttaggtggttaacgtaaccctaagtaccgtcccgacgtaacggtacccgttccgggtggggaccgggggtaccctattacccaacccgtactccgtacccgaaagtaacgaaacctaaacttaacccgaaagaacctaccgtctttacgtttactaacgaaaatacgaaaccagacccgtaggacgacgtacccggaatcggaaccgtaccgggtccgtagttaacgttacgtacggtgaccggaaggacggacgggtccggggaacccctaaacggtaaacccggtttaaccgtaaccggtaaccgttaggtaccggggtaccggtcggtaccgggggaacccgtaaacggggaccccg

SEQ ID NO: 382410 - DNA, 578 bp, Homo sapiens
  misc_feature: GZ8MTXP02GB29G.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgccaggcctccgaggggaaggggctggagtgcgtctcttttatttatagtagtggtagtaccatactccgcagacctcgtggacggggccattccaccatctccagacgacaattccaaagaacacgctgtttctacaaaatgaaacagcctagagacgccgatcgacacggccgttagtattactgtgacgtagagacgtcgggggacccctacggtaaacgttaccgtaacgaaccgtagtcggtaccggtcggtacgggggacccaaacgggggtaaccccg

SEQ ID NO: 382411 - DNA, 802 bp, Homo sapiens
  misc_feature: GZ8MTXP02JR4U7.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtctgggaggaggcttgatccaggccgtgggggtccctgagactctcctgtgcagcctcgtgggtcaccgtcagtcacacctacatgacgtcgtcgggtcccgccgaggccgtaccggagggggaacggggcgtgggacggtcggtccgtttctttacgtttttaagtttagtaaggttaggtaggttacgtaacccgtacgttaccgtcccgactacggacccgttccgggtggggtaccgggggtcccgtacgtttaccaaccctactccctacccgaaagggacgtaaaaccctaaacgtttaaccccgaaaacggtaaaacccgtacccggttccgtttacggtttttaacccttaaacgtaaaacgttaacggaaaacccgtaccggacccgttaagggaacggtacggtacccgggaacttacgggaacccggtaaaccggggttcccggtttaagttaccgttaacgttggacggtacggtaggacggtacggtaccgggggacccctaaacgggtaaacccgttacgtaccgggtaacgttaacggtacggggtaccggttcccgggacgggggtaaccccggaacgggtaacccccgg

SEQ ID NO: 382412 - DNA, 712 bp, Homo sapiens
  misc_feature: GZ8MTXP02JDBWT.13.76.G10.1.454.CMB.2.raw
  modified_base (602)..(602): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagtcttgggttttccttgttgtcttaattttaaaaggtgcccagtgtggaggtgcagcgtggtggagtcgtggaggaggtcttgactccgaggtccggtcgggggtccctgacgtactcctcctgtcgcacgtcctcgttcgggtcctaccgtcacgtccaccacctacatgacgcgtcgggtcccgaccgacggccgtaccgggaagggggaacggggtcggtagggtacggtcggttccggtttcttttacttttttaagtttaagttaggttaggttaggttaacgtaaccctacttaccgtccgacgtacggtaccgttccgggtcgggacggggtcctaacgttacccaaccgtacttaccgaccaaaggaactaacctaaacgttaccaaaggaccctacgtcctttacgtttactacaaaagtcaaacgtcgccgtagacgagaccgagtaccggacncgggtactgttacctagtcgagagaggagacgggtaccggacctaaacggtaactaaccgtcgaacgtaggtacggtcggtacggaccggggtaaccaacgggtaccccg

SEQ ID NO: 382413 - DNA, 694 bp, Homo sapiens
  misc_feature: GZ8MTXP02G7ZP1.13.76.G10.1.454.CMB.2.raw
  modified_base (306)..(306): a, c, t, g, unknown or other
  modified_base (495)..(495): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtctgggaggaggcttgatccgagccgtgggggtccctgagactctcctgtcgcacgtcctcgtcgggtcaccgtcacgtacactacctacatgagtcgtcgggtccnccgaggcctccggaggggagggcgtaggagtcgtcgtctttacttttattagtacgttaggtaggtagtaccatacgtccgactacgtaccgtcggtggacgggcctacttccaccgtatcctacaagacgtaactaagtaccgaaagtaacctaggtccttggtttaacctactaaaagtacgaaacncgtccgtagggaagtccggacgtatacggaacccgcggttacccgtgttaactcgtagggtcgaacggtaggacggttacggaccgggtaaccctaaacggttaaaacccggtttcgtaaacggtcggtttaaacggtaccgggggtaaccgttacggggtacccgggggtaaaacccgtaaacgggggtaacccccgg

SEQ ID NO: 382414 - DNA, 663 bp, Homo sapiens
  misc_feature: GZ8MTXP02GSPDI.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtctgggaggaggcttgatccagccgtggggggtccctgacgactctccgtgtgcagcctcgtgggttcaccgtcagtcacacctacatgacgtcgtcgggtccgccgacggcctaccggaaggggaaggggcgtaggagtcgtcgttcgtttactttttagtttagtaggtagtggtataacctatacctccgcagtacctcggtgggacgggccgtaacttccacctactaccctacgaacgagaaaccctaaattaacccgaaaagtaaacccgtacgtcttacgttttactaacaaaattacgaaaacgcgtccgttagaacggacgacccgtagaccgaacgtccggtacgtagttacttacgtggtacgacggacgaaagtcggtacggggacccaaacgtaaacccgttacacgtctagtcgggtaacgttccggacggggacccaaggggtaacccc

SEQ ID NO: 382415 - DNA, 791 bp, Homo sapiens
  misc_feature: GZ8MTXP02GLDVH.13.76.G10.1.454.CMB.2.raw
  modified_base (661)..(661): a, c, t, g, unknown or other
  modified_base (743)..(743): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggagggaggtcttgactccgaggtccggtcggggggtccctggacgtaccttccgtccgtgtcgctacgtcccgttcgtcgggttccacccggttcagtccaccacctacagtgacgtccgtcgggtcccgccgacggtcctaccgggaagggggaacggggcgtaggggacgttcggtccggtttcttttacgtttttaagtttaagttaaggttacggttaggttaactaaccctaacgttacccgttcccgacgtacggtaacccgttccgggtacgggggtaccggggacccgtactttacccgaaccctacttcccgtacccaaagggtaaaccgtaaaacctaaaacctttaacccgaaaaacggttaaaccccgtacggttaccttttacggtttttaacctaaacgaaaaacgttacggaaacctacgtccgtaggaacgacgaccggtanaccggaaccgtccggtacgttacgtacttacgtggtacgaggtacgaaggtcggtaccggaccctaaacggtaaccttacgngtaacgtaaggtcggtacgtcggtaccggggaacgacgggtaaccccg

SEQ ID NO: 382416 - DNA, 711 bp, Homo sapiens
  misc_feature: GZ8MTXP02IPBS9.13.76.G10.1.454.CMB.2.raw
  modified_base (444)..(444): a, c, t, g, unknown or other
  modified_base (572)..(572): a, c, t, g, unknown or other
tcagtcacgtactacacgaccggtgctcgatttagtcactcatacaggggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggaggaggcttgatccagccgtgggggtccctggagactctcctgtgcacgcctcgtgggttcaccgtcagtcacacctacatgagcgtgggtccgtcgaggctccgaggggagggcgtggagtgcgtcttcttttatttatagtagtggtagtaccgatctccgacagtaccgtcggtggacggggtccgtacgttaccaccctagtcctcccgaagtacgaactaaacttcccgaaanaaaccgtacgtcctttacgtttacttaaccaaaagttcggaaaactacggtccgttaaaggacggtacggcccgaagtaccggaaccgtaccggggtccgtttaagttaaactttacccgttcggggngtaacccgggtaaaaggtcgggtaaaacggggtttcccgggggaaccccctaaacggggttaaaacccgtttccgtaacgaacgttaggtaccggggtaccgtccgggtaccggggaccggaaaaccggggtaccccgg

SEQ ID NO: 382417 - DNA, 673 bp, Homo sapiens
  misc_feature: GZ8MTXP02FLVCN.13.76.G10.1.454.CMB.2.raw
  modified_base (253)..(253): a, c, t, g, unknown or other
tcagtcacgtactacacgaccggtgctcgatttagtcactcatacaggggggggagaggagcccagcactgggattccgaggtgtttccattcggtgatcagcactgaacacaaaggactcaccatggagttttggctgagctgggttttccttgttgctattttaaaggtgcccagtgtgaggtgcagctgggtggagtcgtgggaggaggcttgatccgagccgtgggggtccctgagactctcctgtgcncgcctcgtcgggttcaccgtcagtcacacctacatgagcgtcgggtccgccgacggcgtaccggaggggagggcgtggaggtcggtcgttctttacgtttttatttagttaggttaggtaggttaacgtaactactaccgtccgacgacgtaccgtccgggtacgggcggggaccgtacttaccaccacgtcctaccgagtaacgactaaacttaccaaagaccacgtcttagtttactaacaaatcgaacacggcctaggaacgtacgcccgaagtacgaacccgacgggtccgttaggttaaccttagtcgggtagacggaacggtagggacggttacccggggaccctaaacgggttaaccttaccgagtacgtaagcggtacgtcgggacggggaaccaaacggggcctaacccgg

SEQ ID NO: 382418 - DNA, 630 bp, Homo sapiens
  misc_feature: GZ8MTXP02IF4AN.13.76.G10.1.454.CMB.2.raw
  modified_base (287)..(287): a, c, t, g, unknown or other
  modified_base (381)..(381): a, c, t, g, unknown or other
  modified_base (391)..(391): a, c, t, g, unknown or other
  modified_base (402)..(402): a, c, t, g, unknown or other
  modified_base (554)..(554): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctatttaaaggtgcccagtgtgaggtgcagctggtggagtctgggaggaggcttgatccaggccgtggggggtccctgacgactctcctgtgcacgcctcgtgggttcaccgtcagtcaccacctanatcgagcgtcgggtccgccgaggccgtaccggaaggggaacgggcgtagggagtcgtacgttctttacttttattagtagtacgtggtagtacntactccgacncgtcgtccggnggacggggtaccgtattacacctatcccgtacaacgtaagaactaacttaccgaaagaacctacgtctttagtttacctaactaaaagttccgaaactacgccgtaggagtacgaccgatcgaacgacgggtcttagtacttacgtggtcgnggtaggacgacggtaccgggaccgaacgttaaacgtcgtaacgacgttacggaggtacgtacggacgggaacccgg

SEQ ID NO: 382419 - DNA, 704 bp, Homo sapiens
  misc_feature: GZ8MTXP02IJEMA.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtcggttcaccgtcagtcacacctacatgagcgtcgggtccgccgaggccgtaccggaaggggaacggggcgtaggagtggtccgtttctttactttttaatttagttaggttaaggttaggttagttaaccctaacgttaccgtccgacaacgtaccgttccggtcgggacggggaccgtacttccgaaccctatacctacccgaaagaacgtaactaaacgttaccaaaagtaacccgtacgtactttgttttaaccttaacaaaagttcgaaacacggtcctaggaacgacgccgaatcgaaccgtacgggtcgttagttaactttacgtgtacgacgaaggtacgacggttccggggaaacccctacggttaaaaccgttacgaccggtaattaaacggtgggtaacccggttcggaccgggggaacccaaaacgggtaccccgg

SEQ ID NO: 382420 - DNA, 556 bp, Homo sapiens
  misc_feature: GZ8MTXP02G7SX5.13.76.G10.1.454.CMB.2.raw
  modified_base (392)..(392): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagcgtgggtcccgccgaggcctccgaggggaaggggctggagtgcgtcttcttttatttatagttagtggtagtacatactccgcagactccgtgaggggccattcaccntctccagagacaagttccaagacctagctgtttctacaaatcgaacagcctagagagaccgatgacacggccgtgtattactgtgcgagtgacgtcggggacccaacggtaccgttaccgtacgccgtagtcggtacgtcggtacgggaccgtaacgggacccg

SEQ ID NO: 382421 - DNA, 764 bp, Homo sapiens
  misc_feature: GZ8MTXP02FVWJB.13.76.G10.1.454.CMB.2.raw
tcagtcacgtactacacgaccggtgctcgatttagtcactcatacaggggggggagaggagcccagcactgggattccgaggtgtttccattcggtgatcagcactgaacacagaggactaaccatggagttttggctgagctgggttttccttgttgctattttaaaaggtgcccagtgtgaggtgcagctggtggagtcgtgggaggaggcttgatccagccgtgggggtccctgagactctcctgtgcagcctcgtggttccaccgtcagtcaccacctacatgacgcgtcgggtcccgccgacggcctaccggaggggaacggggcgtagggtaggtcggtccgttctttacgtttttaatttaagttaggttaaggttaggttaacgtaactacgttaaccgtcccggactacggtacccgttccgggtacggggacgggggtcccgtactttacccgaaccctacttacccgtaccgaacggtaaacgaaacctaaacttacccgaaaagtaaccctacgttcttcgttttactaacaaatacgaaacacggtaccctaggaacgtacgaccgtaagtacggaacccgtacgggtaccgttagtttaaacttcgtaggttcggacggtaagggacggtacgggtacccgggggaaacccctaaacgggttaaaaccgttttacccgacggttacgtaacggttcggggaaccggttccgggaccgggggaaccaaaccgggggccctaaaccccgggg

SEQ ID NO: 382422 - DNA, 856 bp, Homo sapiens
  misc_feature: GZ8MTXP02FPBIF.13.76.G10.1.454.CMB.2.raw
  modified_base (255)..(255): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgtcttaattttaaaaggtgcccagtgtgaggtgcagctggtggagtcgtgggaggaggcttgatccaggccgtcggggggtccctgacgactctcctgngcacgtcctcgttcgggtcaccgtcacgtcaccacctacagtgacgtccgtcgggtcccgccgacggcctaccggaaggggaacggggcgtggagtcggtccgtttctttacgttttttaagttttaagtaaggttaggttagggttaacgtaaccctaacgttaccgtccgacgtaacggtacccgttccgggtggggtaaccgggggtcccgtaacgttaccctaaccctaacgttcccgtacccgaaagggactaaaacccgttaaacttaacccgaaaaacgaacccgtaccgttcgttttacggttttaaccctttaaacgaaaaacgttacggtaaaaccacccggttacccgtagggaacgggaaaccggtaccccggaaagtacccggaaaccgggttaaccccggggtccgtttaaaggtttaccgtttaaccgggtttcgggaccgggaaacgggtaacgggtacgggtaccgggggtaacccggggtaaacccccgtaacggttaaaaccggtttacccgttacggaacgttaacggtacgggtaccgggtaccgggtacgggggaaaccccgaaccgggggtaaccccg

SEQ ID NO: 382423 - DNA, 653 bp, Homo sapiens
  misc_feature: GZ8MTXP02G4K6S.13.76.G10.1.454.CMB.2.raw
  modified_base (229)..(229): a, c, t, g, unknown or other
  modified_base (237)..(237): a, c, t, g, unknown or other
  modified_base (638)..(638): a, c, t, g, unknown or other
tcagtcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcacgcccaccctcgagtcgtccgtcgtccccaggacagacagccagcatcactgctcagaatagtgnagataatntacttctgtatcagacagagtcgacggcctaccgtccccgtagtccgtcgtcgtacacttacgtatacgtaaagtacgtcggaacccgacggtcccggacccgtacggacgggtaccccttcccgtagacgtccgttacttccgttacgtccggacctccgtaaccgtcgtacggggtacctcgacccgtaccacttccacgaacctacgccgacggaccggaccctaggacgttacgacggtaacgcggtaacggtccgtaagttacttaacggttagaccgttaggcgggtacgacgggtaacacgacgacgtccgacggtccgacccgtagtcttccggtaccgtaccggtaacggtaacggaacccgttacgggtacccctaccggtttaccgaacnccggaaaacccccgg

SEQ ID NO: 382424 - DNA, 867 bp, Homo sapiens
  misc_feature: GZ8MTXP02GNHTG.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtcgtggaggaggcttgatccgagccgtgggggtcctgagactctctgtgcacgctcgtggtcaccgtcacgtcacacctacatgagtcgtcgggtcccgaccgacggccgtccgggaacgggggaacggggtccggtaggggtaggttcggtccgtttaccgttttaccgttttttaagtttttaagttaggtttagggttacgggtttaacggttaaccctaacgttaccgttacccggacgtaacggtacccgttccggggtacgggggtaccgggggtacccggtacctttacccgacccgtacgttcccgttaccccgaaaggtaacccgtaaacccttaaaacgtttaacccccggaaaaaggtaaaccccttaaccggttccgtttttaacggtttttaccccttaaaagtaaaacgttccggaaaaacccgtccggtacccgttagggaaaccgggacggttaccccgaaagttccggggaaaaccccgtccggggtttacccggttagttaaacggttttaccgggagggtacggaacgggtaagggtaacgggtacccggggtacccggggtaaaccccgtaaacggttaaccgttaccgtacggtaacgttacggtacgggtaccggtaccgggaccggggaaaccgaaccgggtacccg

SEQ ID NO: 382425 - DNA, 849 bp, Homo sapiens
  misc_feature: GZ8MTXP02H9171.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctattttaaaaggtgcccagtgtgaggtgcagctggtggagtcgtgggaggaggtcttgactccgacggccggttcggggggtccctggacgacttcctccgtgtcgcacgcctcgttcgggttcacccgtcacgtcacacctacagtgacgtcgtcgggtcccgaccgacggtccgtaccgggaaggggaacgggggcgtggggaggttcggttccggtttccctttttactttttttaaagttttagttaaggtttacggttagggttaacgttaaccccgtacttaccgtcccgtactaacggtacccgttcccgggtcgggggaccgggggtacccgttacgtttaccccaaccctacgtccctacccgaaaggtaacgtaaaccctaaaacgtttaaccccgaaaacgtaaacccgttaccgggtcctttttaacggtttttacctttaaacgaaaacgttcgaaaacccggttccggacccgttaggaacggtaaccggtacccggtaagttcggaaaccccggaccgggttcccggtttaacgtttaacgtttaccgtggtggacccggaaggacggtacggggtacccggggaccccgtaaaaccgggttaaaccgttaccgttaacgccgtttaaggacgggtacccgttcggggaccggggaccgaaccggggtaaccccg

SEQ ID NO: 382426 - DNA, 688 bp, Homo sapiens
  misc_feature: GZ8MTXP02IENXV.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggaggaggcttgactccaggccggtggggggtccctgagactctcctgtgcacgcctcgttcgggttccaccgtcacgtccaacctacctacagtgacgcgtcgggtcccgccgaggccgtaccggagggggaacggggtcgtgggagtgtcgttctttactttttatttagtagttaggtggtatactactacctccgactacgaccgttcgggtcggggacgggtccgtacttaccacctactcctacccgagtaacgaactaaacgttacccgaaaagtaaccctacgttctttacgtttaccttaacgaaaattcgaaaacgtcgtaccgttaggaagaccggcgagtaccggaccgtacggtccgttagttattacgtgtacggacggagaggtacgtaccgggggaccctaaacggtaaccgttacacggtcttacggtacgggtacgtccgggtacggggaccgaaacggggaccccg

SEQ ID NO: 382427 - DNA, 886 bp, Homo sapiens
  misc_feature: GZ8MTXP02GI2QU.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcacgtcacacctacatgagcgtcgggtcccgccgaggcctaccggagggggaacggggtcgtggggaggtcggtccggtttctttacgtttttaattttaagttaaggttaggttaggggtttaacggtaaccctacgttaaccgtccccggtacgtaacgtacccgttccggggtcggggacgggggtcccgtaacgtttaccaacccgtagttcccctaccgaaacggtaaacgtaaaccctaaacgtttaccccaaaaacggtaaacccgtaccggttccttttacggtttttacccttaaacgtaaaacgttacgaaaacccgtacggtaccccgttagggaaacgaacgggtaccccggtaaagttccgggaaaacccggtacccggggttaccccggtttaaggtttaaacccgtttaaccggtttgggggttaacggtaccggggaaaaggggtaacgggttaacggggtaaccccggggggtaaccccctaaaaccggggtttaaaacccgtttacccggttaaccggtaacggtttacgggtaccgggggttaaccggttcccggggtaaccgggggtaaacccggaaaccgggggtaaaccccccgggg

SEQ ID NO: 382428 - DNA, 578 bp, Homo sapiens
  misc_feature: GZ8MTXP02GGG4L.13.76.G10.1.454.CMB.2.raw
  modified_base (239)..(239): a, c, t, g, unknown or other
  modified_base (350)..(350): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagcccaccctcagtgtccgtgtccccaggacagacagccagcatccacctgctctagaaataatggacagataaatntactctgtatcagcagaagtcaggccagtcccctgcgctggtcatcgtatacaagactgaccaaggcccggtccctagacggggtacctcccccgtagacgcgtactttcncgttggcctccaaactcgtacggactcacgccactctacgaccatacgacggacccggaccctacgccctaagtacggatcggacggcttacgtaacttacttacgtagtacaagttacgagttacggaacctaagtactagttacgggattcgggtacgttggtacgggacggtaacggacctaaacgcggtacccgtacgtacgtaccgacgtaccgaagtccccg

SEQ ID NO: 382429 - DNA, 727 bp, Homo sapiens
  misc_feature: GZ8MTXP02ITMK4.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactaaccatggagttttggctgagctgggttttccttgttgctatttaaaggtgcccagtgtgaggtgcagctggtggagtctgggaggaggcttgatccagccgtgggggtccctgagactctcctgtgcagcctcgtgggttccaccgtcagtcacacctacatgagccgtcgggtccgccgacggccgtccgaggggaacggggcgtgggaggtcggtcgttctttacgtttttatttagtaggttagtggtaacgtactactaccgtccgacgagtactccggttggacgggggcctacttccacctactcctacgacgtaacgactaactaccaaagaaacacgtcgttcgtttactacaaaagtacgaaactacgacccgtagacgtacggacccgtaggtaccggaacccgtacgggtcccggttagtttaaaccgttacggttcggtggaaccggtacggggaaggtaccggggttaccgggggaaccccccgtaaaaggtaacccggttttaaaacccgacgggttacgttaacggtacgggggtaaccgtttccgggaccggggggaaacccgtaaaccgggggacccgtttaaccccggg

SEQ ID NO: 382430 - DNA, 688 bp, Homo sapiens
  misc_feature: GZ8MTXP02GGMW5.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactaaccatggagttttggctgagctgggttttccttgttgctattttaaaaggtgcccagtgtgaggtgcagctggtggagtcgtggaggaggcttgatccagccgtgggggtccctgagactctcctgtgcagcctcgtgggttccaccgtcagtcacacctacatgagcgtcgggtccgccgaggctaccggaggggaacggggcgtgggagtcgtcgttctttacttttatttagtaggttagtggtactacactaccgtccgacacggtacctccggtgggacgggggtaccacgttaccgacctacttccgtaccaaggaacgaaactaaaccttaccgaaaacgaaccacgttcgttacgttttacttaactaaaatacgaaaccacggtaccctaggacgtacgaccgtagtacgaaccgtaccgggtcgttaggtaaacttcgtagggtcgacggaaggtacggtacgggtaccgggggaaccccaacgggtaacccgttaacgtaccggtacttaaggtcggtacggtacgggacggggaccgaacggggacccgtacccgg

SEQ ID NO: 382431 - DNA, 730 bp, Homo sapiens
  misc_feature: GZ8MTXP02FSND4.13.76.G10.1.454.CMB.2.raw
  modified_base (253)..(253): a, c, t, g, unknown or other
  modified_base (564)..(564): a, c, t, g, unknown or other
  modified_base (620)..(620): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttaattttaaaaggtgcccagtgtgaggtgcagcgtggtggagtcgtgggaggaggcttgatccagccgtgggggtccctgagctctctgtgcncgcctcgtggtcaccgtcagtcaccacctacagtgagtcgtcgggtcccgccgacggccgtccggaaggggacggggcgtgggacggtcggtcgtttcctttactttttaagtttaagttaagttaggttaggttaacgttaaccctaacgttacccgtccgacgtaacgtacccgttccggtcggggaccgggggtcccgtaacttcccaacctactccgtacccaaaggaacgtaaacctaaacgttaacccgaaaagaacccgtaccgttcccttttagttttaacccttaacaaaaagtcgaaaacncgtccgtaaggacggaccgtaccgagtacgaccgtacggtcgttactagtttacgngtacggacgagtaggacgggtacccgggtaaccctaacggttaaaccgttacgtaccgtgtaacggtcggtaccggtcgggtaccggggaacccggaaaccgggtacccg

SEQ ID NO: 382432 - DNA, 765 bp, Homo sapiens
  misc_feature: GZ8MTXP02ICVBE.13.76.G10.1.454.CMB.2.raw
tcagtcacgtactacacgaccggtgctcgatttagtcactcatacaggggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggaggaggcttgatccagccgtgggggtccctgagactctcctgtgcagcctcgtcggttcaccgtcagtcacacctacatgagcgtcgggtccgccgacggctccggaggggaggggcgtgggaggtcgtcgttctttctttttatttagtagttaggttggtagtacctacttacctccgacgacgtaccgtccggtgggggacggggtcccgtaacgtttacccaaccctacttccctacccgaaaggtaacgtaacctaaaacttacccgaaaaggtaaaccctacggttccttttaacgtttttacccttaaacaaaaacgttcggaaaaacccgtccgtacccgttagggaaacggacggtacccggtaaagttccggaaacccgtacccggggttccgttaaggtttaatttaccgtggacggtacggaaggtacgtacggggttcccgggggaaacccctaacgggttaaaaccgtttaccgaacgtcgttaacgggttacggggaccggttacggggtacccgggggaaccgaaaaccgggggtacccccgg

SEQ ID NO: 382433 - DNA, 663 bp, Homo sapiens
  misc_feature: GZ8MTXP02FZY6S.13.76.G10.1.454.CMB.2.raw
  modified_base (319)..(319): a, c, t, g, unknown or other
  modified_base (364)..(364): a, c, t, g, unknown or other
tcagtcacgtactacacgaccggtgctcgatttagtcactcatacaggggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtggggggtccctgagactctcctgtgcagcctctgggttcaccgtcagtcacacctacatgagctgggccgccgaggcctccgaggggaggggcnggagtgtcgtcttcttttatttatagtagtaggtagtaccatacnccgcagaccgtcgtggacggggccgtattccaccatctaccaagagaactaatacccaaagaacaccgctttagtttaccttacaaaatgaaacagcctaggagacgacccgatacggaaccgaccggtccgttagttaacgttacgtagggtacggaccggaaggaacggtacgggtaccgggggtaaccccctaaaaccgggttaaaacccggttaaccttaaccggaaccgtttaacggtacgggggtaccggttaccgggtacgggggaccccgtaaaacgggggtaacccccgg

SEQ ID NO: 382434 - DNA, 726 bp, Homo sapiens
  misc_feature: GZ8MTXP02FSY5E.13.76.G10.1.454.CMB.2.raw
  modified_base (248)..(248): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctctgtgcngcctcgtgggtcaccgtcacgcacacctacatgagcgtcgggtccgccgacggcctaccggaggggaacggggctaggagtcgtcgtcctttcttttatttaagtagtagtggtagtacctactacctcgcgacgacgtccggtgggaacggggccgtaacgttcccaaccgacttaccgtaccgaagaagtaaacctaaacttaacccgaaaacgtaaaacccgtacccgtcttttaccgtttttaacctaacctaaaaaagttcgaaaaccgtaccggtacctaaggaacggtaccgacccgtaagttacccggaaccgtaacccgggtccggtttaagttaacttaacggtggtacggaccgtagggacgtacgggtaccggggacccctaaacgggtaaaccgtttaccgaacgtccgttaaggtacgggaaccgttccgggtagggggaaaccccgaaacggggtaacccccg

SEQ ID NO: 382435 - DNA, 675 bp, Homo sapiens
  misc_feature: GZ8MTXP02GJCV3.13.76.G10.1.454.CMB.2.raw
  modified_base (257)..(257): a, c, t, g, unknown or other
  modified_base (508)..(508): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtctgggaggaggcttgatccgaggccggtggggggtccctggacgtactctcctgtgcngcctcgtcggtcaccgtcagtcaccacctacatgacgcgtcggcccgcgaggcctccggagggaggggcgtggagtcgtcgttctttctttttaagtttagtagtaggtaggttacgtacctacttaccgccgacgtacgtaccgtccgggtgggaccggggcctattacccgacctactcctaccaaggaactaaacctaactaccaaagtacctactccgtttagtttaccctaagaaaactcgaaacncgtacctgaagaccgaccgtaatccggaacctacgggtccttaaggtacctttacggtgtcggaacggtagagggtaccggccgggggtaaccccaaacggttaaacggtacctacgaacgtagtaccgggtacggtcggtaaccggggaccgaaacggggtccccg

SEQ ID NO: 382436 - DNA, 596 bp, Homo sapiens
  misc_feature: GZ8MTXP02G9S69.13.76.G10.1.454.CMB.2.raw
  modified_base (255)..(255): a, c, t, g, unknown or other
  modified_base (269)..(269): a, c, t, g, unknown or other
  modified_base (281)..(282): a, c, t, g, unknown or other
  modified_base (284)..(284): a, c, t, g, unknown or other
  modified_base (294)..(294): a, c, t, g, unknown or other
  modified_base (300)..(300): a, c, t, g, unknown or other
  modified_base (311)..(312): a, c, t, g, unknown or other
  modified_base (356)..(356): a, c, t, g, unknown or other
  modified_base (367)..(367): a, c, t, g, unknown or other
  modified_base (383)..(383): a, c, t, g, unknown or other
  modified_base (461)..(461): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagcgtggtggagtctggaggaggcttgatccagccgtggggggtccctgagactctcctgtgcagcctntcgggttcaccgtnagtcacacctanngngcgtcggccncgagcncggagggaggnnggagtcgcgtctttatttattagtagtagtgtatactatacgcncagccgtcggnggacgggctatccacntcacagacaactaactacgaaagaactacgtcttacgttactaacgaaatacgaaacacgtacgtagacgacgacganacgacgaccggtcgtagtacttacgtgtacgacggagacggtacggtacccgggaaccctaacggtaaaccgttacgtacggtaacgtacggtacggtaccggtaccgggtaccgggaaccggtaaccggacccg

SEQ ID NO: 382437 - DNA, 688 bp, Homo sapiens
  misc_feature: GZ8MTXP02FQIQL.13.76.G10.1.454.CMB.2.raw
  modified_base (248)..(248): a, c, t, g, unknown or other
  modified_base (484)..(484): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggtttccttgttgctatttaaaggtgccagtgtgaggtgcagcgtggtggagtcgtggaggaggcttgatccaggccgtgggggtccctgagactctcctgtgcngcctcgtggtcaccgtcagtcacacctacatgagtcgtcgggtccgccgaggcctaccggaggggagggtcgtggagtggcttcgttacttttagtttagtagtaggtaggttacgtaacctatacctccgacgtacgtaccgtcggtgggacggggcctattacccgaccatcctaccaaggtactaaacctaattaacccaaagtaacctacggcctttagtttaccctaaaanaaactacgaaacgtccgtacgtaggaacgaccggaccgtagacccggacgtaccgggtacgtttaagttacgttacggtggacgacggtaaggacggtaccgggacccgggaaaccgttaaaccggtaaccgtacgtacggtaagttaacgggtaccgggtaaccgggtacgggaaccggggaacccggtaaccgggtaacccg

SEQ ID NO: 382438 - DNA, 675 bp, Homo sapiens
  misc_feature: GZ8MTXP02H1CII.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgtctaattttaaaaggtgcccagtgtgaggtgcagctggtggagtctgggaggaggcttgatccagccggtgggggtcctgagtactctcctgtgcagcctcgtgggttcaccgtcagtcacacctacatgagcgtcgggtcccgccgaggcctccggaggggaacggggcgtgggagtggtccgtttctttctttttatttagtagtagtggtagtacctattacctcgcagactccggtgggacgggcctcttccacctactcctacccaagtacgaaactaaacgttccaaaacggtaaacctacgggttactttgtttttaacctaactaaaatcgtaaaacacggtcccttaggaacgacgaccggaatcgaacgacgggtccgttagttacgttaacgtgtaggacgtaaggacgtaacggtccggggaaccctaaaacggttaaccttaacggctaacggttaacgtcggggtaccggttacggacgggggtaccaaaacgggggtaccccg

SEQ ID NO: 382439 - DNA, 525 bp, Homo sapiens
  misc_feature: GZ8MTXP02GWATE.13.76.G10.1.454.CMB.2.raw
  modified_base (383)..(383): a, c, t, g, unknown or other
  modified_base (393)..(393): a, c, t, g, unknown or other
  modified_base (401)..(401): a, c, t, g, unknown or other
  modified_base (403)..(403): a, c, t, g, unknown or other
  modified_base (406)..(406): a, c, t, g, unknown or other
  modified_base (409)..(409): a, c, t, g, unknown or other
  modified_base (411)..(411): a, c, t, g, unknown or other
  modified_base (414)..(414): a, c, t, g, unknown or other
  modified_base (417)..(417): a, c, t, g, unknown or other
  modified_base (419)..(419): a, c, t, g, unknown or other
  modified_base (422)..(422): a, c, t, g, unknown or other
  modified_base (424)..(424): a, c, t, g, unknown or other
  modified_base (426)..(426): a, c, t, g, unknown or other
  modified_base (436)..(436): a, c, t, g, unknown or other
  modified_base (447)..(447): a, c, t, g, unknown or other
  modified_base (457)..(457): a, c, t, g, unknown or other
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctgggggtccctgagactctcctgtgcagcctctggttcacgtcagtcacacctacatgagctggtccgccaggctccaggggaagggctggagtgcgtctcttttattatagtagtggtagtacatactccgcagactccgtgaggggccattcaccatcnccaggacaanaatacaananacnctntntanaananaanancngagagacganagacacgcgtntatatgtcgngagagagacggaccgaacgaaacgtaacgtaacgacgtaacgtacgtacgtacgtacggacggaacgg

SEQ ID NO: 382440 - DNA, 600 bp, Homo sapiens
  misc_feature: GZ8MTXP02FOPGR.13.76.G10.1.454.CMB.2.raw
  modified_base (291)..(291): a, c, t, g, unknown or other
  modified_base (361)..(361): a, c, t, g, unknown or other
  modified_base (370)..(370): a, c, t, g, unknown or other
  modified_base (396)..(396): a, c, t, g, unknown or other
  modified_base (419)..(419): a, c, t, g, unknown or other
  modified_base (432)..(432): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatccagccgtggggggtccctgagactctcctgtcgcagcctcgtgggtcaccgtcagtcacacctacatgagcgngggtcccgcacggcctccggaaggggaagggctggacgtgcgttcttcttttattagtagtaggtggtanaccataccncgcagcctcgtggacgggcatccacntctcagacacataccaaagaacncgcttgttcttanaaactcgaaacagtcctagagacgaccgagtaccgacgtacggtccgtagtaccttagtcgtaggaccggagacgtacggtccggggaccctaaacgggtaaacgtacccgtaacgcgttacggtacggtacccggttacggggaccgggaccggaaaccgggccccg

SEQ ID NO: 382441 - DNA, 620 bp, Homo sapiens
  misc_feature: GZ8MTXP02H45B0.13.76.G10.1.454.CMB.2.raw
  modified_base (389)..(390): a, c, t, g, unknown or other
  modified_base (397)..(397): a, c, t, g, unknown or other
  modified_base (407)..(407): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtccctgagactctcctgtgcagcctcgtcggggttcaccgtcagtcacacctacatgagcgtcgggtccgccaggctccgaggggaggggctggagtgcgttcttcttttattatagtagtggtatacatctcgcacgactcgtggcgggcgtatccacnnctcaganactatacaanacacgcttgttcttacgaaatcggaactacgtacctagagtacgaccgagtacgaccgacgggccggttagttacgttaccgtggtacgacggtagggagtacgggtacgggggtaccccgtaaacggtaacgttacccgtaacgtaaccgttaacggtacgggggttacggtttacgggggacccgtaaacgggggaccccgttaacccggg

SEQ ID NO: 382442 - DNA, 609 bp, Homo sapiens
  misc_feature: GZ8MTXP02GPYPS.13.76.G10.1.454.CMB.2.raw
  modified_base (530)..(530): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctatttaaaaggtgcccagtgtgaggtgcagctggtggagtctggaggaggcttgatccagccgtggggggtccctgagactctcctgtgcagcctcgtggtcaccgtcagtcacacctacatgagcgtcgggtccgccgaggcctcggaggggaaggggcgtggagtggcgttcttcttttagtttatagtggtggtagtaccactacctcgcacgtccgtcgtgggacggggtccgattccaacctactcctaccaagacgaaactaaacttaccaaacgtaacacgctttacgtttactaacaaatgaaaccacgtcctaggagacggtccgataccggactaccgggtccgtagttaatcgtggtacgnggagaggacgtccgggaccacgtaaccgtacgtacgccgtagtacggtacgtcggtacggggaaccgacggtaaccccg

SEQ ID NO: 382443 - DNA, 674 bp, Homo sapiens
  misc_feature: GZ8MTXP02H0P4X.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtctgggaggaggcttgatccagccgtgggggtccctgagactctcctgtgcagcctcgtcgggttcaccgtcagtcacacctacatgagcgtcgggtcccgccgacggcctccggaggggaaggggccgtggagtggcgttctttactttttatttagtagttaggtggtagtacatacctcgcacgaccgttccgtggggacgggccgtacgttccacctatacctaccagacgaactaacttaccaaaacgaaccctacgtcttacgttttactaacgtaaattacgaaaacctcggtaccctaggaacgtacggaccgtagtacggaaccgaccgggtccgtagttacgttacgtggtacggacggaggacggtacggtcgggggaaacccctacgggttaaaaccgttaccgtacggtaacgttacggtacgggaccggttacggtaccggggacccgaaaacggggaccccg

SEQ ID NO: 382444 - DNA, 829 bp, Homo sapiens
  misc_feature: GZ8MTXP02JGCV1.13.76.G10.1.454.CMB.2.raw
  modified_base (268)..(268): a, c, t, g, unknown or other
  modified_base (296)..(296): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtnagtcacacctacatgagcgtcgggtccnccgaggcctaccggaggggtaacggggcgtagggaggtcggtcggttctttactttttaatttagttagtacggttggggttaactaccctaatacctccgactacgaccgttccggtgggacgggggccctagtttcccaaccctaagtttcccgacccaaagggaaccgtaaacctaaaccgttaacccgaaaaggtaaaccctccggttacctttacggtttttaccttaaccgaaaagttcggaaaaccaccggggtcccttaagggaaacggacggtaccccgggtaaagtaccggtaacccgggtacccgggttaccggtttaacggttttaaccgttaccggttacgggtaacgggtaacgggtaaacgggtaccgggttaacccgggggtaccccgggggtaaacccccgttaaaacggttaaaacccgtttacccggtaaaccggtccggtttaaacgggttacccggggtaacccgggttaccgggggtacccggggaaacccggtaaccggggtaaccccgg

SEQ ID NO: 382445 - DNA, 749 bp, Homo sapiens
  misc_feature: GZ8MTXP02J2NEI.13.76.G10.1.454.CMB.2.raw
  modified_base (249)..(249): a, c, t, g, unknown or other
tcagtcacgtactacacgaccggtgctcgatttagtcactcatacagggggggggaggagcccagcactgggattccgaggtgtttccattcggtgatcagcactgaacacagaggactcaccatggagttttggctgagctgggttttccttgttgctattttaaaggtgcccagtgtgaggtgcagctggtggagtctgggaggaggcttgatccagccgtgggggtccctgagactctcctgtgcngcctcgtcgggtcaccgtcagtcacacctacatgacgcgtcgggtcccgccgaggcctaccggaaggggaacggggagtggagtcgcgttcttcttttattagtagtacgtggtagtacactactcgacagactccggtggacggggccgattccacctatcctaccagacgtaaccaaattacccgaaaagaaccctacgtctttacgttttacccttaacgaaaacgttacgaaaacgtacggtacccgttagggaaacggacggtacccggtaagttacggaaacccgtaccgggggttaccccttaagggttttaacgtttaccgttgggttacgggaaccgggaacggtaaacgggtacgggtaaccccggggggaacccccaaaacgggttaaacccgttttaaacccgaccgtaacggttaaacggtcggggaaccggtttacccgggtacgggggaacccccggtaaaacgggggaccccctaacccggggg

SEQ ID NO: 382446 - DNA, 622 bp, Homo sapiens
  misc_feature: GZ8MTXP02IT5C9.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtcgggtcccgccgaggcctccgaaggggaggggctggagtgcgttcttcttttatttatagtagtggtagtacatactccgcagtactccgtgggacggggccgtattccgaccatcctacccagagaactaacttacccaaagaacccacgtcttagttttacctaacaaaatacgtaaacacgtcctaggacgacgccgatcgacgaccgggtcgttagtacttacgtgtaggacgaggtacgacggtccggggaccctacggtaaaccgttactacggaacttacggtacggtaccggtcggtacgggggacccaaaacgggggtaccccg

SEQ ID NO: 382447 - DNA, 587 bp, Homo sapiens
  misc_feature: GZ8MTXP02JWOIE.13.76.G10.1.454.CMB.2.raw
  modified_base (295)..(295): a, c, t, g, unknown or other
  modified_base (334)..(334): a, c, t, g, unknown or other
  modified_base (347)..(347): a, c, t, g, unknown or other
  modified_base (356)..(356): a, c, t, g, unknown or other
tcagtcacgtactacacgaccggtgctcgatttagtcactcatacagggggggagaggagcccagcactgggattccgaggtatttccattcggtgatcagcactgaacacagaggactcaccatggagttttggctgagctgggttttccttattactattttaaaaggtgtccagtgtgaggtgcagttggtggagtctggaggaggcttggtccaggccgggggggtccctgagactctcatgtgcggcctcgtgggctcaccgtcaacaccaactacatgagctgggtccncaggctccagggagaggccggagtggtctcagttattangtcgaggtgccanattcaccgnacgactccggtggacggggccgttcaccatcctacgagacgacaattccaagtaacacggtgtatcttacaatgaacgacctgagagtgacggacgaacggccgtctaattacgtagtcgacgaaagacgtagcaacggtacggacgggacccccgtaaaggtcgggggaccgtggtcggggtacggtttcttaacgttgtacgtgcggtcgggaccgacggtaaccccgg

SEQ ID NO: 382448 - DNA, 723 bp, Homo sapiens
  misc_feature: GZ8MTXP02FKDID.13.76.G10.1.454.CMB.2.raw
  modified_base (302)..(302): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctattttaaaaggtgcccagtgtgaggtgcagcgtggtggagtcgtggaggaggcttgatccgagccgtcgggggtccctgagactctcctgtgcacgcctcgtggtcaccgtcacgtcacacctacatgagcgtcgggtcccnccgaggcctaccggaggggaaggggctggagtcgtcgtctttactttttaagtttagtagtaggtaggtacgtaccctattaccgtcgacacgtaccgttccgggtggggaccggggtcgtaacttcccaaccgtactacctacccgaaagtacgaactaaagtacccaaaagaacctacggcctttggtttaacctactaaaaatcgaaaacctacggccgtaggaacggaccgacgaacgttaccggaacccggaccggttccgtttaagttaaccgtttcgtggtacgggaccgttaaagggacggttacgggaccccgggggaccctaaacggggttaaaaccttcccggtaacgtaacgtaaggtccggggtaaccgttccgggtaacgggggacccccgaaacggggtaaccccg

SEQ ID NO: 382449 - DNA, 718 bp, Homo sapiens
  misc_feature: GZ8MTXP02FYP72.13.76.G10.1.454.CMB.2.raw
  modified_base (260)..(260): a, c, t, g, unknown or other
  modified_base (291)..(291): a, c, t, g, unknown or other
  modified_base (525)..(525): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtcgtgggaggaggtcttgactccgacggccggtcggggggtccctgacgtactctcctgtgcncgcctcgtggtccaccgtcagtcacacctanatgacgtcgtcgggtcccgaccgaggcctaccgggaaggggaacggggtcgtggaggtcgtcgtttctttactttttagtttagtaaggtaggttaggtactaacctactcctccgctacgtaccgttcggtgggacggggtctacttaccgacctactccgtaccaagaactaacctaacttaaccgaaacgtaacctaccgtctttcgtttacctaacgaaaattcgaaacncgtacctaggaagaccgacgtagtaccgaccgtccggtacgttagttacttacgtggtacggacgaacgggtagtaccggggtaccgggtaacccctaaaccgggtttaaaccgttaccggaacgtaaccgttaaggtacgggggtaaccccgtggggtaacccgggggaaccggtaacggggtaacccccgg

SEQ ID NO: 382450 - DNA, 656 bp, Homo sapiens
  misc_feature: GZ8MTXP02FI4XC.13.76.G10.1.454.CMB.2.raw
  modified_base (369)..(369): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggtcaccgtcagtcacacctacatgagcgtcgggtccgccgaggcctccggaggggacggggccggagtgcgtcttctttattagtagtagtggtacgtacactacctccgnacgtacctcccggtggacgggggccagtttccacctatcctaccgagaacgactaaacttacccaaaagaccaaccgtcttacgtttctaacaaagtacgaactacgcctaaggacgacgccgaatcgaacccgtacgggtccgttagttattaccgtggtacggacggaagacgggtacggtaccgggggaccccaaacgggttaaccgttaacctaccggtaccgttaaggtcgggtaccggtcgggtacgggggaacccgaaacgggggtacccgtaacccggg

SEQ ID NO: 382451 - DNA, 638 bp, Homo sapiens
  misc_feature: GZ8MTXP02HAKX7.13.76.G10.1.454.CMB.2.raw
  modified_base (243)..(243): a, c, t, g, unknown or other
  modified_base (245)..(245): a, c, t, g, unknown or other
  modified_base (255)..(255): a, c, t, g, unknown or other
  modified_base (260)..(261): a, c, t, g, unknown or other
  modified_base (301)..(301): a, c, t, g, unknown or other
  modified_base (306)..(306): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcgtggtttcgtgtagctatttaaagtgccagtgtgagtgcagctggtggagtcgtgggaggaggcttgatccagccgtggggggtccctgagctctctgtgcncnctcgtcgtcncgtcnncacacacagtgcgcgtcggccgccgcgcgcggagggaggngtggngtcgtcgttcttactttattagttagtagtaggttacgtacctacgtaccgtcgacgacgtaccgtcggtcgggtacgggtaccgtacgtaccacctactacctacgacgaacgtaactaactaaccgaaacgaaccgtaccgttacgttacgtttacttaacgtaaacgtaacgtaaacgacgtacgtacgacgacgtacgtacgtacgacgtaccggtacgtacgttacgttacgtacgtcgtacggacggaggtacggtaccggaaccgtaaccgtaacgtaacgtacgtcgtacgtacggtacggtacggtacggaccggacggaccg

SEQ ID NO: 382452 - DNA, 653 bp, Homo sapiens
  misc_feature: GZ8MTXP02GRT6V.13.76.G10.1.454.CMB.2.raw
  modified_base (446)..(446): a, c, t, g, unknown or other
  modified_base (479)..(479): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttccaccgtcagtcacacctacatgagcgtcgggtcccgccgagggcctccggaggggaacggggcgtgggagtcgcgttcttcttttattagtagttagtgtagtacatactcgcagcgtccgtgggacggggcctatcacctatcctaccgaagacgaaactaacttacccgaaagtaaccncggtctttatttaccttaacaaaattcgaaacncgtcctaggaacggacgaccgaatacggaaccgtaccgggtccgttagttaaacttcgtggtacggacggtaggaacggtaggtcccgggggaacccctaacgggttaaaaccgttaacgttaaccggaccgtttaaggccgggtacggttaccgggtacgggggaaaccccgg

SEQ ID NO: 382453 - DNA, 788 bp, Homo sapiens
  misc_feature: GZ8MTXP02I8AO9.13.76.G10.1.454.CMB.2.raw
  modified_base (301)..(301): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccgagccgtgggggtccctgagtactctcctgtgcagcctcgtggtcaccgtcagtcacacctacatgacgcgtcgggtccnccgaggcctccggaggggaaggggcgtgggagtgtcgttctttcgtttttattagtagttaggtaggtacgtacacttaccgtccgacacgtaccgtccgggtagggaaccgggggtcctacttccaacctacttccctaccgaaacggaacgtaaacctaaacgtttaacccgaaaacgtaaaccctacggttaccttttacgttttaaccttaactaaaaacggttcgaaaaccgtaccggtacccgttagggaaccgggtaaccgtacccgaaagtaccgggaaacccgtaacccggggtcccggtttaaggttaacgtttaacgttcgggtaagtaccgggaaggggtaacggtaaccggggttacccgggggacccccgtaaaaccggggttaaacccggtttaacccgtaaacgggttacccgttaaggtaccggggtaaacccggggtttcgggtaacccggggggtaaaacccccgggg

SEQ ID NO: 382454 - DNA, 554 bp, Homo sapiens
  misc_feature: GZ8MTXP02IFUMF.13.76.G10.1.454.CMB.2.raw
  modified_base (392)..(392): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagcctggggggtccctgagactctcctgtgcagcctctgggttcaccgtcagtcacacctacatgagctgggtccgccaggctccagggaaggggctggagtgcgtctctttttattatagtagtgtagtaccatactcgcagactcgtgaggggccattcaccatctccaganacaatacaagaacacactcgtttctttacaaataagaaacaacgaccgtacgagacgacgacgtacgacgacggcgtagtattacgtgtgcgagagacgacgggaccgacgtaacgtaacgtacgtaacgtacgtacgtacgtacgtcggacgaacggaccg

SEQ ID NO: 382455 - DNA, 674 bp, Homo sapiens
  misc_feature: GZ8MTXP02G9SV8.13.76.G10.1.454.CMB.2.raw
  modified_base (249)..(249): a, c, t, g, unknown or other
  modified_base (299)..(299): a, c, t, g, unknown or other
  modified_base (388)..(388): a, c, t, g, unknown or other
  modified_base (409)..(409): a, c, t, g, unknown or other
  modified_base (544)..(544): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctattttaaaaggtgcccagtgtgaggtgcagctggtggagtctgggaggaggcttgatccaggccgtggggtccctgagctctctgtgcncgcctcgtgggttccacgtcacgtcaccactacagtgagcgtgggtcccnccgaggcctaccggaggggagggctagggagtcgcgtttctttactttttaagtttagtaaggttagtcggttaagtaccctattaccnccgacacggtcccgttcgggnggggacgggcctacgtcccacctacgtcctacgaacggtaacaacctaacttaccgaaaagtaaccctacggttacctttcggtttaaccttaaacaaaatcggtaaaccaggtccctaggacgaaccgtcgaancggaaccgacggtcgttagttacttacggtgtacggactaacggaggtacggtccgggaacccttaaacggtaccttaaccgcgtaacgtagtacgggtaccgtcgggacgggacccgaaaggtaccccg

SEQ ID NO: 382456 - DNA, 602 bp, Homo sapiens
  misc_feature: GZ8MTXP02GMCML.13.76.G10.1.454.CMB.2.raw
  modified_base (267)..(267): a, c, t, g, unknown or other
  modified_base (295)..(295): a, c, t, g, unknown or other
  modified_base (522)..(522): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctctgtgcagcctcgtggttcaccgtnagtcacacctacatgagcgtcgggtccncgaggcctccgaggggaaggctggagtgccgttcttcttttatttagtagttgtaggtatacccgtataccgtccgacacgaccgttcggtgggacggggccgtattccgaccatcctacgagtacgaactaactaccgaaacactaccgctttgtttaccttacaaaagtcgaaacctgaccttgggacgacgccggatacgacgaccggtcgtagtactttacgnggtgacggtaggagacggtacggaccctaacgtaacgttacacgtaagtacgcggtacgtcgggacggtacggacggccg

SEQ ID NO: 382457 - DNA, 606 bp, Homo sapiens
  misc_feature: GZ8MTXP02I46G7.13.76.G10.1.454.CMB.2.raw
  modified_base (492)..(492): a, c, t, g, unknown or other
  modified_base (521)..(521): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtctggaggaggcttgatccagccgtggggggtccctgagtactctcctgtgcagcctcgtcgggttcaccgtcagtcacacctacatgagcgtcgggtccgccgaggcctaccgagggaagggctggagtgcgtcttcttttattatagtgtgtagtacatacctccgacagacctcggtggacggggcccgtattccgacctatcctaccaagacgaactaacgttaccgaaaagaacctacgtcttagtttccttaacaaagtagaaacgagccgtagagacgaccgtaanacggaccgacggtccggtattacgttacngtgacgagacgacgtccggggaccctacggtaaacgttctagccgttaaggtcggacggtcgtacggggaccgaacgggtacccg

SEQ ID NO: 382458 - DNA, 531 bp, Homo sapiens
  misc_feature: GZ8MTXP02ISW1Z.13.76.G10.1.454.CMB.2.raw
  modified_base (330)..(330): a, c, t, g, unknown or other
  modified_base (393)..(393): a, c, t, g, unknown or other
  modified_base (395)..(395): a, c, t, g, unknown or other
  modified_base (402)..(402): a, c, t, g, unknown or other
  modified_base (408)..(408): a, c, t, g, unknown or other
  modified_base (410)..(410): a, c, t, g, unknown or other
  modified_base (416)..(416): a, c, t, g, unknown or other
  modified_base (419)..(420): a, c, t, g, unknown or other
  modified_base (422)..(422): a, c, t, g, unknown or other
  modified_base (424)..(424): a, c, t, g, unknown or other
  modified_base (426)..(426): a, c, t, g, unknown or other
  modified_base (434)..(434): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctctgggttcaccgtcagtcacacctacatgagctgggtccgccaggctccgaggggaagggctggagtgcgtcttnttttattatagtagtagtagtacatacctcgcagactccgtgagggccatcaccatctcagananatacaanacactntnttctanaannanancnagagacanagacgacgcgtagtatatgtgacgagagacgtacggaccgacgtaacgtaacgtacgtaacgtacgtacggtacgtacggtacggacgaacggaacg

SEQ ID NO: 382459 - DNA, 622 bp, Homo sapiens
  misc_feature: GZ8MTXP02ISQ83.13.76.G10.1.454.CMB.2.raw
  modified_base (171)..(171): a, c, t, g, unknown or other
  modified_base (239)..(239): a, c, t, g, unknown or other
  modified_base (295)..(295): a, c, t, g, unknown or other
  modified_base (527)..(527): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagcccaccctnagtgtcccgtgtccccaggacagacagccagcatcacctgctctaggaaataatggacagaataaatntacttctggtatcagcagagtcaggccagtcccctgtgctggtcatctatcgaagntcgaccaagcccgccctcgagggactcccccgtagacgcgtattctacgtcggcctccaacgtccgtagggaacccttacgaaaccctacttcgtacgaccctactccgaacggcccgggaacccgacggaccttagtcgggagtcggaagggtcctaggtaaccttagtttaccgtggtaccgaacgggtcggtagggacgaacggccgaagccgtacgtccggccccgtnttacgttcggtaccgttacggaaaccggttccgggaaaccgtaacggttccgaaacccgttacgtaaacggtaccaaccggacccgaaaccccgg

SEQ ID NO: 382460 - DNA, 608 bp, Homo sapiens
  misc_feature: GZ8MTXP02JVCI2.13.76.G10.1.454.CMB.2.raw
  modified_base (569)..(569): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttaattttaaaaggtgcccagtgtgaggtgcagctggtggagtcgtgggaggaggcttgatccagccgtgggggtccctgacgactctcctgtgcagcctcgtcggtcaccgtcagtcacacctacatgagcgtcgggtccgccgaggcctccggaggggaggggctgggagtgcgttctttcttttattatagtagtggtagtacatacctcgcagcctcggtggacggggctacttaccacctactcctaccagacgaactaactaccaaagaaccacgtcttacgtttactaacaaaatcgaaactaggacctaggacgagacccgaatcgaccgtacggtcgttattactaacgtgcgacggaaggtagacggtccggggaacccacggtaaccgttaccgtacgngtaggtcggactcggaccgggggtaccaaacggggcccg

SEQ ID NO: 382461 - DNA, 583 bp, Homo sapiens
  misc_feature: GZ8MTXP02FSI8M.13.76.G10.1.454.CMB.2.raw
  modified_base (305)..(305): a, c, t, g, unknown or other
tcagtcacgtactacacgaccggtgctcgatttagtcactcatacagggggcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctgggggtccctgagactctcctgtgcagcctctgggttcaccgtcagtcacacctacatgagctgggtccgccaggctccgaggggaagggcnggagtgcgtcttcttttatttatagtagtggtagtacatacctcccgacacgactccgtgacggggccgattcaccatcctaccagagacaaatccaaagaacacgcttgtttctacaaaatgaaacacgcctaggaacgaacgcccgaagttcgaaccgaccggcccgtagtaacttaccgtgtcggacgagagacgtcggggacccaacggtaacgttacacgactacgtacggaacgttcgacgggggacccaagggacccacggtacctacccg

SEQ ID NO: 382462 - DNA, 771 bp, Homo sapiens
  misc_feature: GZ8MTXP02FP30S.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttattttaaaaggtgcccagtgtgaggtgcagctggtggagtcgtggaggaggcttgatccagccgtgggggtccctgagactctcctgtgcagcctcgtggtcaccgtcagtccacacctacatgagcgtcgggtcccgccgaggcctaccgggaaggggaacggggtccgtagggtaggtcggtccgtttcccgtttactttttaagttttaagttaaggttaaggttagggttaacgtaacccctaacgttacctcccgacgtaacggtaacccgttcccgggtggggaccgggggtacccgtaacgtttcccaacccgtaactcccgttacccgaaaggtaaccgaaaccctaaacttaacccgaaaaacgaaacccgtaccgtacgttttacgtttttacccttaaacgaaaacgttccgaaaaccgtacggtaccccgttaggaacggtaccggtacccgaagttaccgaaccgtaccgggtccgttagtaacgttaccgtggtacgacggaaggagtacggtacggggaacccctaaacggtaaaccgttcgtacgcttaaggccgggtaacgttccggaacggggacccgaaacgggtaccccg

SEQ ID NO: 382463 - DNA, 578 bp, Homo sapiens
  misc_feature: GZ8MTXP02GX813.13.76.G10.1.454.CMB.2.raw
  modified_base (293)..(293): a, c, t, g, unknown or other
  modified_base (354)..(354): a, c, t, g, unknown or other
  modified_base (358)..(358): a, c, t, g, unknown or other
  modified_base (366)..(366): a, c, t, g, unknown or other
  modified_base (384)..(384): a, c, t, g, unknown or other
  modified_base (389)..(389): a, c, t, g, unknown or other
tcagtcacgtactacacgaccggtgctcgatttagtcactcatacagggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggttcaccgtcagtcacacctacatgagctgggtccnccaggctccgagggaggggctggagtgcgtcttcttttattatagtatggtataccatacnccgnagactcgngacggggcattcacatcncaganacaatccaaagacacgctgtttactacaaaatgaaacagtccagagacgaccgatagatacggcgttagtacttatgtcgacgaggagacgtacgggggtaccccgaacgttaaaccgtaaccgttaaccgaaccgtaagtacggggtaccggtacgttcgggggaacccggaaacgggggaaaccccg

SEQ ID NO: 382464 - DNA, 561 bp, Homo sapiens
  misc_feature: GZ8MTXP02FGL6G.13.76.G10.1.454.CMB.2.raw
  modified_base (294)..(294): a, c, t, g, unknown or other
  modified_base (356)..(356): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggggttcaccgtcagtcacacctacatgagctgggtccncaggctccgaggggaggggctggagtgcgtctcttttatttatgtagtggtagtaccatacncgcaggactccgtgacgggggccagttccacatctcagagacaacttcaaagaacacgcttgtttcttcaaatgaaacagcctagagacgaccgatgacgacggccgtaggtattaatgtagcgaggagtagtcgggggacccacggtaaacgttacgtaacgcgtaagtcggacgtcggtacggggaccgaacggggaaccccg

SEQ ID NO: 382465 - DNA, 645 bp, Homo sapiens
  misc_feature: GZ8MTXP02IIL28.13.76.G10.1.454.CMB.2.raw
  modified_base (537)..(537): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttcctttgttgcttattttaaaaggtgcccagtgtgaggtgcagcgtggtggagtcgtggaggaggcttgatccagccgtcgggggtccctgacgactctctgtgcagcctcgtcggttcaccgtcagtcacactacatgagcgtcgggtccgccgaggccgtaccggaaggggaggggcgtaggaggtgtcgttctttactttttaatttagtagttaggtaggtagtacctatacctcacagtaccgtccggtgggacggggaccgtacttccaacctctcctacccgagaacgaactaacttaccaaagaacacgtctttgtttactacaaatgaaacctacgacctgaagcgacgagtacgacgtacggtcgttagtatttacgngtacggacgaaggagtacggtaccgggggacccctaacggtaaacgtttaccgacgtcgttaagtacgggtaaccgtcgggtacggggaacccgaaacgggtaccccg

SEQ ID NO: 382466 - DNA, 701 bp, Homo sapiens
  misc_feature: GZ8MTXP02GWL3U.13.76.G10.1.454.CMB.2.raw
  modified_base (280)..(280): a, c, t, g, unknown or other
  modified_base (297)..(297): a, c, t, g, unknown or other
  modified_base (397)..(397): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttgactgagctgggttttccttgttgctattttaaaaggtgcccagtgtgaggtgcagctggtggagtcgtggaggaggcttgatccagccgtgggggtccctgagactctcctgtgcagcctcgtggttcaccgtcagtcacacctanagtgagcgtcgggtccnccgaggcctaccggaggggaaggggctaggagtcgcgtttctttctttttattagtagttagtaggtacgtacctactacctccgacagtaccttccggngggcgggacctattccacctatcctaccgaagacgtaacctaacttaccaagaacccgtcgtacctttgtttacctacaaaatcgggaaaacctggacctaggacgacgtaccgaagccggaacgtacccggggtaccgttaggttaactttaccggtggtacggaccggtaaggagggttaccggtccgggggaaacccctaaaacgggttaaccggtttaaccacgggttaacgttaaaacggtcgggggtaaacccgttccggggtaccgggggtaacccggaaaaccgggtttcccccgg

SEQ ID NO: 382467 - DNA, 711 bp, Homo sapiens
  misc_feature: GZ8MTXP02HOYKU.13.76.G10.1.454.CMB.2.raw
  modified_base (304)..(304): a, c, t, g, unknown or other
  modified_base (329)..(329): a, c, t, g, unknown or other
  modified_base (379)..(379): a, c, t, g, unknown or other
  modified_base (390)..(390): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctattttaaaaggtgccagtgtgaggtgcagcgtggtggagtcgtgggaggaggcttgatccagccgtgggggtccctgagactctcctgtgcagcctcgtggtcaccgtcacgtcaccacctacatgacgcgtcgggtccgccgnggcctccggaggggaggggcgtggngtcgtcgttctttctttatttagtagttagtaggtacgtacatactccgntacgacgtcgngggacgggtccgtattcccgacactcctaccgaagaacgaaacctacttaaccgaaacgtaaccgtaccggtcctttagttttacccttaagaaaacgttcgaaaaccgtcgtacccgttaggaacggtaccgacccggtaagtaccggaacccggaacgggtcccggttagttaacgtttacgtcggtaggacgtaagggacggtaaacggtcccgggggtaaacccctaacggggtaaaccgtttaccgtaccggtaacgttaacgggtacgggtaccgggtacgggtcgggggaacccgaaaacgggggtacccccgg

SEQ ID NO: 382468 - DNA, 693 bp, Homo sapiens
  misc_feature: GZ8MTXP02G9TR6.13.76.G10.1.454.CMB.2.raw
  modified_base (375)..(375): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtctgggaggaggcttgatccagccgtgggggtccctgagactctcctgtgcagcctcgtggtcaccgtcagtcaccacctacatgagcgtcgggtccgccgaggcctccggaggggaaggggcgtggagtgtcgttctttcttttattatagtagtggtataccattacctccganacgtaccgtccggtgggacggggcctaacttccgacctactccctccgaaagacaaacctaacttacccgaaaagaaaccctcggtactttacgtttaccttaacgaaaattaccggaaaactcggtacccgtaggaacggacggtaccccgaaagtccggaaaccgtaccgggtaccgttagttacttaaccgtgggtacgaaccggaggaacggtacgtaccgggggaccctaaccggtaaacggttaccaaccgggtctaaacggtcgggtaaccggttcggtaaccgggggaccccgaaaacggggtcccccgg

SEQ ID NO: 382469 - DNA, 697 bp, Homo sapiens
  misc_feature: GZ8MTXP02HUQ17.13.76.G10.1.454.CMB.2.raw
  modified_base (316)..(316): a, c, t, g, unknown or other
tcagtcacgtactacacgaccggtgctcgatttagtcactcatacagggggggagagggagcccagcactgggattccgaggtgtttccattcggtgatcagcactgaacacagaggactcaccatggtagttttggctgagcgttgggttttccttgttgcttaattttaaaaggtgcccagtgtgaggtgcagcgtggtggagtcgtgggaggaggcttgactccgaggcccggttcggggggtccctggacgacctctccgtgtgcacgcctcgtcggtcaccgtcacgtcactactacatgagcgtcggccncgaggccgtacggagggagggcgtggagtcgtcttctttactttatttagtagttaggtagtacgtactactacctcgacacgccgtcgggtggaccggggtctacttccacctactcctaccagaactaacctaataaccgaaagaactacgttcgtttactttacctaacaaaagttacgaaaccgttacgacgttaacgaggtaccgtacggacgtacggacccgtaaccgggtccgttaaacgttagtttaaccgggcggtaacggtacggaaacggtacgggaccgggtacccgggtaaacccgtaaacgttaaaccgttacgacgtaacgtacgtaccggtacggtccgggaaccggaaccggaaccggtacccg

SEQ ID NO: 382470 - DNA, 753 bp, Homo sapiens
  misc_feature: GZ8MTXP02G9G00.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagcgtggtggagtcgtgggaggaggcttgatccagccgtgggggtccctgagactctcctgtgcagcctcgtggttcaccgtcagtcacacctacatgagcgtcgggtccgccgaggccgtaccggaaggggaacggggtcgtagggacgtcggtccgtttcttttacgtttttaacgtttagttaaggttaggttagggttaaactaccgtacgttacctacccgacgtacggtaccgttccgggtcggggaccggggtaccctacgtttacccgaaccctagtaccctacccgaagaaacgtaacctaacgttacccaaaggtaacccacgttaccgttgttttaccttaacaaaacgttacgaaaaccgtacgtaccgtacggaagacgacccggaagtacgaacccgtaccgggtccgttagttacttacgtcggtacgtacggaacggtacggtaacggtaccgggggaaccccttaaacgggtaaacccgtttacgtaccgtaacgttaacggtcggtaaccggtcgggtaccggggaacccgaaacggggtaaccccg

SEQ ID NO: 382471 - DNA, 653 bp, Homo sapiens
  misc_feature: GZ8MTXP02FLH9X.13.76.G10.1.454.CMB.2.raw
  modified_base (372)..(372): a, c, t, g, unknown or other
  modified_base (464)..(464): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtgggaggaggcttgatccagccgtcgggggtccctgagactctcctgtgcacgcctcgtgggttcaccgtcagtcacacctacatgagcgtcggtccgccgaggctccggaaggggacggggcgtaggagtcgcgtcttcttttatttagtagtagtgtatacctatacncgcacgctcggtcgggcgggcctagtccacctatcctaccaagacgtacaaacgttaccgaaagaacctacgcgtttatttacccttaaaanaaacgtacgaaacgtacgtaccgtagaacgacgaccgtagtaccggaccgtaccggtacgttagttaacgttacgtcggacgacggaagtacggtacgggtaccgggaacccgtaaaccggttaacgtacgtaccgtaagttaacggtacggtacgggtaccggacgggaaacccggaacgggtacccg

SEQ ID NO: 382472 - DNA, 579 bp, Homo sapiens
  misc_feature: GZ8MTXP02ID2JB.13.76.G10.1.454.CMB.2.raw
  modified_base (356)..(356): a, c, t, g, unknown or other
  modified_base (384)..(384): a, c, t, g, unknown or other
  modified_base (401)..(401): a, c, t, g, unknown or other
  modified_base (439)..(439): a, c, t, g, unknown or other
tcagtcacgtactacacgaccggtgctcgatttagtcactcatacaggggggagaggagcccagcactgggattccgaggtatttccattcggtgatcagcactgaacacagaggactcaccatggagttttggctgagctgggttttccttattactattttaaaggtgtccagtgtgaggtgcagttggtggagtctggaggaggcttggtccagccgtgggggtccctgagactctcctgtgcagcctctgggttcaccgtcagtcacacctacatgagcgtgggtccgccgaggctccgaggggagggctggagtgcgtcttcttttatttatagtagtggtagtacatacncccgacagactccggtggacggggcctnttccacatcctccaganacaattaccaagaacacgctgtttcttacaaatgaacngcctgagacgccgatgacacggccgtagtattacgtgtgcgagagacgtcgggggacccaacggtaaacgttacacgcgttagcggaaccggttcgtacgggggaccctaaacggggacccgtaacggtaccctacccgg

SEQ ID NO: 382473 - DNA, 599 bp, Homo sapiens
  misc_feature: GZ8MTXP02JFUYK.13.76.G10.1.454.CMB.2.raw
  modified_base (261)..(261): a, c, t, g, unknown or other
  modified_base (500)..(500): a, c, t, g, unknown or other
  modified_base (521)..(521): a, c, t, g, unknown or other
  modified_base (561)..(561): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctctgtgcagcctcgtgggtcncgtcagtcacacctacatgagcgtggccgccaggcctaccgaggggacggggcgtaggagtgtcgtctttctttatttatagtagtggtagtacatacgtccacgacgactcggtcgggacgggggcctacgttccaacctactacctacccgaagtacgaaactaaacttacccgaaagtaaccaacgtcttacgtttactaccgaaaattagaaactggacctagagacgccgtaanacgacgacggtactgtatagngagacggagagacggtcggacctaacgtaacgtacacgtntacggtacggtacggtcggacgggaaccgacggtaccg

SEQ ID NO: 382474 - DNA, 637 bp, Homo sapiens
  misc_feature: GZ8MTXP02JSYKZ.13.76.G10.1.454.CMB.2.raw
  modified_base (217)..(217): a, c, t, g, unknown or other
  modified_base (252)..(252): a, c, t, g, unknown or other
  modified_base (278)..(278): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcacgcccaccctcagtcgtccgtcgtccccaggacagacagccagcactcacctgctntagaaataatggacagaataaatatacttctgtancagcagagtcaggccacgtcccctgngctgtcatctatcaagatcgaccaaggccgccctagacgggactcccccgtagacgtcgtacttccgtacgtccgggccttacccgtaaacgtccggttacgggggaaccctccgaacgtcccgtaactccgtacgaaccctacgtaccgaaccgggtaccggggaccccgagggtacgtaggtacgggaacgttacgggaggtacttaggttatttaactttacggtagtccggagggtacgggtacggacgacggccgacggcctaccgtccgtaccgtacgttacgtcggttacgttaccggacgtacggggaacctacggtacctaccggtaccgttacgacccgacgaaccccg

SEQ ID NO: 382475 - DNA, 573 bp, Homo sapiens
  misc_feature: GZ8MTXP02FKWS7.13.76.G10.1.454.CMB.2.raw
tcagtcacgtactacacgaccggtgctcgatttagtcactcatacagggggggagaggagcccagcactgggattccgaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcatgggtccggcaagctccaggggaaggccgtggagtgggtctcaggtattagtggaataggtgagcataggctatgcggtactgtgtaggaagggccgaattcaccgatctcagagacaaaccgcaaagaacctccctagtactctgacaaaatcgaaacacgccagagacgcgtagaaggaccgaacggtccttaggtactttaattaggtacgaaactaaaaggacctaaccctaaaacccccgtttacgtacgtttttaggatttacggtaacgtttaaacccgggg

SEQ ID NO: 382476 - DNA, 558 bp, Homo sapiens
  misc_feature: GZ8MTXP02HDS2Z.13.76.G10.1.454.CMB.2.raw
  modified_base (415)..(415): a, c, t, g, unknown or other
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttcctggtatccagcagaagtcaggccagtcccctgtgctggtcatctatcaagatgccaaagccggccctcgagggctcccccgtgagcgattcgtctgggccttccaaacttccgtggggaaacctcgacgccaccttcgtcaccactcgagaccgggacccagggacctagnggataggacggcgtaggtacctagttactcgtacgacgggtcggtaggacgaggcaaggctaacgtcgacccgtcttaacgtcgtacgttacggaacgtcggaacgaaacggtctaacccggtactaacgtcgaacgaccccg

SEQ ID NO: 382477 - DNA, 722 bp, Homo sapiens
  misc_feature: GZ8MTXP02JXJ5Y.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactaaccatggagttttggctgagctgggttttccttgttgctattttaaaaggtgcccagtgtgaggtgcagctggtggagtctggaggaggcttgatccagccgtgggggtccctgagactctcctgtgcagcctcgtggtccaccgtcagtcacacctacatgagcgtcgggtcccgccgaggcctaccggagggggaacggggctgggagtgcgttctttactttttatttagtagttagtggtagtactactacctccgacacgtacctccggtgggacgggggtaccgtacttaccgaccctacttccgtacccgaaagaaccgtaaacctaaactttacccgaaaagtaaccctaaccggttctttacggttttaccttaaaccgaaaaattcggaaaaacctggtccctaaggagaccgaccgagttacgaaccgaccgggtccgttagttacttaacgtggtacgacggaaaggacgtaacgggtccgggggaaccccctaaagggttaaaccgtttaaccgaccggtacttaacgggtacgggtaccggttaccggtacggggggaaccccaaaacgggggccccttaacccgggg

SEQ ID NO: 382478 - DNA, 743 bp, Homo sapiens
  misc_feature: GZ8MTXP02JYEMB.13.76.G10.1.454.CMB.2.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgactccgacgccggtcggggggtccctggacgacctctcctgtcgcacgtcctcgtcggtccaccgtcacgtccacacctacatgacgcgtcggtccgcgacggcctccggaggggaacggggcgtaggggtaggtcggtaccgtttcgttttactttttaagtttagttaaggttaggttaggttaacgtaccgtactaccgtccgtacgacgtaccgttccggtggggacggggtccgtacttaccacctactcctaccgaaagacgtaaactaacttaccgaaacgaacccgtacgtcttacgtttactacgaaattacgaaactcgccgttaggacgtacgaccgtacgacgaccgtacggtaccgttagtaccgtttagtggtacgtacggaacggaagggccgggtaacccggggaaccccgtaaacgggtaaacccgtttaacgttaacccggtaacgttaacggttaccggggaccggttaccggggtaaccgggggtaacccgggaaccgggtaacccccggg

SEQ ID NO: 382479 - DNA, 707 bp, Homo sapiens
  misc_feature: GZ8MTXP02GHBP8.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggaggaggcttgatccgagccgtgggggtccctgacgactctcctgtgcacgcctcgtcggttcaccgtcagtcacacctacatgagcgtcggtccgccgacggcctaccggaggggaaggggcgtagggagtcgtcgttctttactttttaatttagtaggttaggttggtaacgtactaattaccgtccgacgaacggtccgtaccggtggggtacgggggtacctacgttaccacctactcccgtaccgaaagtaacgaacctaaacttaacccgaaaacgaaaccgtccgttaccgtttcgttttaaccttaactaaaaacgttacgaaaaccgtacggtacccgtagggaaaggaccgacccggtaagtcggaaccgtaccggtccgttagttaacttacgtaggtacggtacgagaggtacggtaccggggaaccctaacggtaacgttaacgtacgtacgttacgtacggtacgtacgggtcggggaaacccgg

SEQ ID NO: 382480 - DNA, 609 bp, Homo sapiens
  misc_feature: GZ8MTXP02FHUTQ.13.76.G10.1.454.CMB.2.raw
  modified_base (259)..(259): a, c, t, g, unknown or other
tcagtcacgtactacacgaccggtgctcgatttagtcactcatacagggggggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctgggggtccctgagactctcctgtgcagcctctgggttcaccgtcagtcacacctanatgagctgggtccgccaggcctccgagggacgggctggagtgcgtcttcttttatttatagtagtggtagtacataccgtccgcagacctcggtagacggggccattccacctatcctccagacaactaacgttaccaaagaaccacgtcttgtttacttacaaaatcgaaacacgcctagaagcgaccgatcgacgacggccgtagtacttacgtgtacgcgtagagtacgtcgggggacccctaacggtaaacgttaccgtaacgtccttaaagcggggtaacgtccggtacgggggacccgaaacggggaacccacggttaccgacccgttctcccacgacaccccg

SEQ ID NO: 382481 - DNA, 642 bp, Homo sapiens
  misc_feature: GZ8MTXP02HY2L2.13.76.G10.1.454.CMB.2.raw
  modified_base (251)..(251): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcngcctcgtggttccaccgtcagtcaccactacatgagcgtcgggtccgcaggctaccggaggggaggggctggagtgcgttctttctttttatttagtagttagtggttagtacctatacctccgacacgtaccgttccgggtggggacggggtaccgtactttccaacctactccgtacccaagaacgtacctaaacttacccaaaggaaaccctacggtctttgttttacaacgtaaatagaaacctgtccctagacgacgccgagtacgacgaccggtcgtattaattcgtggcgacgaggaggcgtacgggggaccccaacggtaaccgtttaccagtccgttagtacgggtaccgtcgggtaccggggaacctaacggggacccccg

SEQ ID NO: 382482 - DNA, 683 bp, Homo sapiens
  misc_feature: GZ8MTXP02GEVXH.13.76.G10.1.454.CMB.2.raw
  modified_base (318)..(318): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgccagtgtgaggtgcagcgtggtggagtctgggaggaggcttgactccgaggccggtcggggggtccctggacgtacctcttccgtggtcgcaggtccctcgtggttccaccgtcacgtccacacctacagtgagcgtcgggtccnccgaggccgacggaggggagggcgtggagtcgtcgtttctttacttttatttagtagttaggtaggttaacgtacctacgtaccgtacgcaacgtccgtccgggtggggacggggcctaacttccacctaacgtcctacgaaagtaacgaaacctaaacttaaccgaaaacggtaaaccctacgtccgtttttacgtttaaccctaagtaaaacgtcgaaaaccgacgtccgtaggagtaaccgcccggtaagtaccgacgtaccgggtaccttgttatacgtgcgaacggaggacgcgtaccggacgtaaccgtaacgtccgagtcgacggtcggaccgtcggtacgggaccgtaacggacccg

SEQ ID NO: 382483 - DNA, 569 bp, Homo sapiens
  misc_feature: GZ8MTXP02FP8AV.13.76.G10.1.454.CMB.2.raw
  modified_base (364)..(364): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctggggtccgccagggcctccgaggggaaggggctggagtgcgttcttcttttatttatagtagtggtagtaccatacnccgcagactccggtggaggggccgattccaccatctccagagacaattccaaagaacacgcttgtttctacaaaatcgaaacagcctaggagacgccgatcgacacggtcgtgtattactgtgacgagagacgtcggggaccccaacgtaacgttactaccggctagtcggtacggtcgtacgggggaccgaacgggtaaccccg

SEQ ID NO: 382484 - DNA, 707 bp, Homo sapiens
  misc_feature: GZ8MTXP02GCZP5.13.76.G10.1.454.CMB.2.raw
  modified_base (170)..(170): a, c, t, g, unknown or other
  modified_base (247)..(247): a, c, t, g, unknown or other
  modified_base (266)..(266): a, c, t, g, unknown or other
  modified_base (294)..(294): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttgctgagctgggtttccttgttgctattttaaaaggtncccagtgtgaggtgcagctggtggagtctgggaggaggcttgatccagccgtggggggtccctgagactctcctgtncagtcctgtggtcaccgtnagtcacacctacatgacgcgtgggtccncgaggcctaccggaggggaagggctagggacgtggtccgttcgttcttttatttagtacggttaggtggttagtactactaccgtccgacagaccttccggtgggcggggacctagttccacctacgtcctaccgaaggaactaacctaattaccccgaaaaggtaacccgacccggtcgttttacgtttcccttaaaacgaaacgtcggaaaccgtcggaacgtacggacggtaccgaacgtacgtaaccggaccgtacgggtacttagttacgttacggtaggacggtaacggaacgtacgggtaccggtacccgggtaaaccctaaacggttaaacccgttacaacggtaacgttaacggtacgggtaccggtaccgggtaacccgggggaaaccgtaaccggggtaccg

SEQ ID NO: 382485 - DNA, 751 bp, Homo sapiens
  misc_feature: GZ8MTXP02JZJXT.13.76.G10.1.454.CMB.2.raw
tcagtcacgtactacacgaccggtgctcgatttagtcactcatacagggggggagaggagcccagcactgggattccgaggtgtttccattcggtgatcagcactgaatacagaggactcaccatggagttttggctgagctgggttttccttgttgctattttaaaaggtgccagtgtgaggtgcagctggtggagtctggaggaggcttgatccagccgtgggggtccctgagactctcctgtgcagcctcgtggtcaccgtcacgtcacacctacatgacgcgtcgggtccgccgaggccgtaccggaaggggaacggggcgtagggtaggtcggtccgtttctttcgttttttaagtttagttaaggttaggtaggttaacgttaaccctaacttaccgtccgactacgtacccgttccgggtggggaccgggggtacccgtacgttacccaacccgtacttacccgtacccgaaaggaacgtaaacctaaacgtttacccgaaaaacgtacccgtacgtccgttttacgttttacctaacaaaagttacgaaaccgtcgtacccgtaagacggtagacccggtaagtacccggaaccgtacccggtccggttaagttaccttacggtggaccggtaacggtaggacggtacgggtacccggggacccgtaaccgtaacggtttaaccacgtcgtaacggtcgggtaccggttcgggtaccgggggaccgtaaccgggggtaacccg

SEQ ID NO: 382486 - DNA, 657 bp, Homo sapiens
  misc_feature: GZ8MTXP02J3FAG.13.76.G10.1.454.CMB.2.raw
  modified_base (372)..(373): a, c, t, g, unknown or other
  modified_base (383)..(383): a, c, t, g, unknown or other
  modified_base (398)..(398): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagccttcgtgggtccaccggtcagtcaccacctacatggacgcgtcgggtccgccgaggcctccggaaggggaggggtctggagtcgtcgtcttcttttattatagtagtgtagtacatctcgnngactcgtggngggcctatcacatcncagacactactacaagtaaccgtctagtttctacgaatcgaactagcctaggagtacgccgaatcggaaccgtacggggtacctttaggtaacctttagtacggtacggaccggaaaagggtaccggtacggggttacccgggggacccctaacggggttaaaacccgttttaaccgaacccgggtaacgttaaacggggtccggggtaccgggtttaccgggtaccgggggtaacccggaaacgggggtaacccccgg

SEQ ID NO: 382487 - DNA, 771 bp, Homo sapiens
  misc_feature: GZ8MTXP02GHASN.13.76.G10.1.454.CMB.2.raw
  modified_base (253)..(253): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctaattttaaaaggtgcccagtgtgaggtgcagcgtggtggagtcgtggaggaggcttgatccagccgtgggggtccctgagactctcctgtgcngcctgtggttcaccgtcagtcacacctacatgagcgtcgggtcccgccgtaggcctaccggaaggggaacggggctaggggagttcggcgtttcctttacttttatttagtaggttagtaggtacgtaacctactaccgtccgacacggtacctccggtggggacgggggtcctaacgttccaaccctaattccgtacccaaaggaacgtaaacctaaacttacccgaaaagggaaaccctacggtacctttaggttttacccttaaaacgaaaacgtacgaaaacctacgtaccgtaaggaacgaccggtaccgtaacgtaaccggaaccggtaccggttaccgttaaggttaacgttacggtacggtacggacgggtaaacgggtaacggtaaccggggtacccggggtaaacccctaaaaccgggttaaaccgttaaccggtaaccggtaacgttaacggtaccggggtaccggtaccggggtaaccggggaacccggaaaaccggggtaccccg

SEQ ID NO: 382488 - DNA, 593 bp, Homo sapiens
  misc_feature: GZ8MTXP02HZ1R5.13.76.G10.1.454.CMB.2.raw
  modified_base (381)..(381): a, c, t, g, unknown or other
  modified_base (451)..(451): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccaggccgtggggggtccctgagactctcctgtgcagcctcgtgggttcaccgtcagtcacacctacatgagcgtgggtcccgccgaggcctccgaggggaaggggcgtggagtggtcgtcttctttttattatagtagtggtagtaccatactccgcagactcgnggaggggcacgttcaccatctccagagacaagttaccaaagaacacgtcttgtttctacaaatcgaaacncgcctaggagacgaccgagtacgacgaacggccgttagtagttacgtggtcgacggagtaggacgtcgggggacccaacgttaaccgttaacgtcgaacgttaagtcggaccgtcggtaccggggccgaaaacgggggcccg

SEQ ID NO: 382489 - DNA, 650 bp, Homo sapiens
  misc_feature: GZ8MTXP02GBGFR.13.76.G10.1.454.CMB.2.raw
  modified_base (250)..(250): a, c, t, g, unknown or other
  modified_base (513)..(513): a, c, t, g, unknown or other
  modified_base (579)..(579): a, c, t, g, unknown or other
  modified_base (617)..(617): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcngcctgtggtcaccgtcagtcacacctacatgagcgtcgggtcccgccgaggcctaccggaaggggaacggggcgtgggagtcggtcgtttctttacttttagtttagtagttaggttggttaacgtacctagttaccgtccggtacgtaacggtaccgttccgggtggggaccgggggtaccctacgtttaccaacctactcctacccgaagacgtaaacctaacttacccgaaagtaaccgacgtcttacgttttaccctanaaaagttcgaaaacgtcgaccgtaggacgacgacccgtatacgaccgtacggcgttatattcgtgngacgtagagcggtacggaccctaacggtaactctacgngtagtggacgtcgacgggaccaacgggtacccg

SEQ ID NO: 382490 - DNA, 582 bp, Homo sapiens
  misc_feature: GZ8MTXP02IZ935.13.76.G10.1.454.CMB.2.raw
  modified_base (416)..(416): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtcgtccccaggacagacagccagcatcacctgctctagaaataattggcagataaatatactctgtatcagcagagtcaggccacgtccctgtgctggtcatctatcaagatcgaccaagccggccctcgacggtctcccccgtgacgcgtacttcgtccgtcggtcctaccctaacgtcgtacgggtaacctcacgcccacgtctacgacactcgacgaccggtacccaggcgtagnggagtaggacggtctagtacttagtacgtagtacgaggacggtaggacacggacgacgccgacgtcggacccgtcgtacgttcggttaccgtaccgggtaaccgtacgggtaaccgtaaccggtaccgtaacccgtttaccgacggttacccgaacggaacccccg

SEQ ID NO: 382491 - DNA, 626 bp, Homo sapiens
  misc_feature: GZ8MTXP02IST5C.13.76.G10.1.454.CMB.2.raw
  modified_base (284)..(284): a, c, t, g, unknown or other
  modified_base (317)..(317): a, c, t, g, unknown or other
  modified_base (358)..(358): a, c, t, g, unknown or other
  modified_base (367)..(367): a, c, t, g, unknown or other
  modified_base (412)..(412): a, c, t, g, unknown or other
  modified_base (448)..(448): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggaggaggcttgatccagccgtggggggtccctgagactcctcctgtgcagcctcgtcggttcaccgtcagtcacacctanatgagcgtggccgccaggctcgagggacggcgnggagtgcgtcttcttttattatagtgtgtagtaccatctcncagactcgngggaggggcctattcaccatcaccaagcaaccaattcccgaaaanaactcgtcttacgtttactaacaaagtacgaaaccncgtacgtaaggacgacgtaccgtaagaccggaaccgtccgggttacgttacgtactttacggtggtacggacggaaggtacggacgggtacccggggaacccgtaaacggtaaacccgttacgacgtaacgtacggtaccggacggttaccggggacgggaaccggaacgggtacccg

SEQ ID NO: 382492 - DNA, 693 bp, Homo sapiens
  misc_feature: GZ8MTXP02GF7NE.13.76.G10.1.454.CMB.2.raw
tcagtcacgtactacacgaccggtgctcgatttagtcactcatacaggggctgggagaggagccagcactgggattccgaggtgtttccattcggtgatcagcactgaacacagaggactcaccatggagttttggctgagctgggttttccttgttgctattttaaaaggtgccagtgtgaggtgcagctggtggagtcgtggaggaggtcttgactccgaggccggtggggggtccctgacgactctcctgtgcacgtcctcgttcggttccaccgtcacgtcaccacctacatgacgcgtcgggtccgccaggcctaccggaggggagggcgtggagtcgtcgttcttttctttttaatttagtaggttagtacggttaagtactactacgtccgacgacgccgttccgtaggggacggggtcctacttccgaacctacgtccctacgaaggtaacgaaccttaaacgttaacccgaaaagtaacctacggttctttacgttttaccaaataaaacgttacgaaaaccgtcgtccgtaggaacggaccgacccgtagtacgaaccgtacggtcgttagttacttcgtggacggacggaggaggtacggggtacccgggtaccctaacggttaaaaccgttcgtaaaccgcgttaaaggcgggtaccggtacgggacggggaaaacccggg

SEQ ID NO: 382493 - DNA, 672 bp, Homo sapiens
  misc_feature: GZ8MTXP02FPXCA.13.76.G10.1.454.CMB.2.raw
  modified_base (290)..(290): a, c, t, g, unknown or other
  modified_base (511)..(511): a, c, t, g, unknown or other
  modified_base (569)..(569): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctccgtgtcgcacgtcctcgttcggtccaccgtcagtaccaccacctacancgagtcgtcgggtccgccgacggcctcggaaggggaggggtcgtggagtcgtcgtctttacttttatttagtagtacggtaggtacgtaacctacttaccgtccgacgtacgtaccgttcggtggggacgggccgtactaccacctactcctacgaagactaacctaacgtaccgaaagaacctcgtcttttcgtttaacctaacgaaaagttcgaaaacncgtacctagggaacgcgtacccgtagacccgacgtcgggtactttagtacttacgggnggtacggacgtaggacggtaccgggtacccggaacctaacggttaaccgtaacgtcgtaagttacggacgggtacgtccggggaccggaaccggaccggaccg

SEQ ID NO: 382494 - DNA, 587 bp, Homo sapiens
  misc_feature: GZ8MTXP02G214Y.13.76.G10.1.454.CMB.2.raw
  modified_base (377)..(377): a, c, t, g, unknown or other
  modified_base (392)..(392): a, c, t, g, unknown or other
  modified_base (419)..(419): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtctggaggaggcttgatccagccgtgggggtccctgagactctcctgtgcagcctcgtgggttcaccgtcagtcacacctacatgagcgtcgggtccgccgaggcctccggaaggggaaggggctggagtgcgttcttcttttattatagtagtgtagtacatactcgacagactcgnggacgggctatcacntcctaccagtagaactaataccgaaanaacacgtcttacgtttctaacaaatcgaaacacgcctaggagacgaccgatacgaccgacggtccgtaggttattacgtgtcgacgagaggtacgtccgggggaacccaacgtacctttacgacgcgttagtacggacgtcggtacggggaaccaacggggtaacccg

SEQ ID NO: 382495 - DNA, 625 bp, Homo sapiens
  misc_feature: GZ8MTXP02FT8Y9.13.76.G10.1.454.CMB.2.raw
  modified_base (278)..(278): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagcccaccctcagtcgtccgtcgtccccaggacagacagccagcatccacctgctctaggaaataatggacagtaataaatatacttctgtatcagcagagtcagccacgtcccctgnctggtcattctatacaaagtctacgacccaaggcccggtccccgtacgaacggggtacctccccccgtaggacgtaccgtactttccgtacgtcggtcctaccgaacgttcgtacgggaacctcaacgcccaatcctacgacacgtcaacggccggaccctagaccgtagtaggattggaacgcttacggacttacttacgtgtaccgagggtacggtggggaacaggacgaacgccgaaccgttcggccccgttacgttagttcgttacccggttacgaacggttaaccgggaaccggtacggtacccgtaaaccgttccgtaaacgtcccaacggtaaacccccg

SEQ ID NO: 382496 - DNA, 806 bp, Homo sapiens
  misc_feature: GZ8MTXP02I3S3R.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtgggaggaggcttgactccacggccggtcggggggttccctggacgactcctcccgtgtcgcagcctcgtcgggtccaccgtcagtcacacctacatgacgcgtcgggtcccgccgaggccgtaccggaaggggaacggggtcgtagggaggttcggtccggtttctttacgtttttagttttaagttaggttaggttaggttaacgttaccgaacttaccgtaccgcaaggtacccgttccggtggggaaccgggggccctatttacccgaccctagttccctacccaaagggactaaaccctaaaacgtttaacccgaaaaaacgaacccgtaacggttcccgtttttaactttttacccgtaaaactaaaaacggtcgaaaaacccgtaccggtacccttaaagggaacgaaccggaccccggtaaataccgggaaccccgacggggttaccgttaggtttaaactttccgtggtacggaacggtaggaacggtacgggtaccgggaaccccttaaacgggtaaaccgtttacgtaccgaacgtttacgggacggtaaacccggtcggtaccggggaacccgttaaaacgggtaaccccgg

SEQ ID NO: 382497 - DNA, 685 bp, Homo sapiens
  misc_feature: GZ8MTXP02G0C7K.13.76.G10.1.454.CMB.2.raw
  modified_base (256)..(256): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagcccaccctcagtcgtccgtcgtccccaggacagacagccagcatccactgctctaggaaattaagtggacaagaataaatatacttcctgtatnagtacaagaacgtcaggcctacgtcccctgtcgcgtggtcatctatcaaagctcgaccgaacgtccggacctcggacgggtactcccccgtaggacgtcgtacttccgtccgtcggcccttacctaaacgtccggtacgggaacctcgactacccgtactacgtaccgaccacgaccgaacggggacccgggaaccccgtaaggtcccgttaaagacggggtaacgtacggggtaacggtaccgttaacggttaactttaaccgttacggttaccggtacggtaacgggggtccgggtacggaacgtacggacgtacggcctaacggtccgtacccgtcgttaacgtcggtttacgtaacgggtaaccgttacgggaaaccgttaacggacccgtacgtaaccgttaacgtccgaaccggtaacccccg

SEQ ID NO: 382498 - DNA, 674 bp, Homo sapiens
  misc_feature: GZ8MTXP02H2RCG.13.76.G10.1.454.CMB.2.raw
  modified_base (290)..(290): a, c, t, g, unknown or other
  modified_base (357)..(357): a, c, t, g, unknown or other
  modified_base (366)..(366): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagtttttggctgagcgtggtttcgtgtagctatttaaaaggtgccagtgtgaggtgcagctggtggagtctggaggaggcttgatccagcctgggggtccctgagactctcctgtgcagcctcgtggtcacgtcagtcacactacatgagctgggtcccnccaggctcccgaaggggaggggctagggactggccgttcttcttttattagagtagtcgtagttacntacgtccgnacgtccgtcgtggacgggtctaacttcacctatccctacgaacggactaaccgtaattaacccgaaacgtaaccaccgttacgtttacgtttaccttaacgtaaagttaacgtaaacctacggtaccgtaggaacggacggtaaccgtagtacgaaccggacgggttacccttaggttaacgttacgtcggtacggtaccggaaacggtaggaccggttaccggggaacccgtaaaccggttaaaacccgttaaccgtaacggtaacttacggtacgggtaacccggttaccggggacgggaacccgg

SEQ ID NO: 382499 - DNA, 704 bp, Homo sapiens
  misc_feature: GZ8MTXP02H1PAZ.13.76.G10.1.454.CMB.2.raw
  modified_base (171)..(171): a, c, t, g, unknown or other
  modified_base (350)..(350): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcacgccaccctnagtcgtccgtcgtccccaggacagacagccagcactcacctgcttacgtaggaaaacttaagttggactaagtaaattaaattactacctttccgtaggttaactccgagtaccaaggaacgtccgaagggcccctaacggttccccctggtcgtcttagggtacctagtacccttaanacgtaaacgtacgtaccgaccggaccggccccggtaccgtacggtacggtacctccccgtagtaccgtcgttacttcgtaccgttcgtcctaccgtaacgtccggtaccggtacctaccgtacctacccgtactaccgaccgaacgtacgccggaacccggacccgggaacgtacggtacgtaggagtacgtacggtacgtacgttagttaactacgttacggtaggacggacgggtacggtacgacgacgtacgcgtaccgtcgtaccggtccgtacgttacggttaccgtacggtacggtaacgtaccggtaaccgtacgtacccgtacgtacgaccgtaccaaccgacccg

SEQ ID NO: 382500 - DNA, 727 bp, Homo sapiens
  misc_feature: GZ8MTXP02IIE45.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtctggaggaggcttgatccagccgtggggggtccctgagactctcctgtgcagcctcgtgggttcaccgtcacgtcacacctacatgagcgtcgggtccgccgaggcctaccggaaggggaacggggtcgtgggagtcggcgtttcttacgtttttaatttagtagttaggtaggttacgtaacctacgttacctccgctacgtaccgttcggtgggggaacggggtccgtacttaccaacctactacctcccgaaaggaacaaacctaaacttacccgaaaaggaaccctacgggttacctttacggttttacctttaaacaaaacgtttaacgaaaccgtaacgtcccgttaggaacgtacggacccgaagttcggaaccgtacgggtcctttaggtaaactttccgtaggtacggtacggaaggacggtaacgtccgggggaacccctaaacggtaacccgttaacgtacccgaagtttaacgaccgggtacgtacgggtacgggacccggaaaacgggtaccccgg

SEQ ID NO: 382501 - DNA, 747 bp, Homo sapiens
  misc_feature: GZ8MTXP02JVN9Q.13.76.G10.1.454.CMB.2.raw
  modified_base (317)..(317): a, c, t, g, unknown or other
  modified_base (326)..(326): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagcgtcgggccgccgaggctccgagggagggctggngtgccgttnttcttttattatagtagtggtagtaccatacctccgacagaccttcggtggacgggggcctacgttccgacctactcctaccgagaacgtaactaaacgttaccgaaaaggaaccaccgttcgtttacggtttttaccctttaaacgaaaacgtttacgaaaaccgtacggtaccccgttaaggggaacggtaaacccggacccccgggttaagtaccggaaacccggtacccggggttacccgggttagttttaacgttaacgtcggggtacggttaaccgggaaagggtaaacgggtacgggtttcccgggggaaacccccttaaaccgggtaaaacgttttaccccggacgtaacgtttaacggacgggttaacccgggttcgttaccggggggaaccctaaacggggtaacccccgg

SEQ ID NO: 382502 - DNA, 718 bp, Homo sapiens
  misc_feature: GZ8MTXP02GEV4U.13.76.G10.1.454.CMB.2.raw
  modified_base (569)..(569): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttccaccgtcagtcacacctacatgagcgtcgggtcccgccgaggcctccggaaggggaaggggcgtgggagtcggccgttcttctttttatttagtagtagtggttagtacctatacctccgacagtacctccggtgggacggggccgtattccaccgtatcctccgaagagaacctaaaattcccaaaagtaaaccacgtctttacgtttaccttaacaaaacttcgaaactacgacccgtaggaacgacgaccccgagttaccggaacccgtaaccggggtccgtttaaggttaacgtttaaccgnggttacggaccggtaacggtaagggaccggttacccggggggaaccccctaaaaccgggtaaaaccgtttaccgtaaaaccggtcgttaaacggtcggggtaaccggttacgggtaccgggggaacccgtaaacgggggtaacccccgg

SEQ ID NO: 382503 - DNA, 767 bp, Homo sapiens
  misc_feature: GZ8MTXP02IYPKA.13.76.G10.1.454.CMB.2.raw
  modified_base (284)..(284): a, c, t, g, unknown or other
  modified_base (471)..(471): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctattttaaaaggtgcccagtgtgaggtgcagctggtggagtctgggaggaggtcttgatccagccggtgggggtccctgagactctcctgtgcagcctcgtggttcaccgtcagtcacacctacntgagcgtcgggtccgccgaggcctaccggaggggaggggcgtggagtgtcgttctttactttttatttagtagttagtaggtagtacctactccgtacgactacgtaccgttcgggtggggacggggtacctacgttacccacctacgtacctccgaaaggaactaaacctaaactaacccgaaaanaacccgtacgttcgttttacgtttacctaacgaaaatcggaaaactcggtccgtaaggacgtaaccggccgtaaaggaccgaccggtaccggggttacttaacggtttactttacgggtacggtcggtaaccggaaagggtaagggttacccgggggtaaccccgggggtaaaccccctaaaaacggggtttaaaaccccgttttaacgtacccgtaacgtttaaacggggtcggggtaaccggggtttacccgggtaaccgggggaaaccccggggtaaaacgggggtacccccg

SEQ ID NO: 382504 - DNA, 605 bp, Homo sapiens
  misc_feature: GZ8MTXP02JQ9X4.13.76.G10.1.454.CMB.2.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagcccaccctcagtcgtccgtcgtccccaggacagacagccagcatcacctgctctaggaaataagtggacagataaatatacttctggtatcagcagagtcaggccacgtcccctgtgctgtcatctatcaagatcgaccaagccggaccctacgagggtactcccccgtagacgcgtacttcgtacgtcggccctacctaaacttccgtacggggaaccttccgaacgtcccaccgttcctacgaccctactaccgacggaccggaccccgaggcctagaggagtggaggactacgacttagttacgtagtcgagggcggtagggacgacgacgacgcctacgcggacccgtctaacgtcgttaccgttaccgggtaacgtccggggaaccgtaacgggtacccgtaaccggtaccgtaacggtaccgaaccggaacccccgg

SEQ ID NO: 382505 - DNA, 625 bp, Homo sapiens
  misc_feature: GZ8MTXP02HSPD2.13.76.G10.1.454.CMB.2.raw
  modified_base (298)..(298): a, c, t, g, unknown or other
  modified_base (411)..(411): a, c, t, g, unknown or other
  modified_base (480)..(480): a, c, t, g, unknown or other
  modified_base (541)..(541): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagcgtgggggtccctgagactctcctgtgcagcctgtgggttcaccgtcagtcaccacctacagtgacgcgtcgggtccnccgaggcctaccggaggggacggggctggagtcgcgttcttctttttattagtagttagtaggtacgtaccatacctcgacgataccgcgtgggacggggcctattccaaccncgtacctaccgaagtacaacctaaacttccgaaaagacctacgcctttatttccaacaaattgaaaacncggtacctaggaacgggacacccggagacgaacccggccggtaccgttaggttaccttagnggtaccgacggagtagacgtcggggaccccaagggtacttaccacgcgttagcggtacggtacgtcggggaaccaaggggcccc

SEQ ID NO: 382506 - DNA, 682 bp, Homo sapiens
  misc_feature: GZ8MTXP02FYQHJ.13.76.G10.1.454.CMB.2.raw
  modified_base (367)..(367): a, c, t, g, unknown or other
  modified_base (407)..(407): a, c, t, g, unknown or other
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctcgtgggtcaccgtcagtcacacctacatgagcgtgggtcccgccaggcctccggaggggacggggcgtggagtgcgttcttacttttatttatagtagtggtataccataccncgcacgaccgtcggtggacgggcctattaccacctatccnccaaggacaactaattaccaaagaccacgtcttagtttacctaactaaaacgtcgaaaaccgcgtaccctagggaacgacgacccggtagtaccgaaccgtaccgggtcccggtttaagtacgttaaccgtggtacggaccgggaagtaacgggacggttaccgggggaaccccctaaacgggttaaaaccggtttacctaaaccgggctttaaacggggacggggtaaaccggtttccgggacgggggaaccccgtaaacgggggtaacccccg

SEQ ID NO: 382507 - DNA, 634 bp, Homo sapiens
  misc_feature: GZ8MTXP02FMU2K.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtggttcaccgtcagtcacacctacatgagctgggtccgccaggctccgagggaaggggctggagtgcgtcttcttttattatagtagtggtagtaccatactccgcagacctcggtggacggggccagttccacctactctacccgaagacgaacaacttaccaaagaacgacgtccttagtttaccttaacaaaagttcgaaacacgtacccgtaggagtaacgcccgaagtcggaaccgaccgggtccgttagttaacttacgtggtacgacgaggagtacgtacgggggaccctaaacgggtaaaccgttacgtaaccggcgttaacgtacggtacccggttcggtacgggggacccgaacgggggtaaaccccg

SEQ ID NO: 382508 - DNA, 700 bp, Homo sapiens
  misc_feature: GZ8MTXP02FQM88.13.76.G10.1.454.CMB.2.raw
  modified_base (252)..(252): a, c, t, g, unknown or other
  modified_base (296)..(296): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctgggtggagtcgtggaggaggcttgactccaggccgtcggggggtcctgagctctctgtgcngctcgtgggtcaccgtcagtcacacctacatgagcgtcgggccncgacggctcggaaggggaggggcgtggagtcggtcgttctttctttttaagtttataggttacggtaggtaatacctactaccgtccgacacgtaccgtcgggtagggacgggggtcctaacgttcccaccgtaacttccctacccgaaaggtaaacgaaacctaaacgttacccaaaaggtaaacctaaccgtcttttacgtttaactaaccgtaaaaattccggaaaacctacgacccgtagggaacgaccgtacggtaaacgtcggaacgacccgggttacgttagttacgttacgtgtcggagacggtagacgggtccggggaacctaccggtaaaacgttcccgaggtaacttaaggtcgggtaccgttgggaccgggggacccaaaacgggggtcccc

SEQ ID NO: 382509 - DNA, 790 bp, Homo sapiens
  misc_feature: GZ8MTXP02JK6QS.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagctctcctgtgcagcctcgtggttcaccgtcagtccacacctacatgagtcgtcgggtcccgccgagggcctaccggaagggggaacggggcgtaggggaggttcggccggtttcccttttacgttttttaagttttaagttaagggtttaggttaggggttaacggttaacccctagttaacccgtacccggaccgtaacggtaccccgttccccgggtggggaccgggggtacccgtactttcccaaccgtaacttcctacccgaagaacgtaacctaaacgttacccgaaaacgtaaacctaccgtaccgtttacggtttttaccttaacgaaaacgttacgggaaaacccggggtccccgtaagggaacggtaaccggacccggtaagttaccggaacccgtaaccggggtcccggttaagttaacgttacgtacggtaggaccgtaaggacggtacggtaccgggggacccctaaacggtaaaccgttaccgtacgtacgtaacggtacggtacggtcggtacgggaccgtaacgggacccgtaaccgg

SEQ ID NO: 382510 - DNA, 697 bp, Homo sapiens
  misc_feature: GZ8MTXP02GL8VW.13.76.G10.1.454.CMB.2.raw
  modified_base (539)..(539): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggtcttgactccagtccggtggggggtccctggacgactcctccgtgtcgcacgtcctcgttcgggttcaccgtcagtccaccacctacatgacgcgtcggggtcccgaccgaggcctccgggaaggggaacgggtcgtaggtaggtcgtcgttcttacttttatttaagtagttaggtagggttactaacctacgtacctccgacgtacgtaccgttccggtggggtacgggtaccgtaacttccaccgtactcccgtaacaagtaagaacctaactacccgaaaaggaccctacgctttaggtttacctaaacgaaattcggaaaccncgtacgtaggacgtacgacgtacgacgaccgacggtcgtattgtacgtgtacggacgaggacggtacggtacccgggaacctaaacggtaacctaaccgtacgtaacgtacggttacgggaccggttacggaaccgggggaaccgtaaccgggacccg

SEQ ID NO: 382511 - DNA, 664 bp, Homo sapiens
  misc_feature: GZ8MTXP02H4VR8.13.76.G10.1.454.CMB.2.raw
  modified_base (271)..(271): a, c, t, g, unknown or other
  modified_base (283)..(283): a, c, t, g, unknown or other
  modified_base (336)..(336): a, c, t, g, unknown or other
  modified_base (565)..(565): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctcgtgggttcaccgtcngtcacacctacntgacgcgtcgggtcccgccaggcctccgaggggaggggctggagtgcgtcttnttttattatagtagtgtagtacctatactcgcagacgttccgtgggacggggcctacgttccaccgtactcctacccgaaagacgaaaccctaaatcccgaaaagaaacccgtacgtccgtttattttaccctaacgtaaaatcgtaaaaccgcgaccttaagggacgtaaccggacccgtaaagtccggaacccgtaaccggggttccgtaaggttacttttaacggnggtacggacggtaggacggtacgggtaccggacccgtaaccggtaaacgttaccgacgtgtacggtacggtacggtacgggacgggaccgtaacggccg

SEQ ID NO: 382512 - DNA, 812 bp, Homo sapiens
  misc_feature: GZ8MTXP02IWCUG.13.76.G10.1.454.CMB.2.raw
  modified_base (624)..(624): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggtttccttgttgctattttaaaaggtgcccagtgtgaggtgcagctggtggagtcgtgggaggaggcttgactccgacggtccggttcggggggtccctggacgacctcctccgtgtgcagtccctcgttcgggttccacccgtcacgtacaccacctacatgacgtcgtcgggtcccgccgacggccgtacggaaggggaacggggcgtgggaggtcggtcgtttctttactttttatttagtaggttaggttaggtagtaccctactaccgtccgtacgtacgtacccgttccgggtaggggaccgggggtaccgtaccgttacccaccgtactccctaccgaaaggaactaacccgttaaataccccgaaaagtacctacgtcctttagtttactaacaaaagtcgaaacacgccgtaggacggaccaccggatacccggacggaacccgggttcgttaaatttaccgtttacgggnggtacggtaaccggaagggtaaaccgggaccggggttacccgggggaaaccccccgttaaaacggtttaaaaccccggtttacgtaaacccgttccggtttaaaacgggggtttccgggggaaaacccccggttttcgggggaaccccggggggaaaacccggtttaaaaccccggggggtacccccg

SEQ ID NO: 382513 - DNA, 550 bp, Homo sapiens
  misc_feature: GZ8MTXP02I5M81.13.76.G10.1.454.CMB.2.raw
  modified_base (294)..(294): a, c, t, g, unknown or other
  modified_base (477)..(477): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtcccnccaggctccgaggggaggggctggagtgcgtcttcttttatttatagtagtggtagtacatactcgcagacctccgtggacggggccattccaccatcctccagagacaattccaaagaacacgctgtttctacaaatgaaacagcctaggagacgccgaatcgacacggccgtagtattacngtgacggagagagtcggggacccacgtaaccgttcacgctagtcggaccgtgtcggggacctaaggggaaccc

SEQ ID NO: 382514 - DNA, 576 bp, Homo sapiens
  misc_feature: GZ8MTXP02HRFYJ.13.76.G10.1.454.CMB.2.raw
  modified_base (254)..(254): a, c, t, g, unknown or other
  modified_base (374)..(374): a, c, t, g, unknown or other
  modified_base (420)..(420): a, c, t, g, unknown or other
  modified_base (472)..(472): a, c, t, g, unknown or other
  modified_base (507)..(507): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggaggaggtcttgatccagtccgtcggggtccctgagactctcctgtgacncgcctcgtcggtcaccgtcagtcacactacatgagcgtcggtccgcgaggcctaccggaggggaagggcgtaggagcgtcgtctttacttttattagtagtagtggtagtacctactacncgacagaccgtcgtcgggacgggtccgacttccacactctccaganaacgtactaccaagtacacgtcttgttactacaatcaaactcgtactagagngacccgagtacgacgtacggcgtagtactagtcgngacgagagacgtacggaccaacgtactaccgagtcgtaacgtcggacgtgtcgggactaacgggacccg

SEQ ID NO: 382515 - DNA, 619 bp, Homo sapiens
  misc_feature: GZ8MTXP02H8LUG.13.76.G10.1.454.CMB.2.raw
  modified_base (296)..(296): a, c, t, g, unknown or other
  modified_base (345)..(345): a, c, t, g, unknown or other
  modified_base (406)..(406): a, c, t, g, unknown or other
  modified_base (445)..(445): a, c, t, g, unknown or other
  modified_base (455)..(455): a, c, t, g, unknown or other
  modified_base (469)..(469): a, c, t, g, unknown or other
  modified_base (496)..(496): a, c, t, g, unknown or other
tcagtcacgtactaacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagctgggtccnccgaggcctccgaggggaacggggccggagtgcgtcttgttttatttanagtagtggtagtacatactccgcagactccgtgcggggccaattccgaaccatcctaccanaagacaaattcccaaagaaacacgcttgtttaccttaanaaatgaaacngctagagacgcganacgacgaacggtcgtagtaatttacgnggtcgacgaaggaggtacggtaccggggaacccctaaacggttaaaccgttacgtaaccgtacgtaacggtacggaaccggttcggtaaccgggggaacccgaaaacggggacccgtaacggg

SEQ ID NO: 382516 - DNA, 611 bp, Homo sapiens
  misc_feature: GZ8MTXP02FN2M3.13.76.G10.1.454.CMB.2.raw
  modified_base (261)..(261): a, c, t, g, unknown or other
  modified_base (393)..(393): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggtcnccgtcagtcacacctacatgacgctgggtcccgccacggctccgaggggagggctggagtgcgtctctttattatagtagtggtagtaccatactcgcagactccgtgacgggcctattcacatctccaganaactaattaccaagaacacgctttgtttactacaaatcgaaaccagtccctaggaacgacggtacccggaatccggaacgtaccggggtccgttagttaacgttacgtcgtaggaccgtaggaacggtacggtccgggggaccctaaccggtaaacgttaccgtacgtaacgtacgttacgggacggtcgttacgggggaccgaaacggggtaccccg

SEQ ID NO: 382517 - DNA, 749 bp, Homo sapiens
  misc_feature: GZ8MTXP02GVWW7.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggtcaccgtcagtcacacctacatgagcgtggtccgccgaggcctaccgaggggaacggggctgggagtcgtcgttcgttctttttagtttatagttagtggtagtactactacgtccgacacgtaccgtccggtaggacgggggccgtacgttccacctaatccctacgaagacgaacctaaagtttaccccgaaaagtaacccgtacggttaccctttaggttttaccctttaaaccgaaaagttccgaaaaccgtacgggtaccccttaaggggaacgggtaaccgaccccggaagtttaccgggaacccggtaaccggggttcccggttaagtttaaccgtttaaccgttaggggttcggaccggtaaggggaaacggtacggggttccgggggaacccccctaagggttaaaccggtttaaccgaacccggtacgttaaacggtcggggtaaccgttcggggttaccgggggaaaacccccggg

SEQ ID NO: 382518 - DNA, 716 bp, Homo sapiens
  misc_feature: GZ8MTXP02GXODA.13.76.G10.1.454.CMB.2.raw
  modified_base (535)..(535): a, c, t, g, unknown or other
  modified_base (596)..(596): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtcgtgggaggaggtcttgactccgacggcccggttcgggggggttcccctggacggtaccttccttccctggtcgcacgtccctcgttcggggttccaccgtcagtccaccacctacatgagcgtcgggtccgccgaggcctccggaaggggaaggggcgtgggagtcgtcgttcgtttactttttatttagtagttagtggttatacctataccgtccgcacgtaccgtcggtgggacggggtcctagttccacctactcctaccgaagacgaacctaacttaccgaaagaaaccctacgtctttacgttttacctaacgtaaaagtacgaaaaccncgtccgaggtacgacgaccggtaagtcgaaccgtaccgggtccgttagttacgtttacggngtacggacggaggtacggtaccgggtaccggggaaaccctaacggttaaccgttaccgacggtaacgttacggtaccgggtacggtaccggggtacggggaacccggtaacgggaccccg

SEQ ID NO: 382519 - DNA, 627 bp, Homo sapiens
  misc_feature: GZ8MTXP02GK6YJ.13.76.G10.1.454.CMB.2.raw
  modified_base (271)..(271): a, c, t, g, unknown or other
  modified_base (299)..(299): a, c, t, g, unknown or other
  modified_base (497)..(497): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtcgggttcacccgtnagtcacacctacatgagcgtgggtcccnccgaggcctccggagggaacgggctggagtgcgttcttcgttttattagtagtgtgtagtaccatactccgcaagcctccggtggacgggggcctacgttccaccctatcctaccgaagacgaactaacttaccgaaagaaccacgtccttgttttactaacaaatcggaaactagtcccgtagagacgtacccgaancggaaaccgccgggtacccgttagtacttaccgtgtaacgcggtaagaagtcggcggggacccaacgtaacgtttacgacgccgttaagtcggaccgttcggaacgggggacccaaacgggggtaccccg

SEQ ID NO: 382520 - DNA, 652 bp, Homo sapiens
  misc_feature: GZ8MTXP02H8T1C.13.76.G10.1.454.CMB.2.raw
  modified_base (286)..(286): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccaggccgtgggggtccctgagactctcctgtgcagcctcgtggttccaccgtcacgtcaccacctanatgagcgtcgggtcccgccgaggccgtccgaaggggaaggggcgtagggaggtcgcgttctttacgtttttaatttagtaggtagtcggttagtacatacctccgacacgtaccgtccggtacgggacgggggtcccgtacttccgaacctactccctaccgaagtaacgaactaaacgttacccaaaagaacccacgtctttacgttttactacgtaaaaatcggaaacacggtcctagaacggacgacgagtcgacgacggtcgtagtacttacgtgtacggcgaggacggtacggtaccggggacctaacggtaacgttaacgacgtactaaggtcgggtaccggttacggacggggtaccgg

SEQ ID NO: 382521 - DNA, 700 bp, Homo sapiens
  misc_feature: GZ8MTXP02HISE5.13.76.G10.1.454.CMB.2.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctatttaaaaggtgccagtgtgaggtgcagctggtggagtcgtggaggaggcttgatccagccgtgggggtccctgacgactctcctgtgcagcctcgtggttcaccgtcagtcacacctacagtgacgcgtcgggtcccgccgacggcctccggaaggggaacggggcgtagggagtggtcgttctttacgtttttaagtttagtacggttaggtacggttaagtactacttaccgtccgacgtacggtaccgttccgggtagggacgggggtacccgtaactttccaacctacgttaccctaccgaaaggtaaacgaacttaaacttacccgaaaacggtaaaccaccggttactttcggttttaccttaacgaaaacttcggaaaactcggtaccgtaggaacgacgaccgtaagacggaacgaccggtccgttagtacgttcgtaggtcgaggaacggacggtacgggtaccgggaccctaacggtaaccggttaactacgtacgttacgcgggtaccgtcgggtacgggaacccgg

SEQ ID NO: 382522 - DNA, 735 bp, Homo sapiens
  misc_feature: GZ8MTXP02GECJP.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctgggtggagtctggaggaggcttgatccagccgtgggggtccctgagactctcctgtgcacgcctcgtcggtcaccgtcagtcacacctacatgagcgtcgggtcccgccgaggcctccggaaggggaggggcgtggagtcgtcgttcttctttttatttagtagtagttggtaagtactacgtacctccgcacgtaccgtcggtgggacggggcctagttccacctatccgtccaaagacgtaaacctaacttacccgaaaaggtaaaccctaccgtcgtttacgttttaaccttaaacgaaaacgttacggaaaacctggtaccccgttagggaaacggtacccggaccgtaagttaccggaacccggtaccgggttaccgttagttaacttaaccggtggtaccggacggaaaggtacggtacgggttaccgggggaacccctaaacggttaaaacccgtttaccgaacggtaaccggtttaacggacggggttacccggttacgggacgggggtaaaccccggaaacgggggtaacccccg

SEQ ID NO: 382523 - DNA, 765 bp, Homo sapiens
  misc_feature: GZ8MTXP02IH6DB.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtcgtgggaggaggtcttgactccgagccgtcgggggtccctgagactctccgtgtgcgacgccgtgtcggttcaccgtcagtcacactacatcgagcgtcgggccgccgacggccgtccggaggggacgggcgtggagtgtcgttctttacttttattatagtagtaggtactacgtactaccgtccgtacgagtaccgtcggtcggggacggggtacctacgttacccgacctcgtacctacccgaagtaaacgaaaccctaacgttaacccgaaaacggtaaaaccctaccggttacttttacggttttaaccccttaaggaaaaaccttacggaaacccgttaaacgggcccttaagggaacggtaccggacccggtaagttaccggaacccgtacggggttaccgtttagttaaacctttacggtacggttacggttaaggaagggaccggggttagacccccgggggtaaaccctaacgggttaaaacccgtttacgtaccggtaagtttacggacggtacccggttacgggtccgggaaacggaaaacccggggtacccg

SEQ ID NO: 382524 - DNA, 758 bp, Homo sapiens
  misc_feature: GZ8MTXP02JQBQB.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttaagttttaaaaggtgcccagtgtgaggtgcagcgtggtggagtcgtgggaggaggtcttgactccgacggtccggtcgggggtccctgacgtactcctccgtgtcgctacgtccgtcgtcgggttccaccgtcacgtccacctacctacagtgacgtcgtcggtcccgccgacggtccgtaccggaggggacggggcgtggagtcggtccgtttactttactttttaagttagttagttaggttaggtacgtaccgtactaccgtccgactacggaccgttcgtcggggacggggtcctacgttaccaccgtactcgaccgaagaccgtaaacctaacttaaccgaacgaaaccgtcgttccgttacgttttaccttaaacaagttacgaaacgcgttacgagagtacgaccgaatcggaccgtacgggtccttagttaacgtacgtggtacggaggaacggacggtaacggggtaccccggggaaccctaaaaccccgggtttaaagttaccccgtaacggttaaccgttgggttacgggtaccccgggttacgggggtaccgggggtaaaccccgggaaccggggtaacccccgg

SEQ ID NO: 382525 - DNA, 687 bp, Homo sapiens
  misc_feature: GZ8MTXP02JBVRX.13.76.G10.1.454.CMB.2.raw
  modified_base (290)..(290): a, c, t, g, unknown or other
  modified_base (496)..(496): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctatttaaaaggtgcccagtgtgaggtgcagctggtggagtcgtggaggaggtcttgactccgagtccggtcgggggtccctggacgtactctccgtgtcgcagcctcgtggtcaccggtcagtcacacctanatgacgcgtcggtccgccgaggcctccggaggggaggggcgtggacgtgtcgtttctttacttttaagtttagtagttagtaggttactacctactaccgtccgagtacgtaccgtcggtcgggacgggaccgtattaccacctctacctccgaaaggactacctaaacgtacgaaaagacctacgttccttagtttacctaaaanaaacgtcgaaaccgtcgaccgtaggaacgtacgtaccgtaagtacggaccggtacggttacttagttacgtacggtggtaagacggtaagtacgggtaccgggtaaccggaacccgttaacgttaaaccgttacgtacgtaacgtacggtacgggtaccgtacggggaccggaaccggtaacgggtacccg

SEQ ID NO: 382526 - DNA, 608 bp, Homo sapiens
  misc_feature: GZ8MTXP02HBVDP.13.76.G10.1.454.CMB.2.raw
  modified_base (295)..(295): a, c, t, g, unknown or other
  modified_base (375)..(375): a, c, t, g, unknown or other
  modified_base (470)..(470): a, c, t, g, unknown or other
  modified_base (496)..(496): a, c, t, g, unknown or other
  modified_base (511)..(511): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtgggtccnccgaggcctccggaggggacggggctggagtgtcgttcttctttttattacgtagtagtggtactaccataccgtccganacgactccggtggacggggcctattccacctatccgtaccagacgaacctaattaccaaagaccacgtcttagtttacctaacaaagtcgaaacncgtcctagacgacgccgatcgaaccncggctgtacttacgngtcgacgagaggtacggtacggggaccctaacggtaaccgtttacgacgaacgttagtacgggtacgttacggacggggaaccgaacggggaccccg

SEQ ID NO: 382527 - DNA, 652 bp, Homo sapiens
  misc_feature: GZ8MTXP02J1IEM.13.76.G10.1.454.CMB.2.raw
  modified_base (255)..(255): a, c, t, g, unknown or other
  modified_base (425)..(425): a, c, t, g, unknown or other
  modified_base (460)..(460): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgccagtgtgaggtgcagcgtggtggagtctgggaggaggcttggatccaggccgtgggggtccctgagactctcctgtgcncgcctcgtggtcaccgtcacgtcacacctacatgagcgtggtccgcgaggcgtccgaaggggaggggctgggagtgtcgttcgttactttttatttaagtaggtagttggtacgtactactacctccgactacgtccgtccgggtagggaacggggccgtacttccgacncttccgaccaagacgaactaatacccgaagaaccncgtacgttcgttttactaacaaattagaactacggctaggaacggacggacccgtagtaccggaaccgaccgggtccgttagtaaacttcgtggtcggacggaggtaacggacggtaccggggacccctaacggttaaaacgtccgttacggacttacggtacggggaccgttacggggcgggaaacccccg

SEQ ID NO: 382528 - DNA, 693 bp, Homo sapiens
  misc_feature: GZ8MTXP02GGY2D.13.76.G10.1.454.CMB.2.raw
  modified_base (376)..(376): a, c, t, g, unknown or other
  modified_base (481)..(481): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctcgtgggttcaccgtcagtcacacctacatgagcgtcgggtcccgccgaggcctaccggaggggaaggggcgtggagtcgcgttcttcttttattatagtagtggtagtacctatacctcgnacgaccgtcgtcgggacggggccgtacttaccaccctacgtcctcccgaaagacgaaacctaagttaccgaaagaaaccctacggcctttggttttacccttaanaaaacgttcgaaaacccgcgtacccgttaagggaacggtaacgcccggtaattacgaaaccgtcccgggttaccgtagttaacgttacgttcgggtcgacgagggatacggggtccggggaacccctaaaccggtaaacgttaccgaacggtcgtaaacggtcggggtaaccgtacgggtccggggtaaaacccgaagggggtaaccccccg

SEQ ID NO: 382529 - DNA, 705 bp, Homo sapiens
  misc_feature: GZ8MTXP02GTXLO.13.76.G10.1.454.CMB.2.raw
  modified_base (629)..(629): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtcgtggaggaggcttgatccagccgtgggggtccctgagactctcctgtgcagcctcgtcgggttcaccgtcacgtcacacctacatgacgcgtcgggtccgccgaggccgtaccggaaggggaacggggtccgtaggggacgtcggtccgtttacgtttacttttttaagtttaagttaggttaggttaggttaacgtaacctacgttaccgttcccgacgaacggtaccggttcccggtaggggaccgggggtccctaacttacccgaacctaacttcccgtaccaaggaacgtaaacctaaacgttacccgaaaagtaacccgtacgttacctttacgtttcttaaacaaaagtcgtaaacgacgtccgagacggaacggcccaagtacggaaccgaccggtccgtaagttactacgtagtccgganaggagtacgggtccgacccgtaacgtaaaccgtaacgtccgagttacggtacggtcgttacgggacgggaacccgg

SEQ ID NO: 382530 - DNA, 553 bp, Homo sapiens
  misc_feature: GZ8MTXP02GJ1EH.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagctcgggtccgccaggcctaccgaggggaaggggctggagtgcgtcttcttttattatagtagtgtagtacatactcgcagctccgtgaggggccatcaccatcctcagagacaattcccaaagacacgcttgttctacaaaatcaaacagcctgagagcccgatggacacggccgtagtacttacgtgtcgcgagacggtacgtcgggggacccaacggtaacgtaacgtaccgcgtagtcgggtaccgtcgtacgggggaacccg

SEQ ID NO: 382531 - DNA, 825 bp, Homo sapiens
  misc_feature: GZ8MTXP02I1TOM.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggtagttttggctgagcttgggttttccttgttgtcttattttaaaaggtgccagtgtgaggtgcagcgtggtggagtcgtgggaggaggtcttgactccgacggccggtcggggggtccctggacgtacttcctccgtgtcgcgacgtccttcgttcgggttccaccgtcacgtccacctactacatgacgcgtcgggtccgccgaggccgtaccgggaaggggacgggtcgtaggacgttcgtccgtttcgtttactttttaagtttagttaaggttaggtaggttaacgttacctacttaccgtaccgaccgtacggtaccgttccgggtcggggaccgggggtaccttacgttaccacctactaccgtaacccgaagtaacgtaacctaaacgttaacccaaaaggtaccctacgttaccgtttacgtttttactaaaaccgaaagttacggaaaccgtaacggtcccggttaaaggggtaacacccgggacccgtaaagtaaccgggaacccgttcggggttaacccggtttaagttaccgtttaacggtggtacgggtaacggtacgggtaggacccgggttaaacccggggacccgtaaacgttaaaccggtttaaccacgggttaaccgttaggggtaccggttaccggtacgggggtaaacccgggtacccggaaacccgggttaccccgg

SEQ ID NO: 382532 - DNA, 624 bp, Homo sapiens
  misc_feature: GZ8MTXP02GMHVE.13.76.G10.1.454.CMB.2.raw
  modified_base (384)..(384): a, c, t, g, unknown or other
  modified_base (467)..(467): a, c, t, g, unknown or other
  modified_base (513)..(513): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtctggaggaggcttgatccagccgtgggggtccctgagactctcctgtgcagcctcgtgggtcacgtcagtcacacctacatgagcgtcgggcccgccgaggcctccggagggaggggctggagtcgtcgtctttacttttattagtagtcgtggtataccatacctcgtacgacgtccgtacgngggacggggcctattaccgaccatcctacgagagaaccaacttaccaaagtaaccacgtcttgtttactacaattcgaaacgnaccgtgacgacgaccgaatcgaccgtccgggtactagtacttacgngtgacggaggaggcggttacgggacccctaaacggtaaacccgttaagtacccggtaagtacgttacgggggaccgttacggaccgggggaaacccgtaacgggaccccgg

SEQ ID NO: 382533 - DNA, 738 bp, Homo sapiens
  misc_feature: GZ8MTXP02F2ODA.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcaagtggtggagtcggtggggggggcttgggttaagccgtgggggtccctcagactctcctgtgcaacctctggattctattttctctgacgcctggttgagcgtgggtccgccgaggcctccgaggggaacggggctgggagtgcgtcttcttttattatagtagtggtacgtacatactccgacacggaccccgtccggtggacggggcccgtattacccgacctatccctacccaagtacgaacctaaactttcccgaaaagaaaccgtacgtactttacggtttacctaacgtaaaaacgttggaaaaccctacggtacccgtaggaaacgtacggaaccccggtaagttacgggaaacccgtaccggggtaccccgttagggttaaacttaacccggtggttacggaccggtaaggacggtacgggtacccggggccctaaaacggtaaaccgtttacgacgtcgtaataccggggtaaaccgttcggtaacgggggaaccgtaaaacgggggacccaccggggttaccaccggtcctacctacccg

SEQ ID NO: 382534 - DNA, 669 bp, Homo sapiens
  misc_feature: GZ8MTXP02I9VFG.13.76.G10.1.454.CMB.2.raw
  modified_base (273)..(273): a, c, t, g, unknown or other
  modified_base (287)..(287): a, c, t, g, unknown or other
  modified_base (517)..(517): a, c, t, g, unknown or other
  modified_base (531)..(531): a, c, t, g, unknown or other
  modified_base (552)..(552): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgtctatttaaaaggtgcccagtgtgaggtgcagctggtggagtctgggaggaggcttgactccagtccgtcggggggtccctgagactctctgtgcagcctcgtcgggttcaccgtnacgtcacacctacngtgacgcgtcgggtcccgccaggctccggaaggggacggggtctgggagtcggtcgttcttacttttagtttacgtaggttaggtaaggttacgtaaccctataccgtccgaccgaagtacccgttcccgggtggggaccggggtccctagtttcccgaaccctatcccgtacaagggaactaaccctaaacttaccaaaaggacctaccgtcttttacgtttaccaaanaaacgtacgaaacngcgtaggacgacaccggtaanacggaccgtacggtacttagttactacgtggacggacgtaggagtcggtacccgggaaccttaacggtaaccgtcgacgtcgtaggtacggaccgtcggacgggaaccacgggaccg

SEQ ID NO: 382535 - DNA, 640 bp, Homo sapiens
  misc_feature: GZ8MTXP02JFCZV.13.76.G10.1.454.CMB.2.raw
  modified_base (256)..(256): a, c, t, g, unknown or other
  modified_base (379)..(379): a, c, t, g, unknown or other
  modified_base (420)..(420): a, c, t, g, unknown or other
  modified_base (520)..(520): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctntggggttcaccgtcagtcacacctacatgagcgtggggtcccgccagggcctaccggaggggaaggggctgggagttgccgttcttctttttaatttatagtaggtggtagtaccgattaccnccgcagaccgttcgtgggacggggccgtacttaccgacctntcctcccaagacgaaacctaattaccaaaggtaaaccacgtccgttagttttacccttagaaaatcggaaaacctcgacccgttaagagacgccggtaanacggaaccgaccggtcgtagttacttacgtggacgacgaggaggacggtaccgggaccctaacgtaaccgtacgacgtcgtacgtacggtaccgtacggtacgggaccgaacgggtaccg

SEQ ID NO: 382536 - DNA, 781 bp, Homo sapiens
  misc_feature: GZ8MTXP02HZJYT.13.76.G10.1.454.CMB.2.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtgggaggaggtcttgactccgaggccggttcggggggtccctgacggtaccttctccgtgtgcacgtcctcgtcgggttccaccgtcacgtccaactacctacatgacgtcgtcgggtccgccgaggcctccggaggggaacgggcgtggagtcgtcgttctttacgttttattagtagttaggtggtaataccacttaccgtccgacgtacgtaccgttcggtcggggacgggggtacctactttacccgaacctactacccgtacccgaagaacggtaaacctaaacttacccgaaaaacgtaaacccgtaccgttaccgttttacgtttaacctttaaaccgaaaacgttacggaaaaccctaacggtcccgttaaaggaacggtaaccgggacccgtaagtaccgaaacccgggtaacggttacccggttagttaaaccgttaccggtaggttaccggacgtaaaggtacggaaccgggttaccggggaacccctaaaacgggtaaccctttaaccggaacgtaaccgtaggtaccgggtacgtaccggggtacggaaccggaacgggtaccccg

SEQ ID NO: 382537 - DNA, 669 bp, Homo sapiens
  misc_feature: GZ8MTXP02J418B.13.76.G10.1.454.CMB.2.raw
  modified_base (255)..(255): a, c, t, g, unknown or other
  modified_base (264)..(264): a, c, t, g, unknown or other
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagttgtccgtgtccccaggacagacagccagcatcacctgctctggaaatacttggcagaatactattactctcgtagtcacganagaagtacncggccgacgtccccgtcgtggtctcggtctctactagtcaaagctacggccgacggcccgaccgtccgacggtcgtacccccgtcgacgtcgaagtttctcgttcggtcgtcctaaccgtccgtacggggtaacctcggaaacgtcccaacgtccctacgaccctgacccgactcggggaacccgtggggaccccgtaggtagtagttggaagttccggagttaccgttgtaacttctacggtacgttacgggtcggaacggggtacggacgggcgaaccgcggacgtccgtaccgtccgggtactttacccgtacgtttccgggttaacccgtaacggggttaccggtaaccggggttcccaaacgggggtttcccctaaaacggggttaccccttaaacccgg

SEQ ID NO: 382538 - DNA, 570 bp, Homo sapiens
  misc_feature: GZ8MTXP02GJWR7.13.76.G10.1.454.CMB.2.raw
  modified_base (319)..(319): a, c, t, g, unknown or other
  modified_base (361)..(361): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctatttaaaaggtgccagtgtgaggtgcagctggtggagtctggaggaggcttgatccagccgtgggggtcctgagactctcctgtgcagcctctgggtcaccgtcacgtcacacctacatgagcgtcgggtcccgccgaggcctccggaggggaacggggntgggagtgcgttcttctttattatagtagtggtatacatacncgcagaccgtcgtggacgggccattcaccatctcgagacgaactaataccaaagaacaccgtctttagttactacaaaatcgaaactagcctagagacgccgatacgacgaccggtcgtagtacttacgtgtcgacgagagacggtccggggaccaacgtaacgttacacgtgtacgcgggtacgtcggacggggactaacgggacccg

SEQ ID NO: 382539 - DNA, 586 bp, Homo sapiens
  misc_feature: GZ8MTXP02FET4M.13.76.G10.1.454.CMB.2.raw
  modified_base (578)..(578): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtcctgagactctcctgtgcagcctcgtgggtcaccgtcagtcacacctacatgagctggggtcccgcgaggcctcgaggggaaggggctggagtgcgtctcttttattatgtagtgtagtacatactcgtagactccgtgaggggccattcaccatctccagacgacaaattaccaaagaacacgtctgttttactacaaaatcgaaacgagtccctaggacgggtcccgaagtcgaacgaccgggccgttagtacttactggtagcggaagagtacgtcggggaccctaacggtaaccgttacacgcttagcgggtaacgtcggtacgggggacccaaacggggaccncgggtacc

SEQ ID NO: 382540 - DNA, 682 bp, Homo sapiens
  misc_feature: GZ8MTXP02JGWP1.13.76.G10.1.454.CMB.2.raw
  modified_base (607)..(607): a, c, t, g, unknown or other
  modified_base (639)..(639): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtggggggtccctgagactctcctgtgcagcctcgttggggtcaccgtcacgtcacacctacatggagcgtcgggtccgccgtagggcctccggaaggggaacggggctggagtggtccgttacttacttttattatagtacgtaggtagtaccatacctccgactacgacgttccgtgggacggggccgtattaccgaccattccaccgaaggaactaaactaacttacccgaaaaaggtaaccctacggtccttaggtttttaccctaacgaaaaattcgggaaaaccctaggtcccctaagggaacggtaaccggaccccgtaaagttcggaaaccccgtaacgggggccctttggtaaaccttgtcggagtaccgaggtanacgggtcgggaccctaacggaacttacgaacncgtaagtcgggaaccgttcggacggggaacccgacgggacccg

SEQ ID NO: 382541 - DNA, 607 bp, Homo sapiens
  misc_feature: GZ8MTXP02JJ4JP.13.76.G10.1.454.CMB.2.raw
  modified_base (281)..(281): a, c, t, g, unknown or other
  modified_base (486)..(486): a, c, t, g, unknown or other
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctgggtggagtcgtggaggaggcttgatccagccgtgggggtcctgagactctctgtgcagcctcgtggtccaccgtcagtcacacctanactgacgcgtcgggtccgccgaggcctaccggaggggaacggggcgtgggagtggcgttcttacttttagttagtaggtagtagtacgtacactactcgacagccgtcggaggtacggggccctattccaaccgtacttcccgaccgaaggacaaactaactaccgaaacacgacgtctttagtttacctaacgaaatcgaaacncgaccgtagacggacgaccgagtcggaacgtcggctagtaactcgtaggtcgagagacgtacggaccggggaccaacgtacgttaacgactacgtacggtcgacgttcgggacggaaccgg

SEQ ID NO: 382542 - DNA, 572 bp, Homo sapiens
  misc_feature: GZ8MTXP02HFO5T.13.76.G10.1.454.CMB.2.raw
  modified_base (297)..(297): a, c, t, g, unknown or other
  modified_base (326)..(326): a, c, t, g, unknown or other
  modified_base (335)..(335): a, c, t, g, unknown or other
  modified_base (469)..(469): a, c, t, g, unknown or other
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttccaccgtcagtcacacctacatgacgctggtccncaggctccgagggaggctggacgtgcgtntctttatanagtagcggtatacatactcgcagtctccgtggacggggaccctatcacctatcctaccaagacgtacaattacccaaagaacaacgtcctgttacctacaaaattcgaaactcggcctagacgacgcgttaacngaacgacggtcccgtattacgtacttaggcaggacgaggtacgacgggaccccaaggtaaccttaacgacgaacctgacggtaccttacggcgggaaacccgg

SEQ ID NO: 382543 - DNA, 646 bp, Homo sapiens
  misc_feature: GZ8MTXP02HB6L1.13.76.G10.1.454.CMB.2.raw
  modified_base (255)..(255): a, c, t, g, unknown or other
  modified_base (485)..(485): a, c, t, g, unknown or other
  modified_base (517)..(517): a, c, t, g, unknown or other
  modified_base (574)..(574): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttcttgttgctattttaaaggtgccagtgtgaggtgcagcgtgggtggagtcgtgggaggaggtcttgatccagccggtcggggggtcctgagactctccgtgtgacncgtcctcgtgggttccacgtcagtccacacctacatgagcgtcgggcccgccgaggcctaccgggaaggggaggggcgtggggagtcggcgtttcttactttttaagttagtacgtaggttaggtatacccgattccgtcgacgaacgtccgtaccgggttgggacgggggtcctacttacccactactctacccgaaggaaccaaactaacgttaccaaaggtaacccncggtacttctttactaacaaagacggaaaccncggccaagacggacgacccgagaccgaccgtacggtccggtattaactcggtagcgngagagacgtcggaccgacgtaacgtaacgacgtcgtagtacggtacggtcggacggacggaacggaacccgg

SEQ ID NO: 382544 - DNA, 593 bp, Homo sapiens
  misc_feature: GZ8MTXP02HY0SR.13.76.G10.1.454.CMB.2.raw
  modified_base (370)..(370): a, c, t, g, unknown or other
  modified_base (429)..(429): a, c, t, g, unknown or other
  modified_base (469)..(469): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtcctgagactctcctgtgcagcctctggggttcaccgtcagtcacacctacatgagcgtcggtccgccgaggcctccggaggggaaggggcgtaggagtgcgttcttctttttattagtagttagtggtataccatactcgnagactccgtgacggggcattcacctatctccagagactaatccaagaaacacgtcgttntttactaccgtaaatacaacgacgcctaggagagccgtanagacgacggccgttgtattacgtgtcggcgagaggtactcgggggaccctaaccggtaacgttaaccgtacgtaacgtacgttacggaccggttacggtacggggaaccgaaacggggaccccg

SEQ ID NO: 382545 - DNA, 778 bp, Homo sapiens
  misc_feature: GZ8MTXP02FFF8P.13.76.G10.1.454.CMB.2.raw
  modified_base (266)..(266): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctggtttccttgtgctatttaaaaggtgcccagtgtgaggtgcagctggtggagtcgtggaggaggcttgatccagccgtggggggtccctgacgactctcctgtgcagcctcgtggtccaccgtnagtcacaccacatgagcgtcgggtccgcgaggcctccgaggggaacggggcgtgggacgtggtaccgttcgttaccttttaagttttaagtaggttagggttggttaacgtaccccgtaacgttacccgtccggactaacggtaccttcccggggtagggacgggggtaccctacgttacccgaacctactttccgtacccaaagggaacgaaaccttaaacttaaaccgaaagtaaaaccccgtaggccctttaggttttacctaaacctaaaagttacgaaaaccgtcgtacccgtagggaacgacggtacccgggaattacccgggaacgtaaccccggggttaccgttaggttaataaccggtttaggacggaaccggaagggtaccgtaacgggtacccgggggaacccctaaaaccggttaaacggttaaacctcccggtaagtaacgggttacccgggtacggtccggtaacgggggaacccccggtaacggggtaaacccccgg

SEQ ID NO: 382546 - DNA, 545 bp, Homo sapiens
  misc_feature: GZ8MTXP02FNKAA.13.76.G10.1.454.CMB.2.raw
  modified_base (427)..(427): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggtcaccgtcagtcacacctacatgagctgggtccgccaggctccgaggggaaggggctggagtgcgtctcttttattatagtagtggtatacatactcgcagactccgtgagggcgtatccacatctcagagacaatccaagaaccacgcttgttctacgaaatgaaacngcctgagacgccgatcgacacggtccgtgtaattcgtgtcgacgagtacgacgtcggggaccctacggtaacgtctacgcgtagtacggacgttcgacggggacctaacggggacccg

SEQ ID NO: 382547 - DNA, 656 bp, Homo sapiens
  misc_feature: GZ8MTXP02GEFJD.13.76.G10.1.454.CMB.2.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgacctcacgcccaccctcagtcgtccgtcgtccccaggacagacagccagcatccacctgctactaggaaattaatggacagaataaatactacttctggtatcagcagagtcaggccagtcccctgtcgctggtcagtctatacaagtatcgaccaaggcccggtacctacgagggtacctcccccgtagacgcgtacttcgtacgtcggcctaccaacgttccggtacggtaacctcgacgccctactcgtacgacccagtaccgacgggcccgggtaaccccaggtacctaggcggtaagttacgggacggtacttaggtaaccttacgtttaacgtcggtacgtacgggcggttacgggaacagaccgacgaccgtaaccgtacggccccgtagttaacgtccgttaccggtttaacgggaaccgggtaccggaaccggtaaccggttacccgtaaacccggtaccgtaaacggtcccgaacccggtaaacccccgg

SEQ ID NO: 382548 - DNA, 582 bp, Homo sapiens
  misc_feature: GZ8MTXP02ISP7S.13.76.G10.1.454.CMB.2.raw
  modified_base (418)..(418): a, c, t, g, unknown or other
  modified_base (500)..(500): a, c, t, g, unknown or other
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggtcaccgtcagtcacacctacatgagcgtgggtccgccaggcctccgaggggaggggctggagtgcgtcttcttttattatagtagtgtagtacatactcgcagactccgtggaggggcctagttccaccatcctccaagacgaactaacttaccgaaanaaaccctacgtcttgtttaccttaacgaaactgaaacacgtcctaggacgtacgccgatcgaccacgggtctagtattacgngtggacgagacgtacgtcggggacctacggtaaacgttcacgaacgtgacggtacgttcgacgggggaccaaacgggacccg

SEQ ID NO: 382549 - DNA, 703 bp, Homo sapiens
  misc_feature: GZ8MTXP02JDP2I.13.76.G10.1.454.CMB.2.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctgggggtccctgagactctcctgtgcagcctctgggtcaccgtcagtcacacctacatgagctgggtccgccaggcctccgacggggaagggctgggagtgcgtcttcttttattatagtagtggtagtacatactccgacacgaccgtccggtggacgggggtcccgtagtttcccaaacctattacccgttaccgaacggaacgaacaaactttaccgaaaacggtaaaccaaacccggtacttcgggtttaccttaacctaaaagttacggaaaaccaacggtcccgttaggaacggaccggacccggaagttacgaaccggtaacgggtcccggttaggttaacttaaccgttaggttcggaccggaaggacggttaccggtacggggggaaccccctaacggttaaaacccgttaacgtaacccgggtacttacgggtacggtaccggtaccggttaccgggggaaaccccggg
